United States Patent 11,098,302 (IDENTIFICATION OF POLYNUCLEOTIDES ASSOCIATED WITH A SAMPLE) - sequence listing, part 61

SEQ ID NO: 209883 - DNA, 790 bp, Homo sapiens
  misc_feature: GYAE6OF02FR98V.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccacctcccagggtcgcagtcgtggtcgcagtcgtggggcgtgaggtaggaacgaaggccgtcgggggccctcggaggtaggtaacggtcctcctcggacgaagggccttcgtcggtacttaccttaaccgtttaccctaccttaatacgttaactactaacgttggggtacgccggtaccgacgggcccgtacgtcgggaaccaaccggtacccggtggacgggtacggggacggttggggacggtcggggacccgtaaacctaacgtacgttacggtgtaccgaacgtcttacggtccttaccaccccgacgttcccggtacgggaactacgtaccgttaaccacgttaccgacccgaaccgtaaaccgacccttttttttttacccaaacgtaaacccgtaaccgtaacgtacccttaacgtaacggttaaggtaaggttacggtaagggtaccgtaaccgtacgtaccgtaacgtacgtaccggtaccgacgacccggtaccgttaccgttacgttacgtcggtacggtccgtacgtaccgaccgtaccgtacgtaccggtacgtccggtaccggtacggtacggtccggtccggtcccggtttcgtaccgttcggtacccggg

SEQ ID NO: 209884 - DNA, 885 bp, Homo sapiens
  misc_feature: GYAE6OF02HYL45.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgctagtcgtggggctggaggtagaaggagccgtggggcctgaggtagaaggtcctccgtgacaagggtcttcgtagggtactttaccgtaccggttttaccctaccttaagtacggttaacttaccgaacggttcggggtacgtcccgggtacccgacgggtccccgtaccgttacggggaaaccgtaacccggtaccggttaagggtaccggttgggtaacggttacgggggaacgttaccggggggaacccctaaaaccccggttaacgaccggtttagggtacgttaccgaacgttacggttcggttacctttaccccgacccgttaaccggttacccggttacccggggtaaacctacggtttaaaccccgttaaccgtaacgttacccgaaacccgtaaccccgtaaccccttcccgttaaacaaacctaaaacccaccgtaacgtaaccctaaggtacgtttaacgggtacgtttacgggaacgttaccggaccgttaacgaccttaacgggtacgtaacggtaacccgtaccggtaacccgggtccgttacctttaacgttaccgtagggaaccgtacggtaacgtaccggttacccgacgggtaaccggttccggacgtacccggacccggttacggaccgtaaccggttccggttaaccccgttttaggtaccccggtttgggtaacccgggg

SEQ ID NO: 209885 - DNA, 697 bp, Homo sapiens
  misc_feature: GYAE6OF02GDXIS.17.25.C03.1.454.CMB.1.raw
  modified_base (176)..(176): a, c, t, g, unknown or other
  misc_feature (176)..(176): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtncagctggtgcagtctggggctggaggtagaagacgccgtggggcctcgagtgaaggtctcctgcaaggtcttcgtggattcctacgtttaccctcctaatagtactcgaacgtgggtcgccgccgacggcccgtcgtcggacctaaccgaccgtgaaggtggacgtggggacgtcggggaccgaaacccgttaacgacgtgggtcgtaccaacgtagttcgttaccttaccaccccgtacgttcccgtaccgggactaacgtacccttacctacgtacgaacccaaccgtaacctcccgtaaccaacttaaaccacgtacgacctaacgagtggtacgttaggacggacgtcccgtagacctacgtacgtacgaacccggtaacgacccggtacccgttacttacgttaacgttggtcgtacgggacgtaccgtacccgaacggtaaccgtccgggtacggacgttacccgtaacgggcacgggttccggtaccgtttacggtaccgtttcggtaccgggg

SEQ ID NO: 209886 - DNA, 863 bp, Homo sapiens
  misc_feature: GYAE6OF02IHOLE.17.25.C03.1.454.CMB.1.raw
tcagcgtagactagcacgaccggtgctcgatttagtagtgtagatttgggtttggggactcaacaaaccacatctgtcctctagagaaaaccctgtgagcacagctccctcaccatggactcggaccgtggaggactccttcttcgttggtggcagcagctaacaacgtacccactcccaggtgcagcgtggtgcagtcgtggggctggaggtagaagacgccgtgggcctacgaggtcgaacggtcctcctcgacgaacggtcttcgcgtacttccgtacgtttaccctcttaagtattactacgtaacgtcgggtacgccgaccgacggcccgtcggtaacggaacccgtaaccggtaccgttaggacggttacggtagggttcggggaggttaaccgggaaaccccgtaacccgtaacgtaaccggttgggtacgtaactaacggtacggttccgttacccttaccccgtaacccgttacgtacccccggttaaaccgggaccgtaacccgttaaacccgttacccgaagttaccccgaacccgtaacccggtttaaacccttccccgtaaaccgtaaaaccctaaaccgaaaccgtacccgttaaccgttaaccgtaacggttacgggttaacgggttacgggaacggtaccggtaccgtacggtaccttacgtaccggtaaccgaccgaacccggtaccggttccgttaacgttaaccgttacgttacggtaccggtaacgtaccgtacccgttaccgaccgggttaacggtcccggtacggtacccgtaccggaccgaaccggttccgggtcccggtttacgttcccggtaacggtttccggggaccgggtaaccgg

SEQ ID NO: 209887 - DNA, 742 bp, Homo sapiens
  misc_feature: GYAE6OF02HPDT0.17.25.C03.1.454.CMB.1.raw
  modified_base (575)..(575): a, c, t, g, unknown or other
  misc_feature (575)..(575): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgacagctggtgcagtcgtgggctgaggtagaagagccgtgggcctcagtgaaggtctccgtgcgaggtctctggacttcgtacgtttacctaccgttaatagtactacgaacggttgggtcgccggtaccgaacggggcccgtaacgtaggaaccgtaaaccggtaccgtaggtaagggttagggacgttacggggaacgttaccgggggaaccgtaaacccccgttaacgtaacggttcgggttacgtacccgaacggtacgttccggttaccttacccgtaaaccccgtacgttaccccggttacggggaacctaaccggttaaccttaaacccgagttaccggaaacccgtaaccgttaacctccctaacctaaactaaaccacgtacgtacctaanacggtacggtagttaccggagtacgtaccgttagaacgtctaacgaccgtaacgaccgtaacggtccgttacttacgttaccgtggacgacgtacgaccgtaccgaacgtacggttccggagtaaccgccgtaacgcgacgtccgtacttacgtacgtggtaccggg

SEQ ID NO: 209888 - DNA, 822 bp, Homo sapiens
  misc_feature: GYAE6OF02G49GD.17.25.C03.1.454.CMB.1.raw
  modified_base (185)..(185): a, c, t, g, unknown or other
  misc_feature (185)..(185): n is a, c, g, or t
tcagcgtagactagcacgaccggtgctcgatttagtagtgtagatttgggtttggggactcgaacaaccacatctgtcctctagagaaaaccctgtgagcacagctcctcgaccatggactggacctggaggatcctcttcttggtgcagcagctacaagtgcccactcccaggtgcagctggtncagtcgtcgggctggaggtagaaagacgccggtcggggccctacgtaggtagtaacgggtcctaccgtggaccgtaacgggtcctttcgtagggtacctttccgtaaccggttttaccctccgttaattaacggttacttaccgtaacggttcgggtacgtccgacggtaccgggccgtcggtaccggaacctaccgtaaccgtggtacggtggtagtcggggagtcgggaacctaaacccttacgacgttcgggtactacgacgtagttcgtaccgttaccaccgtaacgtcccgtaccggaactaaccgttaccttaccgaacgtttccggaacccgtaaccggttaaccctacccgttaaccgtaaacctaaaacccgtaccgtaaccgtaaccctaacggtaccgtaagggtacgttaacgggtacggaaccggtacgtaccgtacgtaaccgtcgtaacccggaacgtacccgtaccggtaccgttacgttacgttaacggtacgtacgtcggaacgttacccgaccgttccggaaaccggttcccgggtacgtaacccggtacccggtaccggtaccggtaccgttcccggggttacccttttacgggtccccgttaccggggtcccgggg

SEQ ID NO: 209889 - DNA, 858 bp, Homo sapiens
  misc_feature: GYAE6OF02IX6HR.17.25.C03.1.454.CMB.1.raw
  modified_base (186)..(186): a, c, t, g, unknown or other
  misc_feature (186)..(186): n is a, c, g, or t
  modified_base (236)..(236): a, c, t, g, unknown or other
  misc_feature (236)..(236): n is a, c, g, or t
  modified_base (815)..(815): a, c, t, g, unknown or other
  misc_feature (815)..(815): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccactcccagtcgcagctggtncagtcgtgggactgaggtgaagagccgtgggcctcagtgaaggtctccgngacgaacggtcttacgtggtacttactacgtttacctacctaattagtaactctaacgttggggtcgtccggaccgacgggtccgtccgtacgggtaaccaaaccggtacctaagggacgggttagggtaggttacgggggaacggtccggggtaaacccgtaaaacccccgttaacggaaccggtttaggggttaccgtaaccgtaacgtaacgggttttcggttaccctttaccccggaaaccctttacgtacccccggtacccgggtaaactacccggttaactttaacccgacgttaaccgaacccgtaacggttaaacccctacccttaaacccgaaaactaaaaccgactaaccgtaccctaaaccggtagtacggggtaaggttacggaaacgggtaccgtaccgtaaccggtaacctttaaccgtaaccgtagggaaacccggtaccccgtaaacggggttcccttaaaccttaaacgtttaccgggttacggtaccgggtaacggaacgttacccgtaccccgtaagggtccgtaacccggggtacgaccggtaacccgtaggtacccgngggttaccccgttcgtttacggtaccgttccggggtaaccggg

SEQ ID NO: 209890 - DNA, 809 bp, Homo sapiens
  misc_feature: GYAE6OF02F2NJA.17.25.C03.1.454.CMB.1.raw
  modified_base (190)..(190): a, c, t, g, unknown or other
  misc_feature (190)..(190): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacgaagtcgcccactcccaggtgcagtcgtggtcncgagtcgtcggggctggaggtagaaggaacgtccgtggggacctcgaggtaggaacggttcctcccgtagacgaacggtccttacgtacggtactttaccttaacggtttacccctcctaattaagtaaccttaccgaacggttcggggtcgccggaccgaacgggtcccgtcgtacggaaccaacggtccgtagacgggtcgggtaaggtgggacgtacgggggtaacctaaacccgtaacgtacgttacgggtccgttaccgaagtacgtttacgttcctacctaccgtacgtcccggttacggggaacctaccgtaacccgtttacccgtaacgtacccgaaaccgacccgttaaccctacccgtacctaaaaccgtaaacctaccgaacgtacctaaccgtacgttaccgggtaagttacggaacggtacggaccgtaacgtaccgtacgtaccgtacgtaaccgggaccggaccgggtaccttacgtaaccgtttacgtacggtcgtaacggacggttaccgtacccggacgtacggttaccggtacggtaccgaccgttaccgggcgtaaccgggttccttaccggtttacgtaccggtcgggttacccgggg

SEQ ID NO: 209891 - DNA, 891 bp, Homo sapiens
  misc_feature: GYAE6OF02GRDVZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtcgccagctggtcgcagtcgtggggctggaggtgaagacgccgtggggcctacgaggtagaacggtccttccgaggaccgaaggtcctttcggtacggtactttaccgtaaccggttttacctaccgttaagtacggttactacgtaacggttggggtacgcccggaaccggtacgggtcccgtacggtacgggaaaccctaaacccggtaccgttaggaagggttacgggaggttagggggtaacggtttaccggggaaaccccgttaaaccctaaacggtcccggtttagggttaccggttaaccgtaaaccgggttcgggtttccgttacccgtttaaccccgacccccgtaaacggttcccccgggtaaaccggggtaactaaccgggttaaaccccttaaccggtaacggttaacccggaaccccgtaaaccggttaaccccgttacccctaaacccgtaaaacgttaaaaccccgaaccgggaacccttacccggtaaaccgttacggttaccgggggtaaaccggttacggaaaccgggtccggtaccgtagacccgttacgtaaccgtacggaaccgaacccgtacccgggtacccttacgttaacgttaccgtggtacgtaccgaggtacccgtcccgtaaggtccgtaaccggtcaccggtacctaacggcgtaccggtccgttacgtacgtaccgtggtaccggg

SEQ ID NO: 209892 - DNA, 907 bp, Homo sapiens
  misc_feature: GYAE6OF02JUCLI.17.25.C03.1.454.CMB.1.raw
tcagcgtagactagcacgaccggtgctcgatttagtagtgtagatttgggtttggggactcaacaaccacatttgtcctctagagaaaaccctgtgagcacgagctcctcacctatggactcggaccgtgggacggtactcccttccttcgtttgggttcggccaggcctaggtccttaacaagtcgcccctacctacccgtaggtcggccagggtcctgggttcgcgtaggtcgtaggggtcctggtaggtaagaacggtaaccggtccggtcggggcccttacgtacggtacggtaacggttcccgttacgtcggtacgtaacgggttcttacggttaggtaccgttaccgttaccggtttaccttaccgtacgttacgttaacttacgtaacggtggttcggaccgaccggtccggtccgttaccggtcggtaaccgtaacccggtacgtacgggttaagggtacgggtacggtacgggggtaacgttaccgggtaacccgttaaacccgtacgttaccggttagggtaccgttaccgtaaaccggtcggttcgttaacccgttcccggtaacccgtacccggttacccgggtaaccggtaaaccgcgttaaacccgtacctaaccgttccggaaacccgttaaccgtacccttaacccgtaacctaaacgtaaaccccatacccggtaactcgtaaccgtaggtaccgtaggtacgtgaacgtcgacgtctacggtacaccggtaccgacggttccgttaacgttaccgtttacggtacgtccgaacgtaccgggtaaccctcggtaaccggttcccgtaacgggtccggttacccggtaccggaacggtaccggacggttccttaaccggttgttccgggtttaccggcgggtaaccccggg

SEQ ID NO: 209893 - DNA, 886 bp, Homo sapiens
  misc_feature: GYAE6OF02GIN6B.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaaggaagccgtggggcctcagtgacggtctcctgacgaaggtcttcgtggtacttccgacgttttaccctctaatagtatcaacgttgggtcgccgccgaggcccgtcgtacggacctaaccgtaccgtggaaggtcgggaagtggggacgtacggggtacccgtaaaacccgtaacgaccgttgggtacgtaccgacgtacgttcgttcccttaccgaacccctacgtaccccggtaccggggtaacctaccggtaacccttaaccgtaacgtaccgtaaacccgaaaccgtaacccttaccccgttaacctaaaaccgtaaaacccaccgtaaacctaccccgttaaagtaacggttacggggtaacggtttacgggaaacgggttaccggtacccgttacgggtaaacctaccggtttaccgaaccggtaaacccgggtaaaccggtaccccggggtttaacccgttaaccgtttaaaccgttttaccggtacggttaccgggtaaccgtaaccgggtacccgttaccccggaaaccgggttacccgggttaaccggggttaacccggaacccgggtttaaccccggtaacccgggtaccggtaacccggggggtttaccccggttttacccccggtttttaacgggttaccccggtttaccgggggttaaccccgggggg

SEQ ID NO: 209894 - DNA, 831 bp, Homo sapiens
  misc_feature: GYAE6OF02G92UE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggaccgtggaggattcctcttcgttggtggcagcaggtctacaagtcgcccactcccgaggtcgcgacgtcgtggtcgcgagtcggtcgggcgtaggtaggtaggaaagaacgccggtcggggtccttcggaggttaggtaaggttccgtaccgtcggacgtaacggtccgttacggtaggtccgtttactacccggttttaccttaccgtaattaggtaacttacgtaacggtgggtaccgtcggaccgtacgggacccgtcgacggtaaccgtaaccggtaccggtaggtacggttacgggaagggttggggacgtcggggtaaccgaaacccgtacgtaaccgttgggacgtacgacgttacgtgtacccgtacgtacccacggttaccggccgtaaacgtacggttacctacggtaactaccggacctaaacgtccctactaccgtaaacaactacgacctaccggtacaggttacggcgttaacggacgacgaccgtacgaactcgttaaccggtcggtaaccggcccgggtaaacccgtccgttaaccgtttaaagggttcctacgggtaccgaacggttaaccggacccgggttccaacccgggtcggttaaacccgggccgtaaaccggtaccggtaacccggtccgtaacccggtacccgggtttcgttacccgggtttacccggtaggggttaaccccgggg

SEQ ID NO: 209895 - DNA, 761 bp, Homo sapiens
  misc_feature: GYAE6OF02HK3E0.17.25.C03.1.454.CMB.1.raw
  modified_base (185)..(185): a, c, t, g, unknown or other
  misc_feature (185)..(185): n is a, c, g, or t
  modified_base (625)..(625): a, c, t, g, unknown or other
  misc_feature (625)..(625): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatcctcttcgttggtggcagcagctacaagtcgcccactcccaggtgcagctggtncgagtcgtgggctgaggtgaacgagcgtagggcctagagtgacgtctccgtgcgaggtcttcgtggtacttcgtacttcctccttaagtacgtactacgtaacgttgggtacgccgaccggagggccctacgtagggaaccctaaaccggtcccggtagacggtaggtagtggggaacgttcgggaacccgtaacctaacgaccggttgggtcgtacgacgtacggttacgttccgttacccaaccgtactcccggttaccggaacgtacgtaccgttacacgttacgaccacgtaacccttccgaaacaacgtaaaccaccgtactacccgtaacgtacggtacgggtaacgttacggacgtaaccgcgttaacgacgttacgaccgttaggaaccccggtaccgtaacggttccccggtttaattaaccggtttacgnggttaacccggaaccgttacgtaccccgggttccgtaaccgggttaccgttacccgggtctaacccggtaccggtaccggacccgtaacgggtccccggtttccggtttaacggacccggtttccgggacccgggg

SEQ ID NO: 209896 - DNA, 731 bp, Homo sapiens
  misc_feature: GYAE6OF02I9JID.17.25.C03.1.454.CMB.1.raw
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (313)..(313): a, c, t, g, unknown or other
  misc_feature (313)..(313): n is a, c, g, or t
  modified_base (485)..(485): a, c, t, g, unknown or other
  misc_feature (485)..(485): n is a, c, g, or t
tcagcgtagactagcacgaccggtgctcgatttagtagtgtagatttgggtttggggactcaacaaccacatctgtcctctagagaaaccctgtgagcacagctcctcacatggactggacctggaggactcctctttcgttggtggcagcagctaacagtcgcccactccgaggtcgcagtctggtcgacngtcgtgggtcnggtaggtgaagacggccgtgggacctgtaggtaggaacggttctccgtagacgtaaggctttggagtacttcttacttttaccgcttatagttacnctaacggtgggtcncgccgcggccgtacgaggacctaaccgccttggagtggaggttggagcggtaccgacctaacgtacgtggcgtcacgtgtttctccgttaccaccgacgttcccggtacgtacgtaacgttaccttaccaagtccgtaaccgaactaccgtacccttaacaaccgttaaacnccgtacgacttaacgtagtaacggtaacttgggaaccggtacgttacaacgttacgactttacggacccggttaaacgaccgttaacccggggtccctttagtttaaacccgttgttaggggaaacccctgggttaccgtccgttaacccgggagtaaccccggtttcggtaaccgggaccttaacccgggttcggtaaccgcggttacccgggtttcccggtaacgttccgtccgggtaacgggg

SEQ ID NO: 209897 - DNA, 659 bp, Homo sapiens
  misc_feature: GYAE6OF02G2ID4.17.25.C03.1.454.CMB.1.raw
  modified_base (156)..(156): a, c, t, g, unknown or other
  misc_feature (156)..(156): n is a, c, g, or t
  modified_base (213)..(213): a, c, t, g, unknown or other
  misc_feature (213)..(213): n is a, c, g, or t
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctanaagtgcccactcccaggtgcagctggtgcagtctgggctgaggtgaagaacgtccgngggcctcgagtcgaaggtcctacctgacgaaggtcttgtggattcacgtttacctctataggtactcaactgggncgaccaggccgntggacacgtcctggatggatgggatggggacctaacctanacgttggntcacgtacgtnttctaccaccagtcccgtcggaactacgaacttacccgataccgaacccacgtaaacctccaacctactaaaacaccgtaacgtacctacgagtaggtacgttggaacggtacgccgtagactacgtacgtacgacggaacccgtaccgtccgttaacgttacttaacgtcgtacgtaccgacgttaccggtaccctaaccggtcgttaccccgggtagtaccggtcccggtaaccggtccggtaaccgggttcccggttaaccccggttttccgtcccggtttacggtaccccgggggg

SEQ ID NO: 209898 - DNA, 802 bp, Homo sapiens
  misc_feature: GYAE6OF02F96LU.17.25.C03.1.454.CMB.1.raw
  modified_base (215)..(215): a, c, t, g, unknown or other
  misc_feature (215)..(215): n is a, c, g, or t
  modified_base (659)..(659): a, c, t, g, unknown or other
  misc_feature (659)..(659): n is a, c, g, or t
  modified_base (664)..(664): a, c, t, g, unknown or other
  misc_feature (664)..(664): n is a, c, g, or t
  modified_base (668)..(668): a, c, t, g, unknown or other
  misc_feature (668)..(668): n is a, c, g, or t
  modified_base (701)..(701): a, c, t, g, unknown or other
  misc_feature (701)..(701): n is a, c, g, or t
tcagcgtagactagcacgaccggtgctcgatttagtagtgtagatttgggtttggggactcaacaaccacatctgtcctctagagaaaaccctgtgagcacagctcctcaccatcggactcggacctggaggactcctcttcgttggtggcagcagactacaagtcgacccacgtcccgaggtcgacaacgtcgtgggtcgacgtaggttccggngggggtaccttagggagggttaggaaagggaacgtacccgggttccgggggccccttacggacggttacggtaaaccgggttcctccgtacggtaccgaagggtcctttacggtaggttacttaccgttaacccggttttaaccctcgttaacgttaacgttaccttaaccaaacgggtttcgggggacgtacccgggtacccgtacgggtacccggtacccgttagggtaaacccctaacggtacccgttagggaacggtacggggtaaggtcggggtaaggtacccggggaacctaaaccccgtaacgtccgttaggtaccgtaccgaacgtggttccgtactaccgaccctacgtcccgttacggaacgtactacctacgactcgacccgaacgtaccgtacactaacaataccacgtacacgtagtgtaagttcgagtcncgtancgancgtaagccgtacgccgtattacgtacgttacgnggtacgtcgacgtaccgtccggaacgttcggtacggttacggaccggttaccgaccgggctaccggtaccgttaccgtttcggtaccgttcgggacccggg

SEQ ID NO: 209899 - DNA, 621 bp, Homo sapiens
  misc_feature: GYAE6OF02GQKPZ.17.25.C03.1.454.CMB.1.raw
  modified_base (244)..(244): a, c, t, g, unknown or other
  misc_feature (244)..(244): n is a, c, g, or t
  modified_base (367)..(367): a, c, t, g, unknown or other
  misc_feature (367)..(367): n is a, c, g, or t
  modified_base (464)..(464): a, c, t, g, unknown or other
  misc_feature (464)..(464): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttacctcctatagtatcaactgggtgcgccaggccgctggacaacgacctggagtggatgggatcgggaccgaaccctaagaaccgtggtcgtcacaggtcgtcttccacccngtcccgtaccgggacacgtacttaccatcgaccacgaacctcctaccaataaacacacgtacctaacagtagtaggttagacggacgccgtagaacncttcgtacgacgtaccgaccgggaccgttacgttaactttacgtggtacggcgaacggtacgtacccgaaccggtacggtaccccggtgggaacccgtaccgtaccgggaccgacggtacccgggttccgtttacggtaccgttcggtacccggggg

SEQ ID NO: 209900 - DNA, 658 bp, Homo sapiens
  misc_feature: GYAE6OF02GU7N5.17.25.C03.1.454.CMB.1.raw
  modified_base (608)..(608): a, c, t, g, unknown or other
  misc_feature (608)..(608): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtagaaggaacgccgtggggcctcgagtgaaggtcctccgtgcaggtcttcgtggacggcaccttcagcgtaactagttacgtttcaagtttgggtgccggacgggtcctcgtcggaacacggtccttggacgtggagtggggaagactcgtcctagtcgtagacaccaccaaacgtcacagacgtacgttcgacggcacgactcgaaccaacgtaacccggacgaaactaaactaaacgaacctaactaagttactcggtagtacgacgtaagaaccgacgtccgttagactacgtacgtaggaacggaccgtacgggtacctttaccgttacgttcgtggtacggacgaaggttaacttacttacgtaacgttaacactttacgtacctttttacccgtttaaccncccttttaccgttcccgtttacgtttccggtaccggttacctaacccggg

SEQ ID NO: 209901 - DNA, 796 bp, Homo sapiens
  misc_feature: GYAE6OF02JGBNE.17.25.C03.1.454.CMB.1.raw
  modified_base (124)..(124): a, c, t, g, unknown or other
  misc_feature (124)..(124): n is a, c, g, or t
  modified_base (516)..(516): a, c, t, g, unknown or other
  misc_feature (516)..(516): n is a, c, g, or t
  modified_base (526)..(526): a, c, t, g, unknown or other
  misc_feature (526)..(526): n is a, c, g, or t
  modified_base (565)..(565): a, c, t, g, unknown or other
  misc_feature (565)..(565): n is a, c, g, or t
tcagcgtagactagcacgaccggtgctcgatttagtagtgtagatttgggtttgggagtcagtctcagtcaggacacagcatggacatgagggtcccgctcagctcctgggctcctgctactcnggctcgagctgccagatgtgacactccagatcgaccacgtctccactcctcctgtctcgtcctgtggtggggtcagacgtccactactactacttcggaccgacacgtacgtaacggtaactttaaaaccttagtttaaacgttaggtactacgaacgacgtaaacgtaaaccggtaacggaaaaccgcccctaacgacccttaccgtacgtacttcgtaccggttcggtactacctaacctacccgtacgttccggtacggacggtaaccggttccggtaacccgtacccgttacggtaacggtcgttacggtaggtcggtagggtacggttacggtacgtacggtagtaacgttaacgttacttacgtaacctacctaactaccgtaccncgtaaccctntacccgtcgaacccgtagttggaaccgttgtaaacccgngttaacctttactaccgttactaaccgtacgtaaacgtacggttaaccgttaccttacccgttaccgggtacccgttaaccgttaccggtttagggtaaacccgggacggttaaccgttaaacggttcgtaaactaaccggttaacggttaaaaccgcggttacggttaccgaaccgttacccggttaccttaaccggttacccttcgtttaacccgttcccgttaacccg

SEQ ID NO: 209902 - DNA, 699 bp, Homo sapiens
  misc_feature: GYAE6OF02IHVRC.17.25.C03.1.454.CMB.1.raw
  modified_base (340)..(340): a, c, t, g, unknown or other
  misc_feature (340)..(340): n is a, c, g, or t
  modified_base (626)..(626): a, c, t, g, unknown or other
  misc_feature (626)..(626): n is a, c, g, or t
tcagcgtagactagcacgaccggtgctcgatttagtagtgtagatttggggtttggggactcaacaaccacatctgtcctctagagaaaaccctgtgagcacagcctcctcaccagtggacttcgggacctgggaggactccttctttcgttggtggcagcagctaacaagtcgcccactcccgaggtgcagcgtggtgcagtcgtggggctggaggtagaagagccgtcgggcctataggaggtaacggtcttccgagacgaggtccttggtaggtacttaccgttaccgtttacctaccttaatagtactacgtaacgtggtcgcgccgacggccgtntacgaacgaaccgacgtgacggttaggacggtgggagtcggaaccggtaacctacggtacgtcggttcgtaccgataggttcctacgtacctacccacgtttaccggacgggtactacgtaacttaaccacgttacgaacctacgacctacctaacactaaaccacgactctaacgcgtggtagtacgaacggtgaccttaggactacgtacgacgtaacgtaccgcggtaccgttaacttagttccgtaggtacacgggaaccgtaccgaccggaacggttaccnccgggttacggaccgtacccggacggtaccggtccgtaccgggttccctttacgccggtttcggtaaccgggg

SEQ ID NO: 209903 - DNA, 915 bp, Homo sapiens
  misc_feature: GYAE6OF02FLNSN.17.25.C03.1.454.CMB.1.raw
  modified_base (271)..(271): a, c, t, g, unknown or other
  misc_feature (271)..(271): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagttcgtgggggctggaggtgaagaacggccgtgggggtcctcgaggtcggtaaggtcctccgtgacgaaggtccttcgtaggtntttaccgtaccgttttaccctccttaattacgtaacttaccgaaccgttgggggttcgccggacccgtaccgggacccggtcggtacggtaacccgtaaaccggacccgttaggtacgggtagggacggttacgggggaaggttaccgggggaacccggtaaaacccccttaaaccgaaccggttacggggttaccgtacccgtaaccgtaacggtttcggttccccgtttaacccgtaccccctaaccgttaccccggttaaccccgggggtaacctaacggttacccctttaaccgaccgttaaccgtacccctaaaccggtaacccttaccccttaaccctaaacttaaaacccgaacctaccgtaccccgttacgtaacggttacgggtaacggtttacggacgggtaacgtcccgtagtaccgtaacgttaccggtacggtaaacccgaccggtaaccggtcccgtttaacgtttaacccgttaccgttaggtccggtaaccggtacgtaccccgttacccgaaccgggttaacccgttacccgggtacggaacccggtacccgttaaccgggtacccgtaccgggtccccgggtttacccggttttacccggttaccgttacccggggttaccggggg

SEQ ID NO: 209904 - DNA, 627 bp, Homo sapiens
  misc_feature: GYAE6OF02F3LYW.17.25.C03.1.454.CMB.1.raw
  modified_base (443)..(443): a, c, t, g, unknown or other
  misc_feature (443)..(443): n is a, c, g, or t
  modified_base (450)..(450): a, c, t, g, unknown or other
  misc_feature (450)..(450): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcgtggggcctcagtgaggtctcctgcaaggcttctggattcaccgtttacctctatagtatcaacgtgggtgcgccgaggccgcgtggaccaacggaccgtggaggtggagtgggagtcggggaccgtaaccctaacgacgtggtcgacgacaggttcgtcctcaccctacgtccgtaccgggacacgtacttaccatacgaccgaacgaacctccaccaataaaccacgtacnccctaanagtggtacgtagacggactccgagacctatcgtacggaccgacgaccggtcctaacttagtttaccgtggtccgacggtagcccggtacccgacggtacgttcccggtaggaaccgtacccgtacgggtacaccgggtccgggttaccttttacgggacccgtttcgggaccggggg

SEQ ID NO: 209905 - DNA, 591 bp, Homo sapiens
  misc_feature: GYAE6OF02FUBC4.17.25.C03.1.454.CMB.1.raw
  modified_base (245)..(245): a, c, t, g, unknown or other
  misc_feature (245)..(245): n is a, c, g, or t
  modified_base (273)..(273): a, c, t, g, unknown or other
  misc_feature (273)..(273): n is a, c, g, or t
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (365)..(365): a, c, t, g, unknown or other
  misc_feature (365)..(365): n is a, c, g, or t
  modified_base (416)..(416): a, c, t, g, unknown or other
  misc_feature (416)..(416): n is a, c, g, or t
tcagcgtagactagcacgaccggtgctcgatttagtagtgtagatttgggtttgggggactcaacaaccacatctgtcctctagagaaaaaccctgtgagcacagctcctcaccatggactggacctggaggatcctcttcttggtggcagcagctacaagtgcccactcccaggtgcagctggtgcagtcgtgggctgaggtgaagagccgtggggcctcgagtgaaggtctctgcaggcttcngattcacgttactctatagtatcatggncgcaggcngtgacacgtcngagtggatggatggaccgaacctacgacgtggtactacacgtagtctctaccaccctgtccccgtcggtaacncgtaaccttaccgatacgacctaacgtaaccctccgtaccaaagtaaaccnctaaccgaccgtaactcgtacgggttacgtaggacggtaacgtccgttacgacgtaacttcgtacgaaccgacccgtcggccttacttaacgttcgtagtcgacgtagtacccgcgtaacgtcgtaccggtgccgaacgtcggactcggtccgtcgttacgtccgtaggtccggg

SEQ ID NO: 209906 - DNA, 773 bp, Homo sapiens
  misc_feature: GYAE6OF02FVB26.17.25.C03.1.454.CMB.1.raw
  modified_base (184)..(184): a, c, t, g, unknown or other
  misc_feature (184)..(184): n is a, c, g, or t
  modified_base (226)..(226): a, c, t, g, unknown or other
  misc_feature (226)..(226): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtncgtagtcgtgggctgtaggtagaagacgccgtcgggcctagngtagtacgtccgtaccgtgaccgtaaggctttcgtaggtacttcctaccgtttacccgttccttaagtaacgttacaccttaaggtgggtaccgccggtaccgaccgggtcccgtacgtacgggtaacctaaccggtaccgttaggaagggttggtaaggtcgggtagggtacggacccgtaaaccctaacgtacgttcgggtactcgtaacgtacgttcgttaccgtacccgtaccccgtacgtaccccggtacgggaccgtacgttacccgtaaccgtaacggtaaccaccgtaaccctaacccgttaccctaaccgtaaacctaaacccgtacgtaacctacccgtactaccgtaaggttcggttaacgggacgacgtccgagtaccgtataccgcggtaaccgtccgtaccgtaccgtagtttaccgttacgtacgtacgtaccgaacgtacctacgaacccggtcgtaccgggtacgtacccgtaccgtcggaccggtaccggttccgttacctttaggtaccccggttgggtaccccgggg

SEQ ID NO: 209907 - DNA, 887 bp, Homo sapiens
  misc_feature: GYAE6OF02GHHIU.17.25.C03.1.454.CMB.1.raw
  modified_base (155)..(155): a, c, t, g, unknown or other
  misc_feature (155)..(155): n is a, c, g, or t
  modified_base (488)..(488): a, c, t, g, unknown or other
  misc_feature (488)..(488): n is a, c, g, or t
tcagcgtagactagcacgaccggtgctcgatttagtagtgtagatttgggtttggggactcaacaaccacatctgtcctctagagaaaaccctgtgagcacagctcctcaccatggactggactggaggatcctcttcttggtggcagcagctanagtcgacccactcccaggtcgcagcgttggtgcgagttcgtgggctggaggtaggaaacgtaacgcccggttcgggggccctcggagggttaggtaacgggttcccttaccgtacgtaccgaacggtccgtttcgtacgggtactttccggtaccgtttttacccgtccttaattacgtacttacgtaacgtgggtccgaccgtcccggacggtccgtcgtacggaaccgtaaccgtacgtggtacggtaggacggtagggtacggtaccgggacccgtaaacccgtaacgtcgttacgggtacgtaccgtagtacgttcgtacccttaaccnccccgtaacgttcccgggtaacccggtaacgtacgtaacccgttaccgtacgtaccgaaaccgtaccggtaacccttaccctaaacccgtaactaaaaccgtaacgtacccgtaaccctaacggaaccggttaggtaccggtttaacggaacccgggtacgttacccgtaacgtaccggttacgttccggaacggtaccggggtaaccctacccggggtttcccgttaaccgttttacgttaccgtacgggttaccgacgggttaacccggtacccggttacccgaaccccggttaagggttccccgggaacggtaccccggttaccgtacccgggtacggttcccgggttacccggttaccgggttttcggtaaccggttcccgggtttacccggggg

SEQ ID NO: 209908 - DNA, 727 bp, Homo sapiens
  misc_feature: GYAE6OF02GLIB4.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccacctcccaggtgcagctggtgcagtcgtgggctggaggtgaagacgccgtggggcctcgagtggaaggtctcctgacaggtcttcgtggtacttctacgtttacctcctatatacttaccaacgtgggtagccgtcccgagggcccgtcgtacggtaaccaaccggtacccgttggacggtacgggtacggttcggggaacgttccggggaacccgtaaaccccgttaaacgtaccgttacgggtaccgtaaccgtacgtacggtttacgttccccgttaaccacccccgttacgttccccggtaaccgggtacgtaacggttaacccttaaccgtacgtaccgtaacccgtaaccgtaacccttcccgtaacctaaacgtaaaccaaccgtacgtaccttaacgagttaggtaacgttacggacggtacgtacctagactacgtctaggaccgaccgaccgtcgtacttacgttacgtgtacgacgtactcgaccgtacgtacgtcggtacgcggttacccgcggtacgacggtccgttcgttacggtacgttccggacggg

SEQ ID NO: 209909 - DNA, 669 bp, Homo sapiens
  misc_feature: GYAE6OF02HR2BO.17.25.C03.1.454.CMB.1.raw
  modified_base (135)..(135): a, c, t, g, unknown or other
  misc_feature (135)..(135): n is a, c, g, or t
  modified_base (328)..(328): a, c, t, g, unknown or other
  misc_feature (328)..(328): n is a, c, g, or t
  modified_base (362)..(362): a, c, t, g, unknown or other
  misc_feature (362)..(362): n is a, c, g, or t
  modified_base (518)..(518): a, c, t, g, unknown or other
  misc_feature (518)..(518): n is a, c, g, or t
  modified_base (536)..(536): a, c, t, g, unknown or other
  misc_feature (536)..(536): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggaggatcctnttccgttggtggcacgtcagacctacaagtcgcccactccaggtgcagcgtcgtgctacgtcgtacgggctaggacgggtcgaacgtaacgtccggtcgggcctacgtaggtagtaacgtctcgtacgcgtaggtccttacgagtacttacctaccgtttcctacttaatagttacgacgtacgtcgggtacnccgacggtcggccgcgtaacgaccgaacgtacgnggtacgtaggacggaggtacgcggaaccgtaaccgaactcggtagtactcgagttacgtcgttacctaccctaccggtctacccggtacgaacgtaccgttaacaccgtacgccgaactacgaccttacccaactaactaaccactaacgacctanacggtgacgtacgtgacntagtcagtactagacgtcgtaccgtacgtacttagtaaccgtgacgtacgaccgtacgtaccctaggtaccgtaccggtagccgtacgtaccgcgtacgttccggttaccctaggttaccgtccggtaacggg

SEQ ID NO: 209910 - DNA, 912 bp, Homo sapiens
  misc_feature: GYAE6OF02H7OGO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcttcttcttggtgcagcagctacaagtcgccacctcccaggtgacagtcgtcggtgcagtcggtggggtctggaggtaggaagaacggccgtcgggggtcctcgtaacggtaggtaacgggttcctccgttacggacgaacgggttcctttccgtgggtactttaccgttaaccgtttttaccctaccgttaattacggttaactacgtaacgttcggggtcgccggtaccgtaacggcccgtacgtacgggaaaccgtaaccgggaaccggtggtacgggtagggtaacgttacgggggtaacgggttaccggggaaaccccgttaaaccccggttaaaccgacggtttacgggtaccgttaacaccggtacgtttacggttacccttaccgtacccgtacgttacccgggtaacggggacctaacggtaaccttaccgtaactaccggtaaacccgtaaaccggtaaccctttacccgtaaacccgtaaacctaaaacccgaacccgttaaccgtaaacccttacgttaacggtacgggttaaggttacggtaacgggtaccgtaccgtaccgtaacctacgttccgtaacgaacccggaccgggtacccggtaaccggttaaccgtttaacgtttacggtaccggttaccgggtacggtaccgttacccggttaccgtaaccggttaccgttacgggtccgtaacggtacccggtaacggaccggttccgggttcccggttaccgtttacggttaacccggtttggggtacccgggg

SEQ ID NO: 209911 - DNA, 784 bp, Homo sapiens
  misc_feature: GYAE6OF02I7214.17.25.C03.1.454.CMB.1.raw
  modified_base (707)..(707): a, c, t, g, unknown or other
  misc_feature (707)..(707): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtggggcctcgagtgaaggtctccgtgacgagtcttcgtggattcgtaccgtttacctccgtattagtactctaacgtgggttacgccgtccgaacgggcccgtacgtacgggaacctaaccggaccgttggagggtacggaggttggggaacggttacggggaaccgtaaacccgtaacgtacgttgggttacgttaccgaacgtagttcgttacccttaccgaaccccgtacgttacccgtaccggggacctaacggtaacccgttaaaccgacgtaccgaacccgtaaaccggtaacccttcccgtaaccctaaaactaaacccgaccggtaactaaccccgttaacgtacggtagggttacggttaacgacgggtacctccggttaaagacgtacgttacgacggaacccgtaccgtaccgggtcccgttaacttacgttaccgtcggtcgaaccggtagtacccggttacctaacgggtcgttacccgggngtaacccgggtccgtaaccggggtcctacgggttcccggttacccggtttaggacccggtttcgggtaacccggggg

SEQ ID NO: 209912 - DNA, 984 bp, Homo sapiens
  misc_feature: GYAE6OF02JWQ9Y.17.25.C03.1.454.CMB.1.raw
  modified_base (179)..(179): a, c, t, g, unknown or other
  misc_feature (179)..(179): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcancgtggtgcagtcgtggggctggaggtggaagaacgccgtcggggcctcaggtgaaggttcctccgtgcgaacggtcttcgtaggtacttaccgtaccgttttaccctccttaagtagttattccgtaaccgttggggttcgccggaccgtacgggtcccggacgttacgggaacccgtaaaccggtacccttagggtagggtacggggtagttacgggggtaacggttaccggggggaacccgtaaaaccccgttaaccgtaaccgggtttcggggttacgttaacccggaaccgttaaggtttcccggtttaccctttaacccccgtaaccccgtaaccggtttaccccccggttaacccggggggtaaaccttaaaccgggttaacccgtttaaaccccggtaccgtttaacccgggaaacccccgttaaaacccgggttaaaccccctttacccccgtttaaaccccgaaaaacccgtttaaaaaacccctaacccggtaaaccgttacccccgttaaaaccggttaacggtttaaccgggggttaacggttaacgggtaaaccgggggtacccgttaaccccgggttaagggtaaaccctacggtttaaccggtacccgggtaacccgtaacccgggtaacccgggttaccccggttactttaacgttaccgtttaggtcccgaacgggtaccgttaccgtaccgtaaccggtccgggttaaccggtacggaacccgtaccggtaccggtacgaccgggttccgttaccggtttcgttaccggttcccggggttaccgggg

SEQ ID NO: 209913 - DNA, 871 bp, Homo sapiens
  misc_feature: GYAE6OF02H2X4T.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctaacaagtcgcccactcccgaggtgcagtctggtgctaggtcgtgggcttggaggtagaagtaacgcgtcgggcctcgaggtacggaacgtcctaccgtacgacgtaacggtcttcgtaggtactttccgtaacccgttttaccctaccgttaagtacgttaacgtccgtaaacgggttggggtccgaccgtacccggtacggtcccgtcggttaaccggaaacccgaaaaccgggttacccgttagggtacggtaacgggtacggtacggggtaacggtacccggggaaacccgttaaaacccctaaggtaccggtttggtaacctaccgtaacgtaggtttccgtacctttacccgaacccgtacgttacccggtaccgggtaaacaaccggttaaccctttaaccgaggtaaacccggtaacccgtaaaccgtaacccgtttaaccctaaacccggttaaacaaaccgtaacccgtaacgtaacccgtaagtacggtaacggttaacggttacggaacgggtccgtaccgtacgtaaccgtaacgtcgttaacgaaccggaccggttaccgggtaccttaacggttaccttaagtcgtacggaacgttacgacccgttaccggaagtccggtaccggtaacggtaccggtaccggtaacgggtaccgtaccgggtaccgttacggtttaaccggtccggttacgggtaacccgggg

SEQ ID NO: 209914 - DNA, 929 bp, Homo sapiens
  misc_feature: GYAE6OF02FHSCZ.17.25.C03.1.454.CMB.1.raw
  modified_base (325)..(325): a, c, t, g, unknown or other
  misc_feature (325)..(325): n is a, c, g, or t
  modified_base (365)..(365): a, c, t, g, unknown or other
  misc_feature (365)..(365): n is a, c, g, or t
tcagcgtagactagcacgaccggtgctcgatttagtagtgtagatttgggtttggggactcaacaacacatctgtcctctagagaaaaccctgtgagcacagctcctcaccatggactggacctggaggactcctctcttggtggcagcagctacaagtcgcccactcccaggtgcagctggtgcagtcgtcggggctggaggtgaagacgccgtcggggcctcgaggtgaacggtcctccgtcgactaacgggtccttcgtagggtactttacctaaccggtttacccttccttaactacggtactccgaaccgttggggttcncccggccgacggcccggcttacgggactaaaccgtaccgngtacgggtcggtaacgtcggggtacgtacggggaacccgtaaacccctaaacgtacgttcgggttcgtaccgtaccgtaacggttcggttacccttacctaacccccgttacgttacccccgggtacccggaaaacggtaaacccgtaacccgttttaacgaaccgttaacccggaaccccgaaaacccggtaaccccttaccccggttaaacccctaaaaacctaaaaacccgtaaccctaaacccgggtaaccccgtttaaacgaaccgggtttaagggtaccgggtttacgaaaccgggtaccgtaccggttaaccgtaaccggtaacttaaccgttccggaaacccgggttaaccggtaacccggttaccgtttaacgttaaccgttaacgtaacggtaaccggtaccggtaacggttaacccgtacccccggtaacggtaaccggttacccgggaaccgtaaccccggggtcccgttaaaccggggacccgtaaccgggttaccccggtttaacccggtttaaccggttcccggttttaacccgggggtaccccggggg

SEQ ID NO: 209915 - DNA, 806 bp, Homo sapiens
  misc_feature: GYAE6OF02JVEKQ.17.25.C03.1.454.CMB.1.raw
  modified_base (129)..(129): a, c, t, g, unknown or other
  misc_feature (129)..(129): n is a, c, g, or t
  modified_base (596)..(596): a, c, t, g, unknown or other
  misc_feature (596)..(596): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggnggatccttctttcgttggtggcagcaggctaaccaaggtcgacccacctcccgaggtgacagtcctggtgacgtagttcggtggggctggaaggttggaaacggacgtccggtcggggaccctacgtaggtggtaaacgggttcctccgtcggtaccggaaggttccgtttacgtggtacttcctaccgtttacctactagttagttacacgtaacggttgggtccaaccgcgccgggccagtacggaactaaccgcgttacggagggttagaggttcggacgggtacgaccccgtaacgtagcttcggggtactacgaagttccgtagttccttaccacccgttacgtccggaaccgataccgttaccttacgggaacctacggtaccgaaccgtacctacctaccttaacaaacgacccgtagttaccaacggtcgtaacggtcgttacgacggtcgttaaccgngttaacctcggtacggtaacggaccgtaacccggtttaacggtaccctttacgttcctttaaacgggtcgtaacggtaccgttaacgtcccccggtaacggttaaccggtcggtaaccgttccgggttaaacccgacgggttaacccggtaccggttaaccggtcccgggttttaaccggttccggttccgggttaacgggtcccggggg

SEQ ID NO: 209916 - DNA, 760 bp, Homo sapiens
  misc_feature: GYAE6OF02IB9UJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagcgtggtgcagtcgtgggctggaggtgaagagccgtgggcctcgagtgaaggtctcctgcgaaggtcttgtggtacttctaccggttttacctccttaatagttactactaacgttgggcgtccgaccggacggcccgacgtacggaacctaaaccggtaccgtaggtacggttaggtaggtacggggtacggtcgggggtaacccctaaaaccccgttaaccgtacggttgggttacggtacccgtaacgtaccggttacggttcccgttacccgaaccccgtacgttaccccggttacccggggaaacctacggttaaccccttaaccgaaccgttaccggaacccgtaacccggtaccctacccctaaccgtaacgtaaaccctacgaccgtaccctaagtacgtacgggtacgttacggacgtacgtccctagactcgtacgtacggaaccgtacgacccggtacgtacgttacgttacgtgtacgtacgtaccggaccgtccgacgtacggttccggacgtacggtaccctacgggcgacggtccggtttacctcggtaccgttacgggacccgggg

SEQ ID NO: 209917 - DNA, 675 bp, Homo sapiens
  misc_feature: GYAE6OF02FTR2W.17.25.C03.1.454.CMB.1.raw
  modified_base (157)..(157): a, c, t, g, unknown or other
  misc_feature (157)..(157): n is a, c, g, or t
  modified_base (267)..(267): a, c, t, g, unknown or other
  misc_feature (267)..(267): n is a, c, g, or t
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctanaagtgcccactcccaggtgcagctggtgcagtcgtggggctgaggtgaagaagccgtggggcctcgagtgaaggtctcctgcaaggtcttcgtggattctacgtttaccnctatagtatcaacgtgggtcgcgccaggccgcgtggaaccaacgaccgtggagtggatgggagtcgggacaaccccgtaancgtggtgcacgngttctcttaccaccctacgtcccgtaccgggaacacgtaaccttaccagtacgaaccctaaccgaaccttccctaacctaactaaaaccgtaccgaacgtacccttaacgacgtacggtacgttacggacgggtacgccgtacgtaaccacgttcgaacggacggtaaccgtaccggtaccgttacttacgttaccgtggtcggacgttaggacccgtacccgacggtcgttacccgggacgtaacccggtacccgttaccgggacgtaccgggttccgttcccggtttaacgtccggttaccggtacccggggg

SEQ ID NO: 209918 - DNA, 803 bp, Homo sapiens
  misc_feature: GYAE6OF02GPEUU.17.25.C03.1.454.CMB.1.raw
  modified_base (187)..(188): a, c, t, g, unknown or other
  misc_feature (187)..(188): n is a, c, g, or t
tcagcgtagactagcacgaccggtgctcgatttagtagtgtagatttgggtttggggactcaacaaccacatctgtcctctagagaaaaccctgtggagcacaggctccgtcaccatggactggacctggaggatcctcttcttggtggcagcagctacaagtgcccactcccaggtgcagctggtnnagtcgtgggctggacggtgaagacgccgtaggggcctacgagtaggtacggtcctacgtcgacgaacggtcttcgtcggtactttaccgtaccggtttaccctaccttagttacggtaactctaacgggtcgggtaccgaccgtcccgaacggtcccggtccttaacggggaacctaaccgggttacccgtagggtaaccggggttacggacggttagggggtaccggtacgggggtaacccgtaaacccgtacggtaccgttaccggtcggttacgaccgtacggtcgttcgtacccgttaccaccgtacccggtccgtaaaccgcctacgtactaccgtacgaccgtaccgaaccttacctcctaaactaaaccgaccgtacgacccgtacacgtaacggtagttaaggaaccgggcgtacgttaccggactaacggtccgttaacgaccgttacccgtaccgtacggtaccgttacttaccgaggtttccgacgggtacctacggtcccgtaccggaacggtccggttacccgtaacggtaacccctttccgggacccggttaccggtacgggttaaccccctttgggttaaccccgtcggttaccccgggg

SEQ ID NO: 209919 - DNA, 803 bp, Homo sapiens
  misc_feature: GYAE6OF02HD79E.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctaacaagtcgcccacgtcccgggtgccagtcgtggtgcagtcgtgggctgaggtgaagagccgtgggcctcgagtagaggtcctccgtgacaggtcttcgtggtacttccgtaccgtttccctaccgtattacgttactacgaacggttgggtcgccgaccgacgggccgtcgtacgggaaccgaaccggtccgtagggacggtgggacggtaggggacgtacgggaacccgtaaaccctacgacggttaggtcgtaccgtacgtacggttcgttaccctacccgaacccgtcgtaccccggtaccgggaactaacgttaacccttaaccaccgtaccgaacccgtaacccgtaacccgttcccctaaacctaaacgtaaaacccaaccgtaccgtacccgtaacgtacggtacgggtaacgttaggaacggaccgtaccgtaaggacctaacgtccgtaacggacccgtaaccggaacccgttccgttacgttaacgttacgttcggacggtaacggaacgtcccggttaaccccgtggtaacccgggttacccgggtagtaacccggtacccgggtaacccgtccggtaccggttccgggtttacccttacggggtttacccgttaccggggtacccgggtaaccggg

SEQ ID NO: 209920 - DNA, 759 bp, Homo sapiens
  misc_feature: GYAE6OF02I8MMK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtcctcctgcaaggcttcgtggattcacgtttacctcctatagtactcaacgtgggtgcgccgaggccgcgtcggaaccaaccggaccgtggaggtggagtggggacgtcggggaccgtaaaccccgtaacgtaccgttgggtcgttacgacgtaggttcgttccttaccgaaccctacgttcccgtaccggggtaactacgtaccctttaaccaacgtaccgaaccctaaccggtaaacccttccccgtaaacccgaaaacttaaaaacccgaccgtaaccgtaccccttaaacgtaacggttacggggtaacggtttacgggaagggtaccgtacccttacgggaacctagttaccgtacgggaacccgtacgaacccggggtccgtttacttaacgtttaaccgtcggttaacgacggtaacggtaccttaacccggaaccggtacggtttcccggaggtacccggacccgttacggggcctaacgggtcccggttaccgtttacggtcgttccggggtaccggggg

SEQ ID NO: 209921 - DNA, 747 bp, Homo sapiens
  misc_feature: GYAE6OF02JJ20A.17.25.C03.1.454.CMB.1.raw
  modified_base (156)..(156): a, c, t, g, unknown or other
  misc_feature (156)..(156): n is a, c, g, or t
  modified_base (267)..(267): a, c, t, g, unknown or other
  misc_feature (267)..(267): n is a, c, g, or t
  modified_base (320)..(320): a, c, t, g, unknown or other
  misc_feature (320)..(320): n is a, c, g, or t
  modified_base (447)..(447): a, c, t, g, unknown or other
  misc_feature (447)..(447): n is a, c, g, or t
  modified_base (570)..(570): a, c, t, g, unknown or other
  misc_feature (570)..(570): n is a, c, g, or t
tcagcgtagactagcacgaccggtgctcgatttagtagtgtagatttgggtttggggactcaacaaccacatctgtcctctagacgaaaaccctgtgagcacagctcctcaccatggactggacctggaggactccttcttcgttggtggcacgcngtactagaagtcgcccactcccgaggtcgcagctggtcgctacgtcgtgggcttggaggtaggaagtacgcgtcgggacctcgaagtgacggtcctctcggctagtcttgngtacgttactaccgtttacctacgtattacgtaacgaccgtacggtcgggtcnccggtaaccgtacgggcgtacgtaccgggaacctaccggtcctagggtacggtgtaacggttgggaaccggttcgggaaccctaacctaacgtcgtaggtccacgtcgtacgttcctaccgttaccncccgttacgtccccggtaggtacgaaccgttactacgactaccgtaacctaccgtacctaccactaaacgaccctaacgtacctactagacgtacgtaggttacggaacgtcgtacccggttnaacgttccggtactacgggtaaccgcccgtaacgtccggttacttaccgttacggtcggtaaccgtaccgggtacgtacccgtaccgtaggtcccggttaaggtccggaccggttacccgaggtacccggttacggtcccgtttacggtaaccgttacccgggcgggtaacccgggg

SEQ ID NO: 209922 - DNA, 971 bp, Homo sapiens
  misc_feature: GYAE6OF02FIMOX.17.25.C03.1.454.CMB.1.raw
  modified_base (156)..(156): a, c, t, g, unknown or other
  misc_feature (156)..(156): n is a, c, g, or t
  modified_base (689)..(689): a, c, t, g, unknown or other
  misc_feature (689)..(689): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactctcttcttggtggcagcagctanaagtcgccctactcccgaggtgctacggctgggtcgacagttcgtacggggcgtggtagggtacggaaacgaacggccggttcgggggtccctacgtaacgggttaggaaccgggttccctccgttcggaacgtaaacgggttccctttacggttacggtaacgttttaccccgttaacccggttttaccccttacctttaaacgttaacggttaacttaacccggaaaacccgggtttttggggggtaccgccccgggtaccccggttaccggggtaccggtacccgggttaacggaaaacccggttaaaaccccggtccggtaacgttaaccgggggtagggtaacggtttaccggggggacggttaaccggggttacccccgaaaaccccgttaaacgttaaccgggtccgggttaccgttaaccgaacggttccgggtttacgtttcccgttaaccccgtaaccccggttacgttttaccccggtaacccgggggttaaccctaaacgggttaccccgtttaaacccgngttacccgaacccgtaacccgtaaccctaccgtaaaccccgtaaactaaaccgacctaaccggttaccctaagtacgtacgggttacgttacggtaacggtaccgttctaacgacgtacttcggaccgtaccggacccgtaccggtacgtactttaaccgttcctacggtagacccgggtacgtacctcccggtaaccggttaccgtacccgggttaacggccgtaccgttaaccggcggtaccggttcccgtacggtttcgtaccgggttccgggtccggg

SEQ ID NO: 209923 - DNA, 671 bp, Homo sapiens
  misc_feature: GYAE6OF02FSYVW.17.25.C03.1.454.CMB.1.raw
  modified_base (591)..(591): a, c, t, g, unknown or other
  misc_feature (591)..(591): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagcctggggcctcgagtgaaggtcctccgtcgacgaacggtcttcgtggtacttaccgtaccgtttacctcctaagttagtaactacgtaacgtgggttcgaccgtccgacggcccgtcgtacggaaccgtaacgaccgttgaggtcgggagtggggtagtcgggaccgtaacctaacgtcgtggtcgtacacgtacggttcgtaccttaccgacctacgtcccgtacgggactacgaccttaccgtagtaccgaccctacgtaacctcccgtaacctaaacgtaaaccacctaccgtaacctaacgtaggttacgacgggtttacggacgtaccgaccgtaggacctagtccgtagaaccgacgtaccgtccgtacttagttacnggtacgacgtacgtacgcccgacgtcgtccggtagaccgtacgcggctacggtccgttacgtcgtaccgttcggtccggg

SEQ ID NO: 209924 - DNA, 706 bp, Homo sapiens
  misc_feature: GYAE6OF02F1DQ6.17.25.C03.1.454.CMB.1.raw
  modified_base (266)..(266): a, c, t, g, unknown or other
  misc_feature (266)..(266): n is a, c, g, or t
  modified_base (497)..(497): a, c, t, g, unknown or other
  misc_feature (497)..(497): n is a, c, g, or t
tcagcgtagactagcacgaccggtgctcgatttagtagtgtagatttgggtttggggactcaacaaccgtacattctgtccttactagagaaaacccctgtgagcgacagctccgtcgaaccatgggactggacctggaggagtcctcttcttggtggctagcagctacaagtgcccactcccaggtcgcagctgggtgcagtcgtggggctggaggtgaaggacgcctggggccctcgagtgaaggtctccgtgcaaggctttcnggtattcgacgttttacctccgtaattaagttactacaacgtgggtcgacgccgacggcccgtctcggacaacgacctggaggtcggaacgtgggagtcggggaccgaacccgttaacaccgttggtacgtcgtaaccgaggttcgtcgtttaccacccgtagtacccgtaccgggacaacgttaaccgttacagtgaaccctagtaacctcccgtaactaacgtaaaccncgtacgaccttaagaagtggtaggttacgagggagtcctagccagttcggtacgacggtaccgtacgggtcccgtacttagttccgtcgtacgaccggaacgttacccgaccgtaacggtccgtaccgggttcgtacccggtcccggttacggacccgtaaccgggtcccggttacccgttttaggaccccttggggttaccccggggg

SEQ ID NO: 209925 - DNA, 606 bp, Homo sapiens
  misc_feature: GYAE6OF02GZ310.17.25.C03.1.454.CMB.1.raw
  modified_base (296)..(296): a, c, t, g, unknown or other
  misc_feature (296)..(296): n is a, c, g, or t
  modified_base (444)..(444): a, c, t, g, unknown or other
  misc_feature (444)..(444): n is a, c, g, or t
  modified_base (476)..(476): a, c, t, g, unknown or other
  misc_feature (476)..(476): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtagaagagcctggggcctcagtgaagtctcctgcaaggcttcgtgacttcacgtttacctcctattacgtatcaacgtgggtctcgccgaggccncgtcggaccaacgcctgaggtggagtgggatcgggacaaccctaacgcgtaggtgctacagtgttacctccacctactccgtccgggactaacgtaaccttaccgacgttaccgacacccgtaaccttaccctaccaagtaaaacccnccgactaccctatacgtggaggttacgagacncgtgactagtcctaggaccgtacgaccggtccttagttacttagtcgtgacgacgtacgtcccgaggtccgtcggtacgaccggccgttacggacctcggccggttcttcgtacggttcggtaccggggg

SEQ ID NO: 209926 - DNA, 813 bp, Homo sapiens
  misc_feature: GYAE6OF02FPWFL.17.25.C03.1.454.CMB.1.raw
  modified_base (731)..(731): a, c, t, g, unknown or other
  misc_feature (731)..(731): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctaacaagtcgcccactcccaggtgcagctggtgcagtcgtggggctggaggtagaagaagccgtggggcctcgaggtgaaggtcctcgtgcgaaggtcttcgtggattccacgtttacctctagtacgtaactactaacgtggggtcgccgtaccgacgggccgtcgtacgggaacctaaccggtacccgtaggaagggttcgggaacgttaggggggactttacggggggaacccttaaaaaccccgtaacggtaacgttcgggtacgtaccgtaacgtacgggtttaccggttaccttacccgaaccccgtacggtttaccccgggtacccggggaactaccgttaaacccgtttacccgtaacgtttacccggaacccgtaacccgtaaaccctttcccctaaaccgtaaaactaaaaccgtaaccctaaccgggttaacccttaacggtaacgtacgggtaaaggtttaggaacgggttacgaccgtacgaactacgttccgtaacggaccgtaccgtaccggttccggttaacttaacgtttagtcggtacggcgtaacgacccggtaacccnggtaaccgtaccggtcgtaaccggtaccgtaccggcggttaccgggcccggtttcgtaccggttccgttccgggtaccgggg

SEQ ID NO: 209927 - DNA, 713 bp, Homo sapiens
  misc_feature: GYAE6OF02JQELD.17.25.C03.1.454.CMB.1.raw
  modified_base (641)..(641): a, c, t, g, unknown or other
  misc_feature (641)..(641): n is a, c, g, or t
  modified_base (669)..(669): a, c, t, g, unknown or other
  misc_feature (669)..(669): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgtggtggcagcagctacaagtcgcccactcccgaggtcgcagctggtgcagtcgtgggctggaggtagagaagccgtgggcctcgtagtagtaaggtctccgtagacgaggtctacgttggtacttcgtaaccgtttacctcttaacttagttactacgtaacggtggtacggccgaccgacgggtcccgtacgtacggaaccgaaccggtaccgtggacggtgggaggttagggggacggtaccggggtacctaaaccccgtaaccgttaccgggtaggttccgtaacgaaccgtaggttcgttacccgttacccgaaccccgtaccgtacccgggttaacccgggaccttaaccggttaacccttaacaccgtttaccggaaccctaacccgaacccctttacccgaactaaacctaacccgacgtaccgtacctacgtaagtcgggtacgttagaaccggtctacgatactacgcacgaccgacgcgtccgtatcgtcncgtgacgcgacgtccgacgtcgtacganacggtacctggccacggtccgttacgtcgtaccgtcggtacggg

SEQ ID NO: 209928 - DNA, 752 bp, Homo sapiens
  misc_feature: GYAE6OF02IJ6I5.17.25.C03.1.454.CMB.1.raw
  modified_base (390)..(390): a, c, t, g, unknown or other
  misc_feature (390)..(390): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatcctacttcttggtggcacgcagctacaagtgacccactcccaggtgcagctggtcgactagtcgtgggctaggaggtgaagaacgccgtgggcctcagtgaacggtctcgtagacgacggtctactggattccgaccgtttacctctatcgtatacaacgtggtacgcgcgtacggccgtgtacggaaccgaacggtccgtagacggtcggtagtacgggagttcgggaacctaaccccgtaagtccgtacgggttacnccgaactaacggtcgttactccgtaacccgtacttcccggacgggaactaacgtaacctttaccgaacgttaccgaaccgaaacgttaaccctacccgttaaacccgaaacgtaaaaccccacgaaacgtacccttaagaacgttgggtaacgttaccgggaacgttaccgacccgttaaggaacctacggttaccaagggttaaacccgccgtaccgggtaccttaacccgttatttaacggtcgtaacggtagtaccgtaccgtacccggtactacgggtccggtacgtaccggttaaacccgtcgggtaccctaaccgggtccgtttaccccttaggttacccggtacgtaacccgggg

SEQ ID NO: 209929 - DNA, 789 bp, Homo sapiens
  misc_feature: GYAE6OF02FOKYJ.17.25.C03.1.454.CMB.1.raw
  modified_base (256)..(256): a, c, t, g, unknown or other
  misc_feature (256)..(256): n is a, c, g, or t
  modified_base (314)..(314): a, c, t, g, unknown or other
  misc_feature (314)..(314): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgccccactcccaggtcgccagccgtggtcgcagtcgtggggctggaggtagaagagccgtggggcctcagtagaggtctctgacaggcttgtgtnttccacgtttccctactagttagtacttacaacgtcgggttgccgtcacgggcccgtntacgggaccacggacgttgaggtcggagtgggtaagtcggggacccaaaccgtacgacgttgggtccgtacacgtagtactccttaccgaccctacgtacccggtaccgggaactacgtactttaaccgacgtaccaaccgtaccgtaactcccgtaacctaactaaaacccgactaaccgacctaacgtaccgtaagggtaacggtttcgaacgggtacttaccgggaacgtaacgtaccgttcgtaaccgggtaacctaacccggaccggttacccgtttaagttaacggttttacccgttagggttaccgaacccggtacggttacccgtaaccccggtaacccgttaaccgggtaacccgggttaaccgggtaaaccccgtccccgttaaccgggggtacccggtaacggtccccggggtttttaccgggtttaccggttaaccccggttttggggtaaacccccgggggg

SEQ ID NO: 209930 - DNA, 749 bp, Homo sapiens
  misc_feature: GYAE6OF02F1UKV.17.25.C03.1.454.CMB.1.raw
  modified_base (291)..(291): a, c, t, g, unknown or other
  misc_feature (291)..(291): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtctggggctgaggtgaagaagccgtggggcctcaggtgaacggtctccgtgcaaggcttctggattcacgtttacctctatagtatcaacgtgggtgcgaccnggccgcgtacggacaacgtaccgtggacgtggagtgggagtcgggaccgtaaccctaagactggtagtccgaacgtagttcgttccttaccaaccccgtacttacccggtacccgggtaactaaccgtaaccgtttaacccgaacgttaccgaaaccccgtaaccggtaaacccctttcccgtaaacccgtaaaacgttaaaaaccccaaccgtaaccgttacccttaaacgtacgttaacgggtaaggtttacggaaacgggtacgtccccgttagaaaccgtactttccgaacggaacccgtaaccgtacccggggtaccctttaacgttaaccgtttaaggtcggttaccgacgaacggttaccgacccgtaaggtaccgttacgggtcgaacccggttaccgtaaccggcgtacggtcccggttaccttttacggtaccgttcggtacccgggg

SEQ ID NO: 209931 - DNA, 746 bp, Homo sapiens
  misc_feature: GYAE6OF02HYZIJ.17.25.C03.1.454.CMB.1.raw
  modified_base (238)..(238): a, c, t, g, unknown or other
  misc_feature (238)..(238): n is a, c, g, or t
  modified_base (376)..(376): a, c, t, g, unknown or other
  misc_feature (376)..(376): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcgagtgaaggtctaccgngcaacggtcttagtggattctaccgtttacctacctatagtatacctaacgtgggtgcgccgagggcccgacgtaggaaccaaccggtacctaggtaggtggaaggtggggtagtacggggaccaaaccccgtaaacncggtggtcgtacacgtgttagtaccttcgaacccacgtaccgtccggggacaacgtaacccttaaccaagtaccgaaccgaaccgtaaccttcccgtaacctaaactaaaaccacgtaaccgtaccgaacacgtaggtagttacgggaggtaacgtccgtacgacgtacgttacgacggaaaccgtacccggaaccgggtaacccgttaccttaacgttttaacgtaggtaccgggtacggtacggtaaccgtacccgaacggtaaccggttccggttaacgggaaccggttaaccccgtacggggtaacccgtacgggttaccccggttaaccgtttttccggttaaccgtttccgggtaaccgggggg

SEQ ID NO: 209932 - DNA, 839 bp, Homo sapiens
  misc_feature: GYAE6OF02HOP47.17.25.C03.1.454.CMB.1.raw
  modified_base (149)..(149): a, c, t, g, unknown or other
  misc_feature (149)..(149): n is a, c, g, or t
tcagcgtagactagcacgaccggtgctcgatttagtagtgtagatttgggtttggggactcaacaaccacatctgtccgtctagagaaaccctgtgagcacagctcctcaccatcggactggacctggaggatcctcttcgtggtggcngtcagactacgaagtcgaccctaccgtaccctagggtcgccgtagtcgtgggtcgtaccgtaggttcggtacggggcttaggaaggtgaaacggtacgccgtcggggccctagaggtacggtaacggtcctacccgtaggtacgtaacggtcttacggtacggtacttaccggtacccgtttaccgtaccgttacgttaacgtacgttacctaacggtcgggtacgtaccgtaccgacggtccgtacgtacggaacctaaccggtctaagggtcggtaggtacggtacggtacgggtaccgggtaaaccgaaccgttaaccgtacgtcggtacacgtacgtacgtaccgttcgtaacccgtaccccgtaacggttccccggaacggtaacctaccggtaactaccgtaaccgtccgaacccggaaccgtaacccgttaccctaaaccgtaaacctaaacgaacccgtaacgtacccgtaaccggttaagtacggttaacgttaacggtaaccgtacgtacccgtcggaaactacgtaaggtaccgacgtaccggtaccgtactacgttaaccgttacgtaggtacgtacgaccggttcccaaccggtcggtaccggtaaccggtacgtaaccggtcccgttaagggacgttaccgtacccgttacggtcgttacgggtcccgggtaccgg

SEQ ID NO: 209933 - DNA, 823 bp, Homo sapiens
  misc_feature: GYAE6OF02HH4MP.17.25.C03.1.454.CMB.1.raw
tcagcgtagactagcacgaccggtgctcgatttagtagtgtagatttgggtttggggactcaacaaccacatatgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcgagtgaaggtctcctgcgaaggtcttctggattctacgtttacctctatagtactcaacgtgggtcgccgccgacggccgtacgtggaacctaaccgactggacggtggaatggggacgtcggggaccgtaaacccgtaacgtacgtcgggtcgtaccgaacgtaggtttcgttacccttacccgaacccgtacttcccggtaaccggggtaacctaacgttaacccttaccgaacgtaccggtaaccccaaaccggtaacccttcccgttaaaccaaacgtaaaaccctaccgtaaaccgtccctaaaacgtacggttacgggtaaggtttacggaacgggtaccgtaccgtaacgtaactacttaccggtacggtaaaccccggtacgtacccgggttacccgttaacgttaaaccggtttaccggttacggttacggaaccgggttaacggtaccccggtttaccccgaaacgggttcccgggtaccccggggtttaagaccccgggttaaccccggtttaaccgggggccttaaccccgggggtccggttttaccccggttttacgggtacccggttttaccggggtacccggggggg

SEQ ID NO: 209934 - DNA, 892 bp, Homo sapiens
  misc_feature: GYAE6OF02JKS28.17.25.C03.1.454.CMB.1.raw
  modified_base (96)..(96): a, c, t, g, unknown or other
  misc_feature (96)..(96): n is a, c, g, or t
  modified_base (157)..(157): a, c, t, g, unknown or other
  misc_feature (157)..(157): n is a, c, g, or t
tcagcgtagactagcacgaccggtgctcgatttagtagtgtagatttgggtttggggactcaacaaccacatctgtcctctagagaaaaccctgtnagcacagctcctcaccatggactggacctggaggatctcttcttggtggcagcaagtctanaagtgcccactcccgaggtgcagctggtgacacgtcggtgggctaggaggtagaacgtagccgtggggcctcgagtaggaacggtcctccgtgacgaaggtccttgcggtactttaccgtaaccgttttaccctaccgttaagttaacgtactacgtaaaccggttggggttacgcccgtccggtaccgggtcccggtcggtcgggtaaaccctaacccggaacccgttggtaaaccgggttgggtaacggttcggggggtaacggttcccggggtaacccgtaaaacccctaacggtaccggttacgggttcggttaccacggtacggtttccggtttacccgttacccgtacccgtaccgttacccggtacccggggtaaacctaacggtaacccttacccgacgtttaccgaacccgaacccggttaaccctacccgtaaccgtaaacttaaacccgaaccgtaccgttacccgtaactaacggtacgggttaaggtttacggaacggtacgtacccgtacgtaaccgtaccttacggaaccggttacccggtaccggaaccgttcccgtttaaccgtaacgtttaaaccgtagggtccggacgtaacccggttaccgttacccggtaacgttcccgggtaacggttaccggtaaccggtcccggtacccggaccggttaacccgggccggttttaccgttcccggttaaccggtttcgggtaaccccgggg

SEQ ID NO: 209935 - DNA, 660 bp, Homo sapiens
  misc_feature: GYAE6OF02G3EEJ.17.25.C03.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (273)..(273): a, c, t, g, unknown or other
  misc_feature (273)..(273): n is a, c, g, or t
  modified_base (303)..(303): a, c, t, g, unknown or other
  misc_feature (303)..(303): n is a, c, g, or t
  modified_base (340)..(340): a, c, t, g, unknown or other
  misc_feature (340)..(340): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (416)..(416): a, c, t, g, unknown or other
  misc_feature (416)..(416): n is a, c, g, or t
tcagcgtagactagcacgaccggtgctcgatttagtagtgtagatttgggtttgggggactcaacaaccacatctgtcctctagagaaaaccctgtgagcacagctcctcaccatggactcggaccgtggaggacttcctcttcgttggtggcagcagctacaagcgcccacgtcccaggtgcagcgtggtgcagtcgngggctggaggtgaagacgccgtgggcctnagtacgagtctcgtgacaggtctcgagtagtttccaacgtttccncttagtaggtatccgaaggttgggcgaccncagggttcccagaccggacaaacgtaccgtgaggtanagggtcggagtcgggacctaccgtaagctggtgcctaaggngttcnctttaccgccctaacgttcgaccggaactnaaccttaccgatcccggaaactaaccggaacctacctaccgaaacttaaaccacgtaccacttaccaaggtcgtaaaggtcggtaaggactcccggataaccagttgtacggaacgtaccgaccgtaccgtacgttacttactaggcgtacgtaacccggcttacccgaacgtcggtccgggagaccggttaccgaggtacggtaccggccggtttacccgtcggtttcgttacggaccggggg

SEQ ID NO: 209936 - DNA, 697 bp, Homo sapiens
  misc_feature: GYAE6OF02GCTSL.17.25.C03.1.454.CMB.1.raw
  modified_base (125)..(125): a, c, t, g, unknown or other
  misc_feature (125)..(125): n is a, c, g, or t
  modified_base (163)..(163): a, c, t, g, unknown or other
  misc_feature (163)..(163): n is a, c, g, or t
  modified_base (324)..(324): a, c, t, g, unknown or other
  misc_feature (324)..(324): n is a, c, g, or t
  modified_base (409)..(409): a, c, t, g, unknown or other
  misc_feature (409)..(409): n is a, c, g, or t
  modified_base (461)..(461): a, c, t, g, unknown or other
  misc_feature (461)..(461): n is a, c, g, or t
  modified_base (587)..(587): a, c, t, g, unknown or other
  misc_feature (587)..(587): n is a, c, g, or t
  modified_base (686)..(686): a, c, t, g, unknown or other
  misc_feature (686)..(686): n is a, c, g, or t
tcagcgtagactagcacgaccggtgctcgatttagtagtgtagatttgggtttgggggactcaacaaccacatctgtcctctagagaaaacctgtgagcacagctctcacatgactgactggagntctcttctgtggcagcagctacagtgaccgactccagngcagtcctggtgactaggttcgtcggggacttggaggtaggaacgaacggtccggttcggggcctacgaggttagaacgggttcctacctacggactaggccttagcggttacttaccgttacgtttaccctacgttaagttactagtacaacgtgggttnccgtacgacggcccgtgtaccgaacgtaccgacgttggaacggtggacgtggggaagtcgggaccctaaccgtatacgtggttcngtaactaggtcttacctacgaccctgtacccgaggaccacgtacctaactanacgtaccgaacctacctacctaccaaagtaaccacacgttacccaacgtggtacagggttagaggcgtaccgtacgagtacctcgtacgaacccgaacgtccgtaccgtacgtttatcccggttanccggtaccgacgggtaccgtcccggtaaccgacgttaccgggtaccggtacgaccggttaccgggacttcggtcccggttactttcggtacccgggttntacccgggggg

SEQ ID NO: 209937 - DNA, 781 bp, Homo sapiens
  misc_feature: GYAE6OF02JO87U.17.25.C03.1.454.CMB.1.raw
  modified_base (266)..(266): a, c, t, g, unknown or other
  misc_feature (266)..(266): n is a, c, g, or t
  modified_base (709)..(709): a, c, t, g, unknown or other
  misc_feature (709)..(709): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggacttcctcttcttggtcggcagcacgctaacagtcgccacgtcccgaggtcgcgagcgtcggtgactacggtcggtgggctggaggtacggaaagacgccggtcggggacctgacgtaggtaacgttcctcggtanacgtaacggtcttacgtaggtcttactaccggtttaaccctcgtaagtaacgttcgttaacgtaccggtgggtacgtaccgtccggaacggccgtacgtaccggtaaacgtaccggaccgttagaacggttagggtaccgtaggggtaccggtaaccggtacccggtaaaacccttaacggcgtttcggttaacgaccgtacgtaacgggtttccttaaccttccgtaacccggtacgttacccgttaacgggaacccgtaaacggttaacccttccggaacgacccgtaaagtaaccgtaaccgttaaccctaaccgtaacgtaaacctaacggtactaccgtaacgtcgtaggtaacgttaacggaacgtacgtacgtacgacgtacctacgtcgtaaccgcgtaccgtaccgttacgttacgtacgtcgtaacgttacgngtaccgttaccgacggtacgtacgtacgtacgacgtcggacgtagaccgttcgtacgtaccgtcggtacggg

SEQ ID NO: 209938 - DNA, 761 bp, Homo sapiens
  misc_feature: GYAE6OF02GSC2X.17.25.C03.1.454.CMB.1.raw
  modified_base (573)..(573): a, c, t, g, unknown or other
  misc_feature (573)..(573): n is a, c, g, or t
  modified_base (651)..(651): a, c, t, g, unknown or other
  misc_feature (651)..(651): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggatcctcttcgttggtggccagcagctacaagtcgcccactcccaggtgcagcgtggtgcagtcgtgggctggaggtaggaagacgccggtcggggcctcgaggtaggacggtcctccgtcgacgacggtcttcgtggtacttccgttaaccgtttaccctaccttaagttagtaaccgttacgtaacggttcggggtacgccggaccgtacgggcccgtcgtacgggaaccctaccggtaccgtcgggtaggtgggaacggttggggtacgtaccgggggtaccctaaaccccgtaaccgtacggttcgggttacgttaccgacggtacggtttcgttacccgttaccgaccccttacgtaccccgggttccgggaaacctaccggtaacctttacccacgtaccgaacccgtccgtaaccctccctaacgaacttaaaccnccgttactactacgagtcggtacgtgggacgtactccgtagtacctgtaccgtcggaaccgttccgaccggttacttnttaacgttcgtcgaggaccgtacgtcctacccggagtcccggtacggtacgtccgtacccacgggtcgccggttaccggttccgtttccggtacttccgggtacccgggg

SEQ ID NO: 209939 - DNA, 889 bp, Homo sapiens
  misc_feature: GYAE6OF02FXABR.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagtctacgaagtcgcccactcccgaggtcgacacgcttgggtcgcgtacggttcgtacggggcttgggagggtaggaaacggaacggtcccggtcgggggtcccttcgaggttacggaacggttcctccgtaggacgtaacgggtccttgtacggtactttaccgttaaccggttttaccctaccgttaattaacggttaccttacggtaacgttcgggggttaccaccggacccggtacgggcccgtacggttaccgggaaacctaaaccggtaccgttacgggagggttacgggtaggttacgggggtacgttacggggaccgtaaaccctacggtaacgtcgggtactaccgtaagtcggtttacgtccttacccgacccgtaccggttcccggtaaccgggtaacctacggttaaccctacgtacgtaccgaaacccgtaccggttaacccctacccggtaaacaaaccgtaaaaccgtacctaccgtacccgttaacgtacggtagggtaacggtttacgggaaccggttcgtaccgtaagaccttacgtaacgacggtaaccggccgttaaccggggtaccttacgttaaccgggttctcgggtacgtaacggtaccggtacccggtactaaccggggtccgttaccggggtacggtcccgtacccgggttacgggccggttaccggttcccgggttacttacccggtaccgggttccggggttaacccgggg

SEQ ID NO: 209940 - DNA, 620 bp, Homo sapiens
  misc_feature: GYAE6OF02FIFYC.17.25.C03.1.454.CMB.1.raw
  modified_base (152)..(152): a, c, t, g, unknown or other
  misc_feature (152)..(152): n is a, c, g, or t
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
  modified_base (371)..(371): a, c, t, g, unknown or other
  misc_feature (371)..(371): n is a, c, g, or t
tcagcgtagactagcacgaccggtgctcgatttagtagtgtagatttgggtttggggactcaacaaccacatctgtcctctagagaaaacccgtgtgagcacagctcctcaccatggactggacctggaggatcctcttcgttggtggcagnagctacaagtcgcccactcccgaggtgcagctggtgcagtcgtgggctagaggtgaagagccgtgggcctgagtgaggtctcgtgacgagtctcgngtattccgaccgttacctcgatagtactctacgtggcncgccgacgccgtgtcggacctaacgaccgtggacgtggagttagggactcggggacctaaccccgactacgtgggacctcgacgngttcgtacctacgaacccctagtcccgtaaccgggctaccggtacttacccgataccggacccaacgtacctactcccgaactaaccacgtaccgacctagagtcggtagtaggacgtacgccacgtatacgtcctaggacgtacgtccgtcgtattacgtacgtcggtagcgtacgtccgtacgaccgttcgaccggtcgacgtacgtccgcggaccgtaccggtcgttacctccggtcggtaccggg

SEQ ID NO: 209941 - DNA, 771 bp, Homo sapiens
  misc_feature: GYAE6OF02I7CHW.17.25.C03.1.454.CMB.1.raw
  modified_base (316)..(316): a, c, t, g, unknown or other
  misc_feature (316)..(316): n is a, c, g, or t
  modified_base (664)..(664): a, c, t, g, unknown or other
  misc_feature (664)..(664): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagctggtgcagtcgtgggctggaggtagaaagacggtccgtcgggggtcctcaggtggtaaggtcctcccgtgccgaaggtcctcgtggacttacctaccgttttacctccttagtaacgtatacaacgttgggtccncgtaccgacggtcccgtcgtacggaccaaccgtaccgtaggaggttccggtaggtggggtacgtacggggacccgtaaaccctaacggtaaccgttgggtacgtacaacgtcgttacggttacccttaccgtaacccgtccgttacccgggtacccggaacgttaaccggtaactttacccgaacgttaccggaaaccccgtaaccgttaaccctcccctaacgtaaacctaaacccgtaacgtaccgtaacccctaacgagttaccggggtaaggttacggtaggtaccgtaccgtcgtaactacgttcccgtagacccgtaccgaccggtcgttacttaacgttcnggtacgacggtaccgtaccgacccgtacggaaccgttccggacgtccggaaccgttcggaccgtaccggtccgttacggttttaccgccggttacggtaacccgggg

SEQ ID NO: 209942 - DNA, 836 bp, Homo sapiens
  misc_feature: GYAE6OF02JF4FF.17.25.C03.1.454.CMB.1.raw
  modified_base (186)..(186): a, c, t, g, unknown or other
  misc_feature (186)..(186): n is a, c, g, or t
  modified_base (262)..(262): a, c, t, g, unknown or other
  misc_feature (262)..(262): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtgcagcagctacagtcgcccactcccgaggtgcagcgtggngactaggtcgtgggtctggaggtaggaaacgacggtccggtcggggacccttgacggttagtaacgggtcctccgnggtaacgacggtccttacgtgtacgttacctaccgtttaccgtctatagtactaccgtaaggttcgggtcgccgggaccgcgggttcccgcgtaacggaacccgtaaaccggtccgtagggtaggtacgggtacggtagggtacggttaaccgggacccgttaaaaccctacggtaacggttcggttacgacctacggtaacgggttttccaaccgtttcccaacccggttacgtccccggtaaccggtactaaacccgtacctaacccggtacgtacccgtaaaccgtaaccgtaccctacccgttaaccctaaaccgtaaacctaaccggtaacccgtaaaccggttaaccgttaacggttaaccgggtaacggttaccgggtaaaccggtaccggtaaccggttaaccgtacgttacccgtacgttaccgaaccgtaccggtaccggtaccgttaccgtacgttacgtcgtacgacgtacgaccgtaccgtacggtctacggtaccgtacggtaccgtaccggacggtcccggttacggtacccgtcggttacccggttacgggtaccggg

SEQ ID NO: 209943 - DNA, 908 bp, Homo sapiens
  misc_feature: GYAE6OF02JJSEQ.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttgggtcggcagcagctacaagtgcccactcccgaggtgcagctggtgcagtcgtgggctgaggtagaagagccgtgggctaaggtgtaaggtcctcctgcaacggtcttcgtggtacttcgtacgtttacctctagtacgttacgtacaacggttgggtcgaccgtaccggacggtcccggtacgttaggaaccgtaaccgtaccggtaggtagggtacgggacggttcggggtaggtaccggggtacccgtaaacccgttaaccgaacgggtttgggttaccgtaccgtaaccgtagggttaccgtttaaccgtaccctaacccggtacgttccccgggttaccggaacgttaaccgttaaccctaacctacggttaacccgaacccgttaaacccggtaacccctttacccaaacccgttaaactaaaccccgaaccgtaacccgtacccgtaaaccgttaggtaccggggtaaacgggtttaacgggaaccgggtttaccgtaacccgggtaacgtaaaccgttactttaccgggaaccggaaccggttaccccggaccgggtttacccgtttaacgtttaaccgttacggtacggttacgtaacccgggttaccgtaacccggttccccgaacgggttttacccggtaccggggttaaccgtaccggttaacccgggtacgggttaccccggtacgggttacccccggttttaccggtttaacgggttacccggtttaccggggtacccgggttaacccgggg

SEQ ID NO: 209944 - DNA, 665 bp, Homo sapiens
  misc_feature: GYAE6OF02F335X.17.25.C03.1.454.CMB.1.raw
  modified_base (71)..(71): a, c, t, g, unknown or other
  misc_feature (71)..(71): n is a, c, g, or t
  modified_base (144)..(144): a, c, t, g, unknown or other
  misc_feature (144)..(144): n is a, c, g, or t
  modified_base (155)..(155): a, c, t, g, unknown or other
  misc_feature (155)..(155): n is a, c, g, or t
  modified_base (188)..(188): a, c, t, g, unknown or other
  misc_feature (188)..(188): n is a, c, g, or t
  modified_base (290)..(290): a, c, t, g, unknown or other
  misc_feature (290)..(290): n is a, c, g, or t
  modified_base (437)..(437): a, c, t, g, unknown or other
  misc_feature (437)..(437): n is a, c, g, or t
  modified_base (487)..(487): a, c, t, g, unknown or other
  misc_feature (487)..(487): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
tcagcgtagactagcacgaccggtgctcgatttagtagtgtagatttgggtttggggactcaacaaccganatctgttccctctagagaaaaccctgtgagcacagctcctcaccatggactggactggagatcctatcgtggngcagcagctanaagtcgtacccactccgaggtcgcagctaggtnacagtcgtagggtctaggaggtagaaagtacggccgttgggacctagaggtagacggtcaccgtgaacaagggtccttgtaggtactttacaccgtttaccncgtatagtatacgagtggtcgacgtcacggtccagtaggacaaccgtacgtgaagtaggacgtgggaacgttcggaaccctaaccgaacgtacgtgggtacaccgtacgtagttcgaccttaaccgaccctacggttccggacgaanactaacgttacatacggaaccacgtactcaacgtataacgcgacacctanagtgtagngacggtncctanactactaagtacgacgttacgaccgttcctagttccgtaaggtcgtaccgaaggtccgttacccgacgtaaccggtcgttaaccggacggtacgaccggttaaacggccgtaacggttacccggttactttaccgggtacccgttccggggaaccggg

SEQ ID NO: 209945 - DNA, 698 bp, Homo sapiens
  misc_feature: GYAE6OF02IGP6N.17.25.C03.1.454.CMB.1.raw
  modified_base (190)..(190): a, c, t, g, unknown or other
  misc_feature (190)..(190): n is a, c, g, or t
  modified_base (310)..(310): a, c, t, g, unknown or other
  misc_feature (310)..(310): n is a, c, g, or t
  modified_base (537)..(537): a, c, t, g, unknown or other
  misc_feature (537)..(537): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccacctcccgaggtcgcagtcctggtncgagtcgtggggctggaggtgaagacgccgtacgggccctcgaggtgaacggtctcctgactaaggtccttcgtggattccgacgttttacccactattagtactacgtaacgtggtacncggaccaggccgcgtgggaaccacgtacctggtagtcggagtgggagtcggggaacctaacccgtagacgtcggtacactacgtagttcgtcttccgaaccctcgtacccggtacggactaaccgaccttaccgagttccgaaccgtaaccgaccgtccctaacgtaaacctaacgaaccggttacacccgttacgtacggtacggtaaggttacgaacgggtaccncccgttaacggacccttagtaccgtaccggaacctaccggtacccggttccgtactttacggttaccgtaggtcgtacgacgtaccgtaccctagtcggtccggacgtccgaacccgtagcggtaacggtcccggttacgttagtcccggtagtcccgggg

SEQ ID NO: 209946 - DNA, 710 bp, Homo sapiens
  misc_feature: GYAE6OF02GXFYQ.17.25.C03.1.454.CMB.1.raw
tcagcgtagactagcacgaccggtgctcgatttagtagtgtagatttgggtttgggagtcagtctcagtcaggacacagcatggacatgagggtccccgctcagctccgtgggctcctgctactctggctccgagctgccagatgtgacatccagatcgacccagtctccactccctcccgtgtcctcgcctcgtggtcgggggtcagacgtccaacctataccacttcggaccggaacaaagtccgtaaacggtaaccgtttaaaaaccttaagttttaaaacgttaggtaacttacgaacgtaccgaaacggtaaaaaccgtaacggaaaaaccgccccgtaagtaacccttccgtaagtaactcggtacgtcggttacacgtacctaccaaccgtcgtagaccggtaagtcgaccgtaccgaatcggtaacgtacaggcggtactagtacgggtactggtaggactaggtacttaacgacttcacgtacctataccaccacgtcacgactacgagtaggtactaggctaactaagtactaaccgttactacggtaacaacgtacgtaacgtttacccgtaccgttcccgtaacgttccttaaccggtttacggaaccggtaaggtaaacctaagggtacgtaacgtaaacgtaaccgaaacgtcgacgggttgaacttcggaaacctacccattttcggaccttacc

SEQ ID NO: 209947 - DNA, 621 bp, Homo sapiens
  misc_feature: GYAE6OF02FKP3K.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaggtcttcgtggtattcacgtttacctctatatatcaacgtgggtgcgccaggccgctggacacgtacctgacgtggagtgggagtcgggaccgaaaccctaagacgtggtgtcacgtagttgtccttaccgaccctacgtcccgtaccgggacacggtaccttaaccagtacgacccaacgaacctcctaccaactaaaccacagaccctaacgacgtggaacgttggacggacgtccagtacacgttcgtaggaaccgtacgaccggtccgttacttactttacgtacgtcgacgacgtaccgtacccgaacgtccgtaccggtacgacgtacccgtaggaccgtcggccggttacccgtttcgtaccgttcggtaccggggg

SEQ ID NO: 209948 - DNA, 721 bp, Homo sapiens
  misc_feature: GYAE6OF02IF0UZ.17.25.C03.1.454.CMB.1.raw
  modified_base (221)..(221): a, c, t, g, unknown or other
  misc_feature (221)..(221): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctctttcttggtggcagcagctaacaagtgcccactcccaggtgcagctggtgcagtctggggctgaggtagaagagccgtgggcctnagtgaaggtctcctgcgaggcttcgtggtattcctacgtttacctccttattagtatctaacgtgggtcgccgccgacggcctcgtacggaccaacggccgttaggaggtcggagtggggacgtacgggacccgtaaaccctaacgaccggttggtcgtaccgacgtaggttcgttaccttaccgaacccctacgttacccgtaccgggaactacgtacccttaaccgtacgtaccggaaccctaacggtaaccccttacccgtaacccaaacgtaaaacccaccgtaacgtaaccctaacgtaggttacgggtaacggtttagggaacgggtacgtaccgtagaacctacgttacgtacggaaccggtaccgtaccggtccctacttaagttacctggtacgacgtaacgccgttaccccgaacggttccgttaccggagtacccggtccgtaccggcgtacgggtccggttacccggttagtaccggttcgtccgggg

SEQ ID NO: 209949 - DNA, 810 bp, Homo sapiens
  misc_feature: GYAE6OF02JYVAN.17.25.C03.1.454.CMB.1.raw
  modified_base (530)..(530): a, c, t, g, unknown or other
  misc_feature (530)..(530): n is a, c, g, or t
tcagcgtagactagcacgaccggtgctcgatttagtagtgtagatttgggtttggggactcaacaaccacatctgtcctctagagaaaccctgtgagcacagctcctcaccagtggactggacctggaggatcctcttcgtggtggcagcagtctacaagtcgccctatcccgaggtcgcagtctcgggtgacaggttcgtacggggcttaggaggtacggaagtaacggtccgtaggggccccttagaggttacgtaacgggttcctacggtcgtaccgaaggtccgttgacggttactttaccgtacgttttaccctacgtaagttacggtactacgtaaccggttggtaccgtccgaccgtacggtccgaggttacggaaccaaggtccgtaggtacggtgaaggttcggtaaggcggtaacctaccgtaacgtcggtgcggtacacggtaagtcttacgtaccaccgtagtcccgacgaacgtacgtacctaccgtacgtaccgaccgtaccgtactcccgttaanaacctaacgtacccggtactaccgtaacgtacggtacgggtagttacggaaacgggtccctaacgttacggtaccgttaaccgtacgttaccggtaacggtaccgttaaccggggtccttaacgttacgttaaccgggtgttaaccggtacgtaaccgggtaccttacccgggtaacggtccggtttaccgggtacggtaaccccgggttcggtaaccggtacgttcccggggtttacccgggacccttttacggggttacccgtcgggtaacccggggg

SEQ ID NO: 209950 - DNA, 827 bp, Homo sapiens
  misc_feature: GYAE6OF02F7CB7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtgcccacctcccaggtgcagccgtggtgcaggtcgtggggctggagggtagaaggaacgccggtcggggcctcgagtcggaacggtcctcctgacgaggtccttcgtggtacttccgtaccgttttaccctacgtattagttactaccgtaacggttcgggtcgacccgtaccggacggtcccgacggtacgggaaccgaaccggtaccgtagggtaaggtgggtacgggtggggacggtacggggaacccgtaaaccccgtaacgtacggttcgggtacgtaccgaacgtacggttccttaccgttacccacccgtaccgttcccgggtaccgggtaaccacggttacccttaaccgacgtaccgaacccgttaacccgtaaccccttacccgtaaacccctaaaacgtaaaacccacccgttaacgacccttaaacggtacggtacgggttacgggttaacggacggtacgtaccgtaacggtaccacggttccgtaacggaacccgtaccggtaaccgggttcctttaccgttaacgttaccggtccggttaggaccgggtacgtacccggtacccgtaccggtaacggtccgggtacggttaacggacccggttacggacgtcgggttacccggttcgttttaccggcgttccggggtccggg

SEQ ID NO: 209951 - DNA, 832 bp, Homo sapiens
  misc_feature: GYAE6OF02F97N9.17.25.C03.1.454.CMB.1.raw
  modified_base (378)..(378): a, c, t, g, unknown or other
  misc_feature (378)..(378): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggactcctcttcgttggtggcaggcagctacaagtcgcccactcccgaggtgcaggtctggtgctagtcgtggggatggaggtagaaggaacgccggtggggtcctacgaggtacggacggtcctccgtggacgaacggtcgtttcgtagggtactttaccggtaccgtttttacccgtaccttaaattacggttaacttaccggaacgggtttcgggggtaccgaccggcccggtaacgggtcccggngttaacggggtaaccgtaaaccggtccgtgggtaacggttcgggaagggtttcggggaacgtaccgggggaacccgtaaaccgtaaggttacggttgggtacggtacctaaggttacggtttctaccgtttccgaaccctacggtccggttaccgggaactaacggtaaccctacgaactaccggtaaaccgtacccgtaacctacccgtaacaaacgtaaacctaacaccgttaaccgacgttagtaacggtagttaacggaggtaccacgttaggtacctagtacgtacggaaccgtccgggtaacccgttaccggttaacgttacgttaccgttaggtagtaccggtaacggtaccgtccgtaaaccggtacggttaccgggttacgacccggttactaccgggttacgaccggtttaccggtacggtttcggtaccgttacggtaccggg

SEQ ID NO: 209952 - DNA, 694 bp, Homo sapiens
  misc_feature: GYAE6OF02GU0IP.17.25.C03.1.454.CMB.1.raw
  modified_base (222)..(222): a, c, t, g, unknown or other
  misc_feature (222)..(222): n is a, c, g, or t
  modified_base (250)..(250): a, c, t, g, unknown or other
  misc_feature (250)..(250): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (419)..(419): a, c, t, g, unknown or other
  misc_feature (419)..(419): n is a, c, g, or t
  modified_base (622)..(622): a, c, t, g, unknown or other
  misc_feature (622)..(622): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtgaacgtagccgtggggcctnaggtgaaggtctccgtgacaggtcttcnggtacttcacgtttacctctatgtatctaagtggtcncgacgaggccncgtaggacaacgtacctggacggtagtggtcggagtccgggtacgtaaaacccgtagacggtgggtactaccgtacgagttcgttcctccaccttacgtcctcgggacacgtacttaccgntaccgaccgaacgtacctccttacgaaacgttaacccaaaccgtcctaaaggtactggggtaaccttagggacggttacaccgtaaccgggaccttaggccttaagggaaccccgtacgtaaaccggtccgtttccttaaacggtttcgtcggttaaaccgccgggaacgttaccgacccgtttaccgcggtttaacccgggnttaaccccggtcggaaccgccggtacgggtaccccgtttttacgtcggtttccggttaaccgggacccgggg

SEQ ID NO: 209953 - DNA, 885 bp, Homo sapiens
  misc_feature: GYAE6OF02F9D7Y.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacgaagtcgcccactcccgaggtgcagcgtggtgcagtcgtgggctggaggtagaaggacgtccgtcggggcctcgaggtgtaacggtcctcgtgcgtaacggtccttgtaggtactttccgtaaccgttttaccctaccgttagttaacggtaactaccgtaaacggttggggtcgcccggtaccgacgggtcccgtcggtacgggaaaccgaacccggtaccggtaggtacgggtcgggtaaggtcggggaacgggttccgggaacccgtaaacccgttacggaacgttcgggtacgtaaccacggttaccggtttcggttcccttaacccgacccgttaccgttccccgggtaacgggtaaccgtaaccgttacccgttaaccgacggttaaccgaacccgtaaccgtaaaccccttcccgtaaaccgaaaactaacccggacctaccggtaaaccttaaccggtaaggttccgggtaaaggttacggacggtaccgttaccgtaccggtaattaccgttacgaacccgggtaccgtacccgggtaccggtttcccgttaacttaaacgggtttccgtagggtaaaccggcccgtaaaagggttccccgtaccccggaaggttacccgggttaccccggtggtaaccccggttcccggaaaccgggttcaccccgggttaacccgtttccgggtttaaccgttcccgggtacccggggtaacccgggg

SEQ ID NO: 209954 - DNA, 877 bp, Homo sapiens
  misc_feature: GYAE6OF02HMF24.17.25.C03.1.454.CMB.1.raw
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcgagcgtggngntagtcgtggggctggaggtagaaggaacgccggtacggggcctacgaggtacggaacggtccgtaccgtagaccgtaagggttccgttcgtacggtactttaccgttaaccgttttacctaccttaagttacgtaacgtacgtaaccggttgggtacgaccgtccgaacgggtcccgtacggtaacggaaccgtaaaaccggtaccgtaagggtacggtaggggtacggttaacggggtacgggtaccggggtaaaccccgtaaaacccgtaaccggtacggttaggtaccggtacgtaacggtacggtttacgttcctaccccaaccgttaccgttcccggaccggtaactaaaccgtacgtaccgacttaacggaaccctaaccgtaccttaccaaccgtaaaactaaaccgacctacgtacctaaaggtacgttaaggaacgggttacggaacggttacccgacggtaacgtaacccgtagttcccgaacgggtaaaccgtacccgtaccgggtaacccgttacgtttaaaccgttaacggttccgggaacgtagggtaaccggtacccggtaccgttaacggggttcccggttaccggtaagggaaccccggttacccgaccgggttaacggaccggttacccgggttttactttaccgggcccgggtttcgggaacccggggg

SEQ ID NO: 209955 - DNA, 711 bp, Homo sapiens
  misc_feature: GYAE6OF02G65UH.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccacctcccaggtgcagcgtggtgcagtcgtggggctggagggtagaagacggtccgtcggggcctcgaggtggaaggtctcctgacgtaggtcttcgaggtacttccgtacgttacctactagtagtactacgtacgtagggtcgccgccgacggccgcgtacggaaccaaccggaccgtggacggtagggtacggtagggtggtaccggggaccgtaaaccccgtaagtacggttggtacggttaccacggttacgttcgttaccgttacccacctacctaccggtaccgggacctaacgtaccttaccagtaacccgtaccgaaccgtacccttccaactaaacctaaaccaccgtacgaaccttagacggttggtaacgtagggtacgtaccgcttacggaacttacgtacgtacggacccgtacggccgttaccgtactttacgtacgtgtaacggcttaacgggcctaccgtaacgtcgtccggagtacccgtaccggtaccggcgacggttcccgttaccgtcggtcgttacggaccgggg

SEQ ID NO: 209956 - DNA, 587 bp, Homo sapiens
  misc_feature: GYAE6OF02GQWK2.17.25.C03.1.454.CMB.1.raw
  modified_base (186)..(186): a, c, t, g, unknown or other
  misc_feature (186)..(186): n is a, c, g, or t
  modified_base (479)..(479): a, c, t, g, unknown or other
  misc_feature (479)..(479): n is a, c, g, or t
  modified_base (484)..(484): a, c, t, g, unknown or other
  misc_feature (484)..(484): n is a, c, g, or t
  modified_base (518)..(518): a, c, t, g, unknown or other
  misc_feature (518)..(518): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcngtcgtggggctgaggtgaagagccgtggggcctcagtgaaggtctcctgcaaggcttctggattcacgtttacctctatagtatcaacgtgggtgcgcccgaggcccgcgtggaccaacggacctggagtcggagtggggagtcgggaccgaaaccctaacgacgtgggtctacgaccgagtcgttccttaccaccctacgtcccgtccgggaacacgtaccttaccagtacgaccaacgacctcctaccataaaccacacgactaaccagtcgtagtaggaggactccgtanactancgtacggacgacgcgtaccgtctacttctcgtcncgagtcgtaccacggtcgtccgtgcgaccgtccgcgtacggtcgtaccgtttgtaccgtcggtaccggg

SEQ ID NO: 209957 - DNA, 873 bp, Homo sapiens
  misc_feature: GYAE6OF02G3ONW.17.25.C03.1.454.CMB.1.raw
  modified_base (184)..(184): a, c, t, g, unknown or other
  misc_feature (184)..(184): n is a, c, g, or t
  modified_base (326)..(326): a, c, t, g, unknown or other
  misc_feature (326)..(326): n is a, c, g, or t
  modified_base (717)..(717): a, c, t, g, unknown or other
  misc_feature (717)..(717): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacagtcgcccactcccaggtgcagctggtnctagtcgtggggctaggacggtagaagacgccgttcggggcctcgaaggtgaacggtcctaccgtgtacgaacggtcttacgcggttacttccgttaccgttttacctacgtaagttagtactaccgtaacgttgggtaccncggtccgtacgggtcccgtacgtacgggaaacctaaccgtaccggtgggtaacggtaggggaacgttgggggtaacgtaccggggacccgtaaaacccgtaacggtaccggttggggttaccgtaaccttacgggtagttcgttaacccgttaccgaccccgttaacggtaccccggtaaccggggtacctaaccggttacccttaacctcgtaacccgtaacccgaacccgttaacctcccctaacgtaaactaaaccgaccgtacgaccctaacgtaacggtaggtacggttaacggaacggtaccgtaccgtagtaaccgtacgtaccgttaacggaaacccgtacccggtacccggtaccggtttaaccttaacgtttaccgggttntaaccggggtaccgtaaccgggtacccgttaacccggtaacccgggtaacggttaacccggtacggggtaacccggttaccccggaaaccgggttccgggtaccccggtttacgggtaccccgtttacggttacccgggtcgggtaaccccggggg

SEQ ID NO: 209958 - DNA, 726 bp, Homo sapiens
  misc_feature: GYAE6OF02IOUQ4.17.25.C03.1.454.CMB.1.raw
  modified_base (239)..(239): a, c, t, g, unknown or other
  misc_feature (239)..(239): n is a, c, g, or t
  modified_base (272)..(272): a, c, t, g, unknown or other
  misc_feature (272)..(272): n is a, c, g, or t
tcagcgtagactagcacgaccggtgctcgatttagtagtgtagatttgggtttgggggactcaacaaccacatctgtcctctagagaaaaccctgtgagcacagctcctacaccatggactggacctggaggactcctcttcttggtggcagcagctacaagtcgcccactcccaggtgcagctggtgcagtcgtgggctgaggtgaagaacgcgtgggcctcgagtgaacggtctccngacgaaggtcttcgtggattctaacgtttaccncctatacgtaactcaacgttgggacgccgtaccgacggtcccgacgtacgggaacaaccggacctaggtagtaggtaggtcgggaacgtcgggtaaccctaaacccgtaacgtacgttaggtacgtacctaagtacggttcgttaccttaccgaacccgtcgtacccggtaccggggaacacggttaaccttaccgaagttccgaacccgtaacgtaaaccctcccgtaaacgtaaacctaaaccgaccgtaaccgtaaccctaacggtagtcggggtaacttaacgggtacggacttaccgtagactacgtgacgaacgaccgaccgtcgtctaacgtttacgcgtagtaccgaggtaccctaccggaacggtacggttcccggtacggtaacccgttccgaacggtccgaacgggttcccgtaccggtttaccgtcggttacggtacccggg

SEQ ID NO: 209959 - DNA, 895 bp, Homo sapiens
  misc_feature: GYAE6OF02IUPKE.17.25.C03.1.454.CMB.1.raw
  modified_base (628)..(628): a, c, t, g, unknown or other
  misc_feature (628)..(628): n is a, c, g, or t
tcagcgtagactagcacgaccggtgctcgatttagtagtgtagatttggtttggggacgtcaacaaccacatctgtcctctagagaaaaccctagtagagcacagctcctcaccatggactggacctggaggatcctcttcttggtggcagcacgctacaagtcgccactcccaggtgacagctggtacgcgagtcgtgggctggaggtacggaaggaagccgacggggtacctcgtaacggagtaacgggtcctaccgtggaaccgtaagggccttttcgtacggtactttccgtaaccgttttaccgtaccgttaattacggtactacgtaaacgttcgggtacgtccgccgaaccggggcctacggtacggtaaccgaaaccggtacccgtaggtaacggtacgggtaacgttaggggaacggttaccgggggaaacccgtaaaaccccggttaaacgtaccggtttaggtccgttaaaaccggaccgttaaacggttccggttcccttaacccgacccgttaccgtacccggtaaccggggaacctaacggtaccttaaacccagtacccgggtaaccaaaccgtaaaccccgttcccgtaaaaccctaaaccgtttaaaaccncccgtaaacgtaacccgttaaacgaacgttacggaaacggtttacggacccgggaacgttcccgtaagtaaccctagttaacccggacggaacccgtaaacggccccggtttaacgttccgttaaaaggttccggttacgtaccgaacccgggttaacggaccccggttaacgtaccggtaaccggtcgggacccgaccgttaccgggaaccccggtaggtcccggttaccgggttaccctttacggaccgtttcccggggaacggg

SEQ ID NO: 209960 - DNA, 846 bp, Homo sapiens
  misc_feature: GYAE6OF02HYKTT.17.25.C03.1.454.CMB.1.raw
  modified_base (181)..(181): a, c, t, g, unknown or other
  misc_feature (181)..(181): n is a, c, g, or t
  modified_base (619)..(619): a, c, t, g, unknown or other
  misc_feature (619)..(619): n is a, c, g, or t
  modified_base (795)..(795): a, c, t, g, unknown or other
  misc_feature (795)..(795): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctgggaggatccgtcttcttggtggcagcagctacaagtcgccccactccccaggtncgtagccgtgggtgaccgtagtcgtgggggaccttaggaggttaggaacgaacggtcccgtgggggtcctaccgaggttaggaagggttcctaccgttggaccgtaagggtcctttcgtacgggtattcctaacccgtttttaccgtacccttaattaggtacttaaccgtaacggttggggttcgtacccggacctaccggggtcccgtacgttacgggaacccgtaaaacccggacccggtaaagggttcgggtaaacgtcggggtacgttaagggggacccccgtaaaaccgttaaccggtacgtcggggtaccgttacgaaccgttagtcgtttaccgtaccgtaccccgtagttaccccggaccggtaaccgtaacccttacgttaaacccggtacgtaccgaacccgtaaccgtaaccgttcccccgttaanaaaccgtaaacccgaacgaccggtaaccctaacggtaagttaccgggtaggttaaggacgggttacgaccgggttacaacgttactccgggtaacgaacccggtaccgaccgggttaccctaacgtttacgtaaccgtgaccgtacggaactcggtaccgacggtagtaccggtancccgtacgacggtcgacgtcccggtacgtttcacgttcgggaccgtaccgg

SEQ ID NO: 209961 - DNA, 802 bp, Homo sapiens
  misc_feature: GYAE6OF02I3Q4X.17.25.C03.1.454.CMB.1.raw
  modified_base (376)..(376): a, c, t, g, unknown or other
  misc_feature (376)..(376): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtgcagcagctacaagtgcccactcccaggtgcagctggtgcagtcgtgggtctaggaggtgaagaacgccgtgggcctcgagtaggtacggtcctcgtacgacgacgttcgttacgtggtacttcgttaaccgttttaccctacgtaattattacgtacctaacggttcgggtccgtccgaccgacggtcccgcgtacggaacctaacccggtacgtcggaggtacggtagngggtaacgcggggaaacctaacccgtaaacgtcggttaggtcggtaccacggttaacgttcgttaccttacccgaacccgtccgttccggtaaccgacgttaacgtaacccttaacgtcgtaaccggaacccgtaaccgtaaacccgttacccttaaccctaaacgtaaaacccgtaaccaaaccgtccttaaaaccgtcggttaacggtacggtttacggaacggtacgtaacccgtacgtaccgtacgtagttaaccgaaccgtacccgtaccggacccgtttacgttaacgttcgttaccggtagaccggtaacaccggttaacccggtaccggtaccggaacgggttcccggtaaccgttacccggcggttaccggcccggtaccggtttacccttacgggttaccgtacgggtaacccggg

SEQ ID NO: 209962 - DNA, 668 bp, Homo sapiens
  misc_feature: GYAE6OF02GWPPY.17.25.C03.1.454.CMB.1.raw
  modified_base (160)..(160): a, c, t, g, unknown or other
  misc_feature (160)..(160): n is a, c, g, or t
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (356)..(356): a, c, t, g, unknown or other
  misc_feature (356)..(356): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacagtncccactcccaggtgcagctggtgcagtcgtggggctggaggtgaagaagccgtgggcctcagtgacgtcnctgcaaggcttcgnggtacttcgaccgtttacctctatagtatactaacgtgggtcgcgccgaggcccgtcgtaggaccgaacgaccgtggaacgtggagtgggagtccggacctaaacccgtaancgtggtgtacagtagtcgttccacgacccacttccgtaccgggacacgtaccttacagtaccgaccctaccgtaacctcccgtaaccctaaactaaacccactacggtaacctacgtaacgttcgggtaaggttacggaacggtacggtacctcgtaactaccttcgaccggaaccgtaccgaccgggttcctacgttaattccggttagtggaccgtacgtacgacccgtacgtacgtaccgggtacgtcggacccgttaccggagtaccggtccggttaccgttttacggtccgttaccgggtcccgggg

SEQ ID NO: 209963 - DNA, 843 bp, Homo sapiens
  misc_feature: GYAE6OF02HO4Y8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggacagcagctacaagtgcccactcccaggtgcagctggtgcagtcgtggggctggaggtgaagagccgtgggcctcagtgaagtctcgtgcaggtcttcgtggtacttacgtaccgtttacctcgttataggtactccgtaacgttgggtcgtccggtaccgacgggcccgtacgtacggggaaccctaaccggtacccgtaggtacgggttcgggtaaggttacgggggacgtaccggggaaccccgtaaaaccccgtaaacgtaccggttcgggtacgttacccgagtacggtttaccggttaccctttacccgaacccgtacgtttaccccgggttacccggggaacttaaccgggttaacccttaacccgtaacgttacccggaaaccccgtaacgtaaaccccgtttcccctaaaccgtaaaccgtaaaacccgaccgtaaacggtaccccttaaacgaacggtttacgggtaacgtttaacgggaaccggtaccgtccgtaacgtacacgttccgacggaacccgtaccgaccgggttaccgttacgttacgttaccggtggtacggaccgtaaggtacccgtacccgtaccgggttaaccggttcccggtaaacggacccggtacccgtaccggtaccggtacgggtaccccggtttccgtttacggtacccggtttcgggtaaccgggg

SEQ ID NO: 209964 - DNA, 870 bp, Homo sapiens
  misc_feature: GYAE6OF02IBT65.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcagcgtggtgcagtcgtggggctggaggtgaagagccgtggggcctcgaggtagaaggtctccgtgacgaaggtcttcgaggtactttccgtaccgttttacctacttaagttacgttactacgtaacggttggggtacgccgtaccggaacgggtcccggtactacgggaaacctaaaccgggaccgttagggacggttagggacggtacgggggtacgtacgggggtaaacccgtaaaccctaacggtacggttcgggttacggtaaccgaacgtacggtttacgttcctttacccgaccccgttaaccggttccccggttacccggggaaacctaaccggttaacccgttaacccgtaacgtacccgaacccgtaaaccggttaccctacccctaacctaaaccgtaaaaacccaccgtaaaccgtacccgtaaccgtagggttaacggtaacggtaccgggtaaacggtacggtacccgttaacggtaacctaacggttcgtaacgggaaacccggtaacccggtaaccggggttacctttaccgtttaacgtttacgggttacggtacggtaaccggacggtaccccgtaccggtaccggttacggtaccgggtacgacccgggtacccgtacggtaccgggtcggtccggtttaccgtttccggttaccgggttccggtaccggggg

SEQ ID NO: 209965 - DNA, 778 bp, Homo sapiens
  misc_feature: GYAE6OF02FY005.17.25.C03.1.454.CMB.1.raw
  modified_base (233)..(233): a, c, t, g, unknown or other
  misc_feature (233)..(233): n is a, c, g, or t
  modified_base (394)..(394): a, c, t, g, unknown or other
  misc_feature (394)..(394): n is a, c, g, or t
tcagcgtagactagcacgaccggtgctcgatttagtagtgtagatttgggtttgggagtcagtctcagtcaggacacagcagtggacatgagggtccccgctcagctccgtggggctcctgctactctggctccggagctgccagatgtgacatccagatcgacccagtcctccatccctcctgtctcgcctcgtgggtcggggtcaggatccaccagtcacgttcgaccganaagtcaacggtacttaaacctattaaatggtatcagactaacgaaaccgtaggaaaaccgccccaagtaccctactgtacctcgttacgtggttcacgtacctaccgtactcgtacgacgtacggtcggtaccgttacccgagtcggtaaggttcgtaggnggtacgagtaggtacgttcgagggtactaggttaccttctaaacgtcctaactacctcgtaacctacccgtacttaccgtacgtaacccgtaccgttaagggtacgttacggtcgtaaccgttaaccggtaccttacgttaaccttaaccgtacgttaacccggaaacgtttagttaaccgttaccccgttaccccgtttccccggttaacccgttacgtttaacccgggttttacccggaaccgggtaaaccggggttaaccgttaacggggttaacgtaacggtaaacccgttaaccggtaaaaccggtacccggttacggttacgggtaccctaccggtaccccgtaacgtttcccgggtttaccttccgggttttaaccc

SEQ ID NO: 209966 - DNA, 791 bp, Homo sapiens
  misc_feature: GYAE6OF02IXL0Q.17.25.C03.1.454.CMB.1.raw
  modified_base (231)..(231): a, c, t, g, unknown or other
  misc_feature (231)..(231): n is a, c, g, or t
  modified_base (272)..(272): a, c, t, g, unknown or other
  misc_feature (272)..(272): n is a, c, g, or t
  modified_base (294)..(294): a, c, t, g, unknown or other
  misc_feature (294)..(294): n is a, c, g, or t
  modified_base (345)..(345): a, c, t, g, unknown or other
  misc_feature (345)..(345): n is a, c, g, or t
  modified_base (394)..(394): a, c, t, g, unknown or other
  misc_feature (394)..(394): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtgcagcagctacaagtgcccactcccaggtgcagctggtgcagtcgtgggctgaggtgaagagccgtgggcctacagtgaggtctcngcagtctctggacttctaccgtttacctctatacgtactanaacgtggtgccgcctacggccncgtacggacaccgcctggagtcggattcgggagtggaccgtaaacctacgngttcggagtccagagttctccgtactacccgacgtcccgacggtaaccngttaaccttacccgagttaccgaacccgtaaccgtaacccctaccctaccgtaaacctaaccgtaacccgtacgttacccccgtaagtaccggttaaccggaacggttacggtaaaccgggtaaccgttacccggtaacgggaaccttaacccggttaacgttaaaccgggaaaccgtaccccggggtaacccgggttaaccccggtttcgttaaaaccttttcccgggacgtttaccgggaacggttaccggacccgggttaaccgtaaccccggttaaccgggttaacccggggttaccaaaccgggggtcccctaaccgggggtaccgtaacccccggggtccggtttcccccggttttaacgtaccccgggtttccggggtaaacccgggggg

SEQ ID NO: 209967 - DNA, 650 bp, Homo sapiens
  misc_feature: GYAE6OF02F4L0F.17.25.C03.1.454.CMB.1.raw
  modified_base (525)..(525): a, c, t, g, unknown or other
  misc_feature (525)..(525): n is a, c, g, or t
  modified_base (596)..(596): a, c, t, g, unknown or other
  misc_feature (596)..(596): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagcatccttttcctggtggcagcaggcacaggtgcccacgcccaggttcagttggtgcagacgtgggctgaggtgcagagccgtggggcatcagtgactgtctcctgcaaggccagtggatagtatcttacaacaaatagtggtatgtaagttgggtgcgacgacggacccccggagaacgggtcttacggaggttgggggtgggggttcgggtacgaggtcgggttcgtttacggaacgggttaaggacgtacgtagtacgtcggacaaccggaagagtagggaagggtacgaggacgtacgaacgttaacttaacccggaaccggtaccccgaaccccccgtaaggaaaccaccgtaacgttacctaacgtactacgaccaacgtcgaacggtacncgtagacgagtcgtacgacgtacgacgtacgttacttactcgtgtcgacgttagtactttcggttttaccngttacgtacgttacgttaagttagtttcgtagttcgtacgttacgtaggtacgg

SEQ ID NO: 209968 - DNA, 828 bp, Homo sapiens
  misc_feature: GYAE6OF02JERUR.17.25.C03.1.454.CMB.1.raw
  modified_base (364)..(364): a, c, t, g, unknown or other
  misc_feature (364)..(364): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaaacgacggccgtcggggtccctcgaggtaggaaggttcctccgtgacaaggtccttcgtggtacttccgtaaccgttttccctactaatagttactaccgaacgttggggtcgcgccgacggcccgcgtggaaccacgacctggacgtggagtgggancgggaccaacctaacgtgtcggtctcagtcgttctccgttaccacccgtacgtcccggaccgggtaacctacgtaaccgttacctacgtaccgaaacccgaacccgtacccttacccctaaccgtaaactaaacccgtaaccgaacctacccttaaacgtacggttacggggttaaccggttaaggtaacccggggtaacggtacccgtacggtaaaccctaccgtttaccgaaacccggtacccggtaaacccggtacccggggttaaccctttaccgtttaaccgtttaacggttaccggtaccggggttaacccgtaacggttaccccttaaccccgggaacccggttcccgggttaaccgggtccggttaaacccggtccccggttaaccgggcccgtaccggggttcccggtttacccggttttaccggtccgttttacccgggggtaaccccgggggg

SEQ ID NO: 209969 - DNA, 1008 bp, Homo sapiens
  misc_feature: GYAE6OF02IC9K3.17.25.C03.1.454.CMB.1.raw
  modified_base (163)..(163): a, c, t, g, unknown or other
  misc_feature (163)..(163): n is a, c, g, or t
tcagcgtagactagcacgaccggtgctcgatttagtagtgtagatttgggtttggggactcaacaaccacatctgtcctctagagaaaaccctgtgacgcacagctcctcaccatggactgacctggagatcctctttcgtggtggcagcagctaacaagtcncccactcccgaggtgcagcgtggtgacagtcgtggggtctaggaggtagaaggaacgtccgggtaggggcccttcgaagggttcggtaaacgggttcctacccgtaggtaaccggtaacggggttcctttacggttacgggttaaccgttttccttaaacccgggtttttaccccttaccctttaagttaaccggtttaactaccgtaaacggtttggggtaccgtccgggtaacccggaccggggtacccgtaccggttaacgggaaccctaaaaccggtaccgtcgggtaaggtagggtaggttacggggtacgttacggggaacccgtaaaaccccgttaaaccggtacggttaacgggtacgtaccgtaacccggttagggtttaccgttacccgttaccccgtaaacccgttaaccggtccccggttaccccggggtaacctaaccggttaccccgtttaaaacgtacgttacccggtaaacccgtaaacccgttaaccccgtaccccgtttaaccccaaaacgttaaaacccgaaaccgttaaaccgtaccccgttaaacgttaacggtacgggttaacggggttaaccggtaaccgggttacggttaacccgttggtaaaccgtacgttccgggttaaccgaaaccgggtaccgtaaccccggttacgttaaccgttttaaacgttccgttaacggttaccgtaaccgggtaacgtaccccggttaccggaaccggttcggtacccggggttaacggaccccgggttaccgaccgggtaccgtacgggttaccccggttacggtttttacccgtacccggggttccggttaccggggg

SEQ ID NO: 209970 - DNA, 839 bp, Homo sapiens
  misc_feature: GYAE6OF02F700I.17.25.C03.1.454.CMB.1.raw
tcagcgtagactagcacgaccggtgctcgatttagtagtgtagattgggtttggggactcaacaaccacatctgtcctctagagaaaaccctgtgagcacagctcctcaccatggactggacctggaggatcctcttcttggtgcagcagctacaagtgcccactcccaggtgcagctggtgctagtctggggctggaggtgaagaagccgtggggcctcgagtgaaggtcctcgtgcgaacgtcttcgaggtattccgtaccgtttaaccttcccttaagtacgttaactaccgtaaacgttggggtacgtccggtcccggtaacgggtcccgtacgtcggaaaccgtaaccggtaccggtcggtaacggtcgggtaggtacgggggtacggtacgggggtaccccgtaaaaccccgttaaccgtacggttaccgggtacggttaccgaaaccgtaggtttaccggttccgttacccgtaacccctacggttaccccggtacccggggaaccttaaaccggtaccctttaaccgtacgtacggtaaaccccgaccggtaaaccctttcccctaacccgtaaacctaaaaccgaacccgtaacccgttacccgaacctaccggtagggtaacggttaggaccgggacgttcccgtaaggaccgtactaccgtaggaacccgtacggacccggttccgttaacgttacgtttaccgtaggtacgtacggtaccgtccgtacccgtaacggtcggtttacccggtacggtcccggtaccgtaaccgggtcgtaaccgggtcccggtttacttccggttaccccgtaccgggttacccgggg

SEQ ID NO: 209971 - DNA, 819 bp, Homo sapiens
  misc_feature: GYAE6OF02GXRVH.17.25.C03.1.454.CMB.1.raw
  modified_base (186)..(186): a, c, t, g, unknown or other
  misc_feature (186)..(186): n is a, c, g, or t
  modified_base (299)..(299): a, c, t, g, unknown or other
  misc_feature (299)..(299): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcngtcgtggggctggaggtgaagagccgtggggcctcgagtagaggtcctcctgcaaggcttcgtggtacttcacgtttacctctatagtatcaacgtgggtgcgccaggcccgntcggacaacgtaccgtgacggtggtagtcgggagtcggggaccgaaacccctaacgaccgttgggttacgtacctaacgtacggttcggttacctttacccgaaccccgtacgttaccccggtacccgggggtaaccgtaacggttaaccctttaacccgaacgttacccgggtaacccctaaacccggtaaaccccttaccccttaacccgtaaaacctttaaaaaccccgaaccgtaaccgttaaccccgttaaacgtaacggttaacgggttaacggttacgggaaccgggtacggtacccgttacgtaaccgttacgttaccgttaacgggaacccctaacgggtacccgggtcccggttaacgttaacccgttttaacgtcggttacggtaccggtacgtacccgtaccccggaacggtaaccggttcccgggttacggaaccggtcccggttaacgggaccgtaccgggtaccggttacccgttttacggtaccgttttcgggtaacccggggg

SEQ ID NO: 209972 - DNA, 743 bp, Homo sapiens
  misc_feature: GYAE6OF02JEJZV.17.25.C03.1.454.CMB.1.raw
  modified_base (269)..(269): a, c, t, g, unknown or other
  misc_feature (269)..(269): n is a, c, g, or t
tcagcgtagactagcacgaccggtgctcgatttagtagtgtagatttgggtttgggggacgtcaacaaccacatctgtcctctagaagaaaaccctgtgagcacagctcctcaccatggactggaccgtggaggactcctctttcttggtggcagcagctacaagtgcccactcccgaggtgcgagcgtggtgcgtagtcgtgggctggaggtagaagaacgccgtgggccgtcagtaggaacggtccgtcctgcgaacggtcgttcgngtagttacttaccgtttaccttcctataggtactacgacggtgggtcgaccgcgtacgggcccgtcggtacggaccaacggtccgtaggtaggtagggtaggtgggaacggtcggggacccgtaaacccgtaacctacggttaggtccgtaaccgagtacggttacgttcctactaccctacggtcccgtaccgggaacctacgtaccgtaaccgtataccgacctaaccgaccttaccccattaaaaccaacccgagaaccgtacccacgtaggaggtacgggttagggaaaccgttcgaccgtctacgtacttccggacgaccggtaccctacggtacccgtagttaacttcggtacgtacgggaccgtaccgtccccgtaacgcggtaacccgggtctttacgggaaccttcgggttaacccgaggttcccggttacggtttcccttccccggttaagcggggttaccggg

SEQ ID NO: 209973 - DNA, 742 bp, Homo sapiens
  misc_feature: GYAE6OF02FHZ4B.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtgaagagccgtggggcctcgaggtagaacggtcctcctggacgaaggtccttcgtggtattccgtacgtttacctcttaagttagtacttacctaacgtgggtcgaccgccgaaggcccgtagtacggaaccaaccggtaccgtaggaggtaggtagtggggagtacgggaccgtaaaccctaacgtacgtcggtacgtaccacgtcgttcgtcgtttacccaccctacgttcccgacggtacacgtaccttaccacgttaccgaaccgaccgtaaacctcctaccaaactaaaccaccacgaacctacgtaagtcggtaacgttagaacgcgtacccgtagaaacctcttccgtaacggaaccgtcccgtaaccggggttccttaacgttaacgtttaccggtggtaccgttacgtaaccggttccgtaaccccggaacggttcccggttaaccggggttacgaacccggtttaacccgtacgggaccgtacgggttaacccgtttccggtttacggttccgggttacggtacccggggg

SEQ ID NO: 209974 - DNA, 754 bp, Homo sapiens
  misc_feature: GYAE6OF02GVR9J.17.25.C03.1.454.CMB.1.raw
  modified_base (632)..(632): a, c, t, g, unknown or other
  misc_feature (632)..(632): n is a, c, g, or t
tcagcgtagactagcacgaccggtgctcgatttagtagtgtagatttggggtttgggggactcaacaaccacatctgtcctctagagaaaaccctgtgagcacagctcctcaccatggactcggacctggaggatcctcttcttggtgcagcagctacaagtcgcccactcccaggtgcagcgtgggtacgcgagtcgtggggtcgtggacggtagaacggaacggtcggtcggggtcctacgtaggtacgtaacggtcctacgtcgacgtaacggtcttcgtacgtacgttaccgttaaccgtttaccttaccgtaattaacgtaacttaccggtaagggttcggtacggaccggccggacgggcccgtacgtacggaaccgaaccgtacgtacggtacggttaggacggtaggggtacggtacgggtaaccgtaaacccgtacggtacggttcggtactaacgttagtacggttccttaccgtcccgtaaacccttcccggtacccgggtacccgtaaactaacgttaaccgtaccgttaccaaccgtaacccgtaacccgtaacccgtacctaaacctaaacctaaccgtacaacccgtactaagtacgtaagtacgtaacggcgtacncgtacactacgctaacggaccaccggtccgtacgttctacgttgtcgcgtacgacggtaccgaccgacggtcgtacgcgaaccgtcgtcgacgtcggtaccttcgtacgtcggtcggtacgg

SEQ ID NO: 209975 - DNA, 816 bp, Homo sapiens
  misc_feature: GYAE6OF02IKZZ8.17.25.C03.1.454.CMB.1.raw
  modified_base (70)..(70): a, c, t, g, unknown or other
  misc_feature (70)..(70): n is a, c, g, or t
tcagcgtagactagcacgaccggtgctcgatttagtagtgtagatttgggtttggggactcaacaaccanatctgtcctctagagaaaaccctgtgagcacagctcctcaccatcggactggacctggaggatcctctttcttggtggcagcagctacaagtcgcccacctcccgaggttgaccgagtcgtgggtgcgtaggtcgtgggggtctaggagggttaggaagtaacggtccggtgggtcctacgaggtaggtaacgtcctaccgtggacgtaggtcttcgtacggtacttacgttacccgtttaccgtaccttaagtacgtactaccgtaacggttgggtcgccgacccgacggtcccgtccgaacggtacccgaaccgtaccgtaggtacggttaggagggtacggggaggtccggggtaaccaaaccccgtttaacgcggttacgggttctaccgtaacgtacggtttccgttacccttacccgaaccccgttacgtcccccgggttaccgggtaaacctaacgttaacccgtttaaccgtaacgtaccggtaaaccccgtaaaccgttacccgtaaccccgtaacctaaaaccgaaacccacgtaccgacctaacgtaacggtggtaaccgtagggaacggtaccgaccttaaggaccgtagtacgtaccggtacgaaccgaccggtccttaacgtagttaccgtggccgtacggtacgtccgaccgtacgtaaccggtccgtacggccgtacgtaccggccgtacgggtacccgttaacggtcccggtacggttcggtaccgggg

SEQ ID NO: 209976 - DNA, 903 bp, Homo sapiens
  misc_feature: GYAE6OF02IW56S.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtcctccatccctcctgtactcgcctcgtaggtcggggtcagacgtacacctatccgtacgttacggacccggtaacaacggtaccgaacgggtaaaccgttttaaaaacccgtttaagttttaaaacggtttacggtaacttccggaacgtacgtaaaacgtaaaaacccggttaacgggaaaaaccccggttacccccgaaaccggtaacccttaccgtaggttaaccttaccgttcggtgggttaaccgtacctaccggtacccttaccgttcgtaacggtaacggtaacgggtcccggtaacccgttcccgtacggtaaccgggttaacggttccgtaggtacgaacggttacggtaacggtacgttacgggagggtaaacctaggtttaacttaacgttacctacccgtaaccgtaaccctaacgtacccttaaccgtaccgttacctaccgaaccgtacccggttaaggttacgttacgtaacggtacccgtaactttaaacggttaccttaaaccgttacgtaaaccgttaccggaaagttaacccggtttaacttacccggtttaacccgtcccgttaacggttaccgtttaccggtaaaccgggtaaccggtaaccgggttaaaccggtaggttaaccgtaacgttaaaccggaaacgttaaccggtaacgtacggtccggtaacgtacccgtaacgttcccgttacggttaaccttcccggtttaaaccc

SEQ ID NO: 209977 - DNA, 581 bp, Homo sapiens
  misc_feature: GYAE6OF02HPSQ6.17.25.C03.1.454.CMB.1.raw
  modified_base (187)..(187): a, c, t, g, unknown or other
  misc_feature (187)..(187): n is a, c, g, or t
  modified_base (276)..(276): a, c, t, g, unknown or other
  misc_feature (276)..(276): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (323)..(323): a, c, t, g, unknown or other
  misc_feature (323)..(323): n is a, c, g, or t
  modified_base (363)..(363): a, c, t, g, unknown or other
  misc_feature (363)..(363): n is a, c, g, or t
  modified_base (409)..(409): a, c, t, g, unknown or other
  misc_feature (409)..(409): n is a, c, g, or t
  modified_base (444)..(444): a, c, t, g, unknown or other
  misc_feature (444)..(444): n is a, c, g, or t
  modified_base (534)..(534): a, c, t, g, unknown or other
  misc_feature (534)..(534): n is a, c, g, or t
  modified_base (569)..(569): a, c, t, g, unknown or other
  misc_feature (569)..(569): n is a, c, g, or t
tcagcgtagactagcacgaccggtgctcgatttagtagtgtagatttgggtttggggactcaacaaccacatctgtcctctagagaaaaccctgtgagcacagctcctcaccatggactgacctggaggactcctcttcttggtggcagcagctacaagtcgcccactcccaggtcgcagctgggtnccagtcgtcggggctggaggtgaagacgccgtggggcctcgaggtgaaggtctccgtagcaaggtcttcgtggtactctaccgtttccnctatagtatcagtgggtncgctacggccgngtggacgaccgtcaggngtggagtggggagtcgggaacctaaccctagtacgtggtnaccagtagtcgtctacaccctacgtcccgtacgactagtacctacncgactaccgacaccgtacctcaaacgaacacgacncctacaggtcgtagtagacggactcgtagcgtactcgtaacggacgaccgtccggtacctcttagtacgtgcgacgacgacgttacccgntacggtccgagcctacgcgacgcgtcgccgtttcnccgtggtaccgg

SEQ ID NO: 209978 - DNA, 1130 bp, Homo sapiens
  misc_feature: GYAE6OF02JO1CV.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacagtcgcccactcccaggtgcagcgtggtgcagtcgtgggtctggaggtggaagaacggtccgtggggacctctaggtggaacggtctacccgtggaccgtaaggtcttcgtaggtacttcgtaaccggttttaccctacctagttaaggtactccgtaaacgtggggttacgccggaccgtaacgggtcccggtaccgtttacgggaacccgtaaaccgggtaaccccgttgggggtaacggtttacggggaaccgggtttacgggggggtaacgtttacccggggggggaaaccccgttaaaaaccccccggtttaaccggtaaccgggttttacggggggttccggttaaaccggtaaacccgggtttaacggggtttttacccgggttaacccccgtttttacccccgggtaaaccccccccgtaacgggtttttacccccccgggggtcccccggggggttaaaaaccccgttttaaaccgggaaaacccccccggtttttttaaaccccgtaaaaccgggtaacccgggtttaaacccccccgggaaaccccggttaaacccccggttttacccccggtttaaaacccccgtaaaaacccggttaaaaacccccggttaaccccggttaaacccgggtaccccccgtttaaagtaaacccgggttacggggtttaacgggtttaacccgggtacggggtaaaaccggttccccggtaacggtaacccctaggggtttaacctaaccccgggtaacccggttaaccccgggtaaccgggttcccggttaaaccgtttacgggtttaccccgttagggaccggtaaccggttaccgggtacccggttaaccccgtacggttaacccgggttccgggtaaggtcccgttaacccgggttaccgggtaacccggtcggggtaccccggttacccggttttacgggacccctttacgggggttaccccggggg

SEQ ID NO: 209979 - DNA, 790 bp, Homo sapiens
  misc_feature: GYAE6OF02FU5AQ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactaggacctggaggatcctcttcttgggtggcagctagctacaagtgcccactcccaggtgcagctggtagcagtcgtgggctggaggtgaagaagcgtggggcctcaggtagaacggtctcctgacaaggtccttcgtggatttccgaccgttttaccctcgtagttagtaacttcgaaaccgttggggttctaccggtacccgaagggtcccgtagtacgggtaacccaacggtacccgttggaaggttgggtaaggttggggtacgttacggggaaccccgtaaaccccgtaaccgtacggttagggtacgtacacgtaaggttccttaccgtttaccgaaccccttacgtacccggtaccgggtaacctacggtaaacctttacccgaagtacgtaaccccgacgtaaacctccccgttaactaaacgttaaacccgacgtaacggacccttaacgtaacgtgggttaacgttacgggaaggtacgaccgttacgaaccgttacgtccgtaacggaaccgtacccgtaaccggtccgttacttaaccgttctcggttacgaccggtaacggaccgtacccgacgtaaccgttaccgggacgtacccggtacgttacccgggacgttacgggtcccgttacgtttaccggtaccggttcggtacccgggg

SEQ ID NO: 209980 - DNA, 862 bp, Homo sapiens
  misc_feature: GYAE6OF02FWVCM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgaggtgaaggtctccgtgcaaggtcttcgtggacttcacgtttacctctatagtatcaacgtgggtgccgccgaggccgcgtacggaaccaaccgacccgtggacggtagggtacgtaggggtagtcggggaccgaaaccccgtaaactacggttggtacgttaccgacgtacggttcgtaccctttaccgaaccccctaacgttccccggtacccggggtaaccgtaacgtaacccgtttaacccgtaacgttacccgggtaaccccgtaaaccggttaaaccccttaccccctaaccccgtaaaacgttaaaaacccgacccgtaaacccgtaccccgttaaaccctaacgggtttacgggtaaacggtttaacgggaacggtaaccgtacccggttaacgaacgttaccgtttaccggtaacgggaaacccgtacccggaacccggggttacccgtttaccgttaaaccgttttaacggttacggtttacggaccggttaaccggtacccgttaccccgtaacgggttaccggtccccggggttaagtaacccgggtaccccggttaaccgggtccgtaaccggggttcccccgggtttaccgtttaccggttacccggtttccgggtaacccgggggg

SEQ ID NO: 209981 - DNA, 779 bp, Homo sapiens
  misc_feature: GYAE6OF02FQDGP.17.25.C03.1.454.CMB.1.raw
  modified_base (237)..(237): a, c, t, g, unknown or other
  misc_feature (237)..(237): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtagaagaacgcgtcggggcctcgagtgaaggtctccnggacaggtcttcgtggactttcgactttacctactatagtatactaacgtgggtacgcgaccgtacggccgcgtcggaacaaccgtacccgtaggaggtaggaggtaggggaggtacgggaccgtaaaccccgttaacgtaccgttggttcgacgtaacgtacggttcgttaccgttccgtaaccctacgttacccggtaccgggaacgtaacgtacccttaacgtacgtaccgtaaccgaaccgttaaacctccctaacctaactaaaccgtaccacggaaacccttaaccggtaggtacgggttacggttacggacggtaaccggaccgtaacggtaccgtacgttaccgtacggtaaacccggtacccggaacccgggttccgttaaccgtttaagtttaaccgggttagtaccgtaacgggtacccgtaacgtcccccgtaacgggtaccggtccgggtaccggcgttacccgggtaccggtacgtacccgggtaccggtttaccctttacggttaccggttccggttacccgggggg

SEQ ID NO: 209982 - DNA, 813 bp, Homo sapiens
  misc_feature: GYAE6OF02FM2BN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagacgccgtggggcctcgagtagaacggtcctccgtgacgaggtcttcgtggtacttcgtaccgtttaccctccgtaagttagtactacgaacgtgggtcgccgccgacggcccggcgtacggaacaaccgtaccgtagacggtagggtaagttgggaacggtcgggtaaccgaaacccttaaacgacggttcggtaggtacctaagtacgttcgttaccttacccgacccgttaccgtaccccggttaccggggaacctaacggttaacccgtttaccgaacgtccgaaaccccgaacgtaaaccccttccctaacccgtaaataaaacccaccgtaacgtacccttaacgtacgttacgggttaaagttcggaaacggtacgtacccgtaagtaaccgtaacttcggtaacgaacccggttaacgtaacccgggttaccgttacgtttaaacttcggtacggttaacggacccgggtaaccggtaaccgtccccgtaacgggtaacccccggttgggtaacccggtaacccggcccggtaaacgggtccggtaccggttcccggtttaccccgtttaacggttacccggttttcgggaacccgggggg

SEQ ID NO: 209983 - DNA, 934 bp, Homo sapiens
  misc_feature: GYAE6OF02G4Y1X.17.25.C03.1.454.CMB.1.raw
  modified_base (176)..(176): a, c, t, g, unknown or other
  misc_feature (176)..(176): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtncagctggtcgcaggttctggggctggaggtagaaaggtacgccgtggggtaccctcgagtagacggtcctaccgtgacctaaggtccttacgtaggtaactttccgtaaccgttttacccgtacccttaattacgtacttaccgtaaaggttcgggttacggaccgtccggaccggtcccggtacgttacgggaacccgaaaccggtacccttggtaggttacggtaaggttacgggggacggttaccggggacccgtaaaaccccgttaccgtaccggttacggtaccgtactaaccgtacgtttccggttcccttacccaacccgtaccggttaccccggttacgggaacctaaacggttaacccttaacccgtacttacgggtaacccaaaccgttaaacccttcccttaaccgaaaacttaacccgaaaccctaaaccgtaacccttacccggtaaagtttacgggtaacggttacggaaccggggtaactacccggtaacgtacctacggttacccgtaccggtaaccggtacccgtaacccgggttacccgttaaccgtttaacgggttcccgtttacgggttaccggggaaacccgttaccggggtacccccggttaaccggaaacccgggttcccgggttaacccggggtcggttaacccccggttccgggtaaacccggtacggtaacccgggttaacccggttcccgggttttaaccggttacccgggtttaaccgggtccccggggg

SEQ ID NO: 209984 - DNA, 744 bp, Homo sapiens
  misc_feature: GYAE6OF02H5V5M.17.25.C03.1.454.CMB.1.raw
  modified_base (474)..(474): a, c, t, g, unknown or other
  misc_feature (474)..(474): n is a, c, g, or t
  modified_base (586)..(586): a, c, t, g, unknown or other
  misc_feature (586)..(586): n is a, c, g, or t
  modified_base (698)..(698): a, c, t, g, unknown or other
  misc_feature (698)..(698): n is a, c, g, or t
tcagcgtagactagcacgaccggtgctcgatttagtagtgtagatttgggtttggggactcaacaaccacatctgtcctctagagaaaacccctgtgagcacagctcctcaccatggactggacctgggaggatcctcttcttggtggcagcagctaacaagtgcccactcccaggtcgacagcttgggtgccagtcgtcgggggtctggagggtgaaacggaacgtcccgtaggggccttacgaggtggtaacggttctacctcggacgaacgggtctttcgtaggactttcttaccggttttacctaccttaacgttacgttaactaccttaaacgttgggggtgtaccggccgaacgggcccgtcgtacggaaaccgaaccgtaaccgtcggtaggttacggaggttaggggacttacgggggaaccctaaacccgttaaacgcggttcgggtcttaccgaacagggtttnttaccgttcaacccctacggtcccgtaccgggtaacctaaggtaaaccctttaccgacgtacgaaccccgtaacctaacccttcctaccaaactaaacgacaaccttccganacgttaggtacgttgaagacgtcctagtaccgagtacgacggtacacccggacgtcccttagtttactaccgtaggtacgacgtacgtaccgacccgtagccggtaccggtnaaccgtcgacgacgtccgcggtttcccgtagtcccgttaggccggg

SEQ ID NO: 209985 - DNA, 888 bp, Homo sapiens
  misc_feature: GYAE6OF02IVFPH.17.25.C03.1.454.CMB.1.raw
  modified_base (176)..(176): a, c, t, g, unknown or other
  misc_feature (176)..(176): n is a, c, g, or t
  modified_base (184)..(184): a, c, t, g, unknown or other
  misc_feature (184)..(184): n is a, c, g, or t
  modified_base (271)..(271): a, c, t, g, unknown or other
  misc_feature (271)..(271): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctcggaggatcctcttcttggtggccagcagctacaagtgcccactcccaggtncagctggngcagtctcgggctggaggtgaagaagctgggcctcagtgaaggtctcctgcgaaggcttcgtggtactttcgaccggttttaacccnccttattaacggtactacgtaaccggtggggttacgaccgaccgtacgggtccctccgttacggaaccaaacggtaccctagggtacgttcggaagtttcggggacgtcggggaccgtaaaccccgttaacggaccgttgggtacggtaccaacgtacggtttcgttaccgttacctacccgtaagttccccggttaccggggaacgaggttaccctttacccggtaagttccggtaacccaacgggttaaacccttcccgtaaaccctaacggttaaaacccacgtaaaccggtccccttaacgtacgggttagggtaacgtttagggaaccgggttacacccgttaaggtacctaacgggtttacgtaaccggtaacccggtaaccgtacccgggggtaacccgtttcttaaaaccggtttttacccgttaacgggtttccgaaaccgggtttacgggacccccgtttaccccgggtaaccgttaaccgggggttaccccggttaacgggggtaaacccgttaaccggtaacccggggttaccctaaccgggggtttaccccgttaaccggggtttttcccggtaacccgggtttccccgggttaccgggggggg

SEQ ID NO: 209986 - DNA, 772 bp, Homo sapiens
  misc_feature: GYAE6OF02FSDO8.17.25.C03.1.454.CMB.1.raw
  modified_base (103)..(103): a, c, t, g, unknown or other
  misc_feature (103)..(103): n is a, c, g, or t
  modified_base (174)..(174): a, c, t, g, unknown or other
  misc_feature (174)..(174): n is a, c, g, or t
tcagcgtagactagcacgaccggtgctcgatttagtagtgtagatttgggtttggggactcaacaaccacatctgtcctctagagaaaaccctgtgagcacanctcctcaccatgactggacctggaggatcctcttcttggtggcagcagctacaagtgcccactcccaggtncagctggtgcgtagtcgtgggctgaggtagaagagcctcggggcctcagtgaaggtctccgtgacgaaggtccttcgtggtacttcctaccgttttacctccgtattagttactaccgaacgttggggtacgccggtcccgagggtccccggtcgtacggaaccgaaacccggtacccgttacggacggggttgggaacggtttgggggaacgttccgggggaacccgtaaaacccccgttaaagacccggttgggttacgtaccaagtccggttacgtttcccgttaccgtacccctaggtaccccgtccgggaacctaacggtaaccctttccgaactccgaaccacgtaacctcccgtaacaaacgtaaccaactacgaccttaccgagtcggtagtggacggtactccttacggactagttaccgacggtacccgaccgtaccggaccggttcctttaaacgtttcgcggttactacgggtaccgtacggacccctaacggtcgtaccgggttacgtcccggttacggtaaacccgccgggttaacggcccgggtttacggtttacccgttaccggttaccggggtacccgggg

SEQ ID NO: 209987 - DNA, 813 bp, Homo sapiens
  misc_feature: GYAE6OF02HS1CK.17.25.C03.1.454.CMB.1.raw
  modified_base (179)..(179): a, c, t, g, unknown or other
  misc_feature (179)..(179): n is a, c, g, or t
  modified_base (657)..(657): a, c, t, g, unknown or other
  misc_feature (657)..(657): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagactcctcttctggtggcagcagctacagcgtccactccgagtgcagctgngacagtcgtgggtctgaggtagaacgtacgccgtgggacctcgaacggtaggtaacggttccttaccgaggacgaacggttacttacgtacggtactttaccgtaaccggtttacctaccttaagttacggtactaccgtaacgggttcggggtccgccggtaccggaacgggttcccgtacggttaccggaaccgtaaccggtaaccgttggtacggttagggagttacgggggacggttaccgggggaacctaaaccccgttaacgtacggttacggttacgtaccgtacgttaacggtcgtttaaccgtacccctaacgttacccggtaccgggttaccggaactttaccggtaaccgtttaccacggtaaccggaaacccgttacggtaaccctttacccaaacccgttaaaagtaaaccccgaggtaaccgtaccgtaaacggtaacggttttggaaacggttacggggtacncgttaaccgacgtactacgtcggaacgaaccggttaccgacgttcgttaacttacgttcggaacgtacgcggtaaccgtccggtaaccttgggaaccgttaggccggtagacccgcggtcgacgggttccttacggttgtacccggttggaccggg

SEQ ID NO: 209988 - DNA, 848 bp, Homo sapiens
  misc_feature: GYAE6OF02IWNCF.17.25.C03.1.454.CMB.1.raw
  modified_base (294)..(294): a, c, t, g, unknown or other
  misc_feature (294)..(294): n is a, c, g, or t
tcagcgtagactagcacgaccggtgctcgatttagtagtgtagatttgggtttggggactcaacaaccacatctgtcctctagagaaaaccctgtgagcacagctcctcaccatcggactcggacgtggagactcctcttcgtggtggcagcagctacagtcgcccactccgaggtgcagtcgtggtacgctaggttcggtggggtctagggaggtaggaaggacggtccggtcgggcctagaggtcgtacggtcctcgtagacgtagttctgtcgtcttacctaccgtttccnccgttagtaatactacgtacggtgggtccacgccgacggtccgtcggtaacgaccgtaacgtacgtggaggtacgggagttacgggacggttacggtaaacccctaacccgtaaggtcggttggttaccgaacgtacggtcgggtttaccgtaccctacccggtaaccctaccgggttcccggtaaccgggtactaaaccggtaccttaaccggacgtacccggtaaccgtaaccgtaacccttacccgtaacctaaaaccgtaaccgttaccgacctacccaaggttaccggtaaggttcggttaagaccggttaccggtacctaaccgggttcgaaaccgttccgtaacgtacccgggtaccgtacccgggttacgtttaaccgttagttaaccggtccggtcggaaaccggtaccggttacccggtaaccgtaaccgggtttccgggtaccccgggtttaggaaccccggtttaaccggaccgggttacccgtaaccgggtttcccggttacggttttacccgggttacggttccccgggggtaaccgggg

SEQ ID NO: 209989 - DNA, 753 bp, Homo sapiens
  misc_feature: GYAE6OF02H33JQ.17.25.C03.1.454.CMB.1.raw
  modified_base (105)..(105): a, c, t, g, unknown or other
  misc_feature (105)..(105): n is a, c, g, or t
  modified_base (196)..(196): a, c, t, g, unknown or other
  misc_feature (196)..(196): n is a, c, g, or t
  modified_base (376)..(376): a, c, t, g, unknown or other
  misc_feature (376)..(376): n is a, c, g, or t
  modified_base (738)..(738): a, c, t, g, unknown or other
  misc_feature (738)..(738): n is a, c, g, or t
tcagcgtagactagcacgaccggtgctcgatttagtagtgtagatttgggtttgggggagtcagtctcagtcaggacacagcagtggacatggacgggtccccgntacacgctccgtggggcctccgtgcctactcgtcggctccggagcgtcgaccagtatgtcgactatcccagtatcgaccctagtcctaccnctccctcccgtgtctcgccctggtgggtacggggtaccaggtcgtacactactcacgttcggaccgaactaacgtcgaaccgggtaacttaaaacttagttttaatggtaactcgacgacgaaacggtaaaccgtaggaaaaccgccctaacgtacctcgtaacgtctcgttcgtcggtnacctacctcccagttccgaggtacgacggttccggcctccgaagtccggtacgtacgcggtacgcgttaggtaccgtagtaccgggtacggtaactattttaacgtaaccctacgtacccttaaccggactactaccgtaaccgtacgttaccgtaccgaaccgtacgttaccgggtaaggttccgttacgtaacgacgttaactaccttaacgtactaacgtaccaagtacgttacctaccgtcccttacccgtacgttccgttaacgttaccgggaacgaaccggtaaacgtacggttaagtaccgtaaagttaaaccgtaacgtacggttacgaccgtacggtaacctcgtaaccgttntacccgttagttacc

SEQ ID NO: 209990 - DNA, 687 bp, Homo sapiens
  misc_feature: GYAE6OF02IO34X.17.25.C03.1.454.CMB.1.raw
  modified_base (304)..(304): a, c, t, g, unknown or other
  misc_feature (304)..(304): n is a, c, g, or t
  modified_base (359)..(359): a, c, t, g, unknown or other
  misc_feature (359)..(359): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttctggtggcagcagctacaagtcgcccactcccaggtcgcagccgtggtgcgagtcgtgggctggaaggtacgaagaagcccggtgggacctcgtaggtcgtaacggtcctccgtagacgtacggtctcgtaggtacttccgtaccgttacctccgttaatagtacncgtaagtggcgaccggtcgacgtccgcgacgaacgacgacgtgtacggtgtaggnggagtacggaccgtaaaccacgtcggtgtacgtcaagtcgtcgtctaccaccgtcgtaccggcgactacgtaccgttaccagaccgtaccgtaacctaaccgtaccctaacgaaacctaacacgtaaccgaccgtaaccgtaggtccgggtaattacggacgaccgtactaacggacaccgttaccgaacggtaccgtaaccgtccgaccgtttacgttaacgttcgtacggtaccggtacgtaccgtaccgtcccgacgtaccggttcggacgtccggaccgtagtcccggtaactcccggttaccgtagttcccggaggtaccggg

SEQ ID NO: 209991 - DNA, 919 bp, Homo sapiens
  misc_feature: GYAE6OF02INMO1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctctttcgttggtcggcagcgagctaacgaagtcgaccccactccctaggtcgcagctgggtcgcgtagtcggtggggtcgtggaagggtaggaaacgaacggtccggtacggggcccttagacggttaggaacggttcctaccgttgacgtaaggtcgttcgtacggttacttaccgttaaccgttttaccttaccgttaattaacggttaacttaccgttaaaccggttcgggggtaccgtcccggacccggtacgggtccccggtaccggtaccgggtaaacccggtaaaccggtaccggttagggtacggtacggggtacgggttacgggggtacgggtaacccgggaaaccccgtaaaacccggttaaccgttaacggtttccgggtaccggttaaccgtaaccggttaggtttccgtttaaccccgttaacccgtaacccgttcccggtttaccccgggtaccgggtaaaccgttaaccgtttaacccttaaaccgtaaccgtaacccggtaaccccgtaaacccgtacccttaacccctaactaaaacccgtaaacccacggtaaccgtaacccgttacgtacgggttaacggtaggtttacggaacgggtacccgtaccgtaactaaccggtaccgtacgtaacgggtaccgaaccgtaccgggttaccgttaacgtttacgttacgtcgtaacgaccgtacgtacccgtaccgacggtacggtccggtaggcccgtacggacgtcgtacggtccgttacggtctcggtacggtacgg

SEQ ID NO: 209992 - DNA, 820 bp, Homo sapiens
  misc_feature: GYAE6OF02IW7IK.17.25.C03.1.454.CMB.1.raw
  modified_base (96)..(96): a, c, t, g, unknown or other
  misc_feature (96)..(96): n is a, c, g, or t
tcagcgtagactagcacgaccggtgctcgatttagtagtgtagatttgggtttggggactcaacaaccacatctgtcctctagagaaaaccctgtnagcacagctcctcaccatggactggacctggaggatcctcttcttggtggcagcagctacaagtgcccactcccaggtgcagctggtgcagtctggggctgaggtgaagaagcctggggcctcagtgaggtctcctgcaaggcttctggattcacgtttcctctatagtactacaacgtgggtcgtcgccgagggccgtcgtacgggaccgaaaccggtaccgttagggacggttagggtaacggtcgggggaagttacgggggaacccgtaaaaccccgtaaacgtaccggttgggttacggtccgaacgtaacgggtttcgttaccttcccgtaaccccctacggttccccgtaacccgggggaactaaaccggtacctttaacccgtaacgtaaccgaacccgttaaacccggaacccctttacccgtaacccctaaaacttaaaacccgacctaacgtaccccttaaacgtaacgttaggggttaaggttacggaaacgggtcgtacccgttaagtaacccgtagttacccgagtaacccgggaaaccgtacccgggtacccgtttaaccgtaacgttttaccgcggttaacgaccgtaaagggttacctccccggtaggtaacccgggtttaccgtccggaaccggttcccgttaacgggacccgaagggttcccggtttaacctttcccggttaaccggtttccgggtaacccggggg

SEQ ID NO: 209993 - DNA, 767 bp, Homo sapiens
  misc_feature: GYAE6OF02JDPPR.17.25.C03.1.454.CMB.1.raw
tcagcgtagactagcacgaccggtgctcgatttagtagtgtagattttgggtttgggggagtcagtctcagtcaggacacagcatggacgatgagggtccccgcttcagctcctggggctcctgctactctggctccgagctgcagatgtgacatccagatgacccagtcctaccatccctcccttgtcctcgtccgttcgtgggttcgggggtacacggtactccaacccattcctaccgttcggacccgggaactaacgttccgaaccgggtaacctttaaaaacctttaattttaaacgttggtaactaccgagtacgaaacgaaaaccgtaggaaaaaccgcccctaacgtacccgtccagtaaccttcgttcgtcgggtctacctacctcctacttcgtcgacggtaacggttcgaccgtccaggtcgtacggttcgaggtcgggactaggcgtagtccggtaggaacttagtacttttaccaacttcgacctaccgaactccctaacctaccggttacaccgtaacccgtaacgttggtaaacggttcgttaccgttacgtaccgtaactttaccgtaacccttacgttacgtaaacccgtaacgtaacgttaccggtttaaccctaacccgggtttacccctcggttaacccgtttcgttaaccgggaccgtaacgggttaccgtaagtacgtacggtaagttaaacccgagtaacggttcggacgtaccttaccgacctcgtactttccgtatttcccg

SEQ ID NO: 209994 - DNA, 808 bp, Homo sapiens
  misc_feature: GYAE6OF02FRGA2.17.25.C03.1.454.CMB.1.raw
  modified_base (190)..(190): a, c, t, g, unknown or other
  misc_feature (190)..(190): n is a, c, g, or t
tcagcgtagactagcacgaccggtgctcgattttagtagtgtagatttgggtttggggactcaacaaccacatctgtcctctagagaaaaccctgtgagcacagctcctcaccatggactggacctggaggatcctcttcttggtggcagcagctacaagtcgcccacctcccgaggtgcagcttgggtnccgagtcgtggggctggaggtgaagaacgccgtggggcctacgaggtaggaaggttcttacccgtggtacaacgggtctttacgttacgggtattttaccgttaaccgtttttaaccccttacccgtttaagttaacgttaacttacccgtaaacggttggggttcggaaccgccccggtaaccgggcccggtcccgttacggaaacccgtaaaccgggaactttccgggaaggtccgggtaaggttcggggtaacggtacggggaacccggttaaaaccccttaacggaaccgttgggtaccgtaccacgtaaggttaccgtccttacccaaccccgttagttccccgtaccgggtaacacggttaacctaaccgacgttaacgacctaaccgtaacctaccctactaaactaaaccaacaccaccctaacgtacgtacggtacgttaaggacggacgtacccgtacgagtcccttcgtaacggacctaaccgtacccgggtacttaacgtttccgttacgtacgttacggacgtacgacctaccggtagtaaccggtcggttcgaaccggcctacggccgacgttcccggtctttaccgtacgttcggtaaccggg

SEQ ID NO: 209995 - DNA, 835 bp, Homo sapiens
  misc_feature: GYAE6OF02G8L8E.17.25.C03.1.454.CMB.1.raw
  modified_base (184)..(184): a, c, t, g, unknown or other
  misc_feature (184)..(184): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttctggtggcagcagctacaagtgcccactcccaggtgcagctggtncgagtcgtggggctgaggtgaagagccgtgggacctgagtgacttgtctccgtagcgaggcctaggtggactagtactcttacaacaaaattacgtaggtaataggaagtttggggtcggtacgaacccggaccgggaccccccggaaacggaaccggggtcgttagggacgggttggggggttagggggtcgggttcggagggtcggttacggttacgggaacgggttaacggcgtaaaccgaaggttactcgggaacctaaccggtaaaaggtaacgttaggggaaacgggggactaacggtaacgggtaacgaaccgggttaaccgttaacccgggaaacccgggaaccccaaacccccccgaagaaacccgtacgtaaacggtaaccgtaactacggtaccgaacttaaccgtaccgaacggtaaccgtacctaggtaacgtacgtaccgtaaccgggtaaaccgtacccgggttaaccgggtcccggtttaaactttaacggttaccgtaacgggttcggtaacccggtagttaaacggttttacgggtttttaccgaacggtttacctaaaggtttaaccccgtaagtttaaccggttttaaggtaccggtttacggaaccgttttacggtacgttaaccggggg

SEQ ID NO: 209996 - DNA, 654 bp, Homo sapiens
  misc_feature: GYAE6OF02G99JU.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctacaagtgcccactcccgaggtcgccagctggtcgcagtcgtggggctgaggtgaagaagccgtggggcctcgagtgaaggtctccgtgacaggtcttcgtggtacttccgtaccgtttacctccgtatacgttacacgtaacgtggggtcgccgaccgacgggcccgtcgtacggaaccgtaaccgtacccgtggaaggtggacggttggggaacgtcggggaacccaaacccgtaccgtacggttcggtcgtacgactagtcgtcctaccgacctcgtccgtaccggataccgtactaccgatcgaccaccgtacctcctacaataccacgactacacgtagtagggtacttggaacgtcgccgtagactacttcgaggtacccacggaccgtacgttacgttactcggtgcgacgtacgacctaccggacgtcgtccggtacggccgtacccggtcggacgtcggtacccgtcggtttacgaccggttcggacccgggg

SEQ ID NO: 209997 - DNA, 907 bp, Homo sapiens
  misc_feature: GYAE6OF02F6MRB.17.25.C03.1.454.CMB.1.raw
  modified_base (236)..(236): a, c, t, g, unknown or other
  misc_feature (236)..(236): n is a, c, g, or t
tcagcgtagactagcacgaccggtgctcgatttagtagtgtagatttgggtttggggactcaacaaccacattctgtcctctagagaaaaccctgtgagcacagctcctcaccatggactggacctggaggatcctcttcttggtcggcagcagctacaagtgccactccaggtgcagctggtgcagtctgggctggaggtgaagaacgccgtgggcctcgagtgaaggtctccgngacaagggtcttgaggtattctacgtttacctcttaagtacgtactacaacgttgggtgaccgtcgacggccgtacgtcggaacaccgacgtcggagtcggagtcggggatcggggtaacgaacccttaacgaccgttggtacggtctaacggtaggtttacggttcctttacccgaaccccttacgttccccgggtaacgggtaacccgtaacgttaaccgtttaacccgtaacgtccgaaacccgtaacccggtaaacccgttacccgtaaccctaaaacgttaaaacccgacggttaaaaccgttaccccgttaaacgttaaacggttaccgggggttaaagtttaaccggggaacgggttaacccggtaacccggttttaacgggaaaccccgtttaacggttcccggtttaaaccgggaaaccccggaaccgggtaaccccggggtttaccccggtttaaacgtttaaacccggttttaccgttacggggttaacccgtaccggtaaccgggttacccggtttaacccggaaccgttttaaacccgggtccggggttacgggtttaaaaccccgcccgggttaacccgggttactaaacccgggggtttcccgtttaacccggtttttacggaaacccggggtttttcccgtaaccccgggggggg

SEQ ID NO: 209998 - DNA, 1044 bp, Homo sapiens
  misc_feature: GYAE6OF02G9LDN.17.25.C03.1.454.CMB.1.raw
tcagcgtagactagcacgaccggtgctcgatttagtagtgtagatttgggtttggggactcaaccaaccacatctgtcctctagagaaaaccctgtgagcacagctcctcaccatggactggacctggaggactccttcttcttgggtggcagcagctacagtcgcccactacccgaggtcgacagcgtggtgcagttcgtgggctaggagggtagaaggacggccgggtcgggaccctacgtaggtaggtaacggttcctaccgtaggacgtaaacggtctttcggggggggtacttactttaccgtaaccggttttaaccccttaccgttaacgtttaacggttaacttccgttaaacggttcggggttcgggaccccggggtccccggggtcccggtaccggttacggggaacccgaaaccggtaacccggttagggaccgggttaaggggtacggtagggggtaacggttacccggggaaacccgtaaaacccccgtaaacgggtaccgttagggttaccgttcgaacggttaggttacccgtttcttaccccgaacccgttaccgttaccccggtaccggggtaacctaaccgggtaacccttttaaacccacggtttaaccccgaaacccgtaacccgtaacccttaccccgtttaaacccgtaaaacccgttaaaccaaacccggttaccgtaaacccggtaaccgttaaacgggtttacccgggttaaagggtttaaccgggtaaaccgggcccggttaacccggttaacggaaccttaaaccggtccggttaaccgtaaccggggtaaaccgtcccccggggttacgtttaaaccgtttaccgtttaacggtttaacccgggttggaacccgggttaaggtaccccgttaccccgacccggggttaaccggtacccgggttccgggttaacccggttaccggggttaaccccggaaccgggttcccgggttacccgggtttaccccggttttaccgggtacccgggtttacggggacccggggtaacccccgggg

SEQ ID NO: 209999 - DNA, 780 bp, Homo sapiens
  misc_feature: GYAE6OF02GSMA1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagaacgccgtgggcctcgaggtgaacggtctccgtgaccgaaggtcttcgtaggtacttcctaccgttttaccctaccttagtacgtacttacgtaacgttgggtacgccgaccgacgggcccgtcgtacggaaccgaacgtacctggtacggtcggagtgggagtcgggacctaaacccgtagacgtcggtactacgacgtaggtctctacctacccgtacgtcccgtaccgggtactaccggtactaccgtagtacgaacccaacccgtaaccgttacccctaactaaacctaaacccgaacctaccggtaccttaaacgtacggttacggtaggttaaccggaacgggtaccgttaccgtaacgtcctaaccgtaccggttaccggaaccggtaccgtaacccgggtacccgttaactttaaccgttacggttcggtacgaaccggggttacacccggttaaccccgaaggtttccgggtaacccggtacgggtacccgtaaccggttcgggacccggttacggtaccccgggttccgttttacgggtacccgttcgggggttaacccgggg

SEQ ID NO: 210000 - DNA, 847 bp, Homo sapiens
  misc_feature: GYAE6OF02JIVC5.17.25.C03.1.454.CMB.1.raw
  modified_base (138)..(138): a, c, t, g, unknown or other
  misc_feature (138)..(138): n is a, c, g, or t
  modified_base (188)..(188): a, c, t, g, unknown or other
  misc_feature (188)..(188): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagactctcttnttggtggcagcagctacagtacccatcccaggtgcagctggtgcagtcgngggactgaggtgaagacgccgtacgggcctcaggtacggtaaggtcctccgtgaccgtaacggtctttacgacggtatttaccgaaccgttttacccgtcgtaattacggtactacgaacgttcggggacgtaccgaccggtcggtaccccgcgttaacggaacctaaccggtaccgtagtcggtacggtagtaggggacgtcggggaaccgttaaaccctacgtaccggttaggtctacgtaaccgtggttaccgttcttacccgacccgtcgtaccggtcccgggaataacgtacccgttacagtaccgacctaaccggtaccttaccgtaaccgtaacaaaccgtacgtaacccgtaccgtaaacgtacggttacggtaaacccggtttgggaaacggtaccgtaccgttaaaccgttacgtaaccgttccggtaaaccggttaccggaaaccggttacccgggtacccgtttaaccgttaccggtttaaccgttcggttaacggaacccggttaaccggaccgttacccgtaaccggtaccggtttcccggtaaccggttaccggttacccggtaccggtaaccgtacccgggggttaccctttaaacccggttcggttaaaccggtttcccgggtaccccgggggtaacccggg

SEQ ID NO: 210001 - DNA, 1196 bp, Homo sapiens
  misc_feature: GYAE6OF02IBI37.17.25.C03.1.454.CMB.1.raw
  modified_base (347)..(347): a, c, t, g, unknown or other
  misc_feature (347)..(347): n is a, c, g, or t
tcagcgtagactagcacgaccggtgctcgatttagtagtgtagatttgggtttggggactcaacaaccacatctgtcctctagagaaaaccctgtgagcacagctcctcaccatggactcggacctggaggactccttctttcttggtggcagcagctacgaagtcgacccacctccgaggtcgcagtcgtggtgacgtaggtcgtgggactaggaggtaggaacgacgccggtcgggtcctacgaggtacgtacggtcctccgtagacgtacggtccgttcgtaggtacttaccgttaccgtttaccttaccgttaattacggtactaccgtaacggtggggtacnccggaccgtacggtccgacgtacggtaacctaaccggtaccgtggtacggtacggtacggtacggggtacggtacgggaacccgtaaacccgtaaccggtacggttacgggttacgtaaaccgtacggtacggtttaccgttaaccccgttacccgtaacccccgttaaccggttacccccgggtaacccggggtaaacccgtaaaccggttaaaccccgtttaaacccggtaaccgtttaaaccccgggtaaaccccggtaaaccccggtaaaccccgtttaacccccgttaaaccccgttaaaaacccgttaaaaaccccgtaaaaccccggtaaacccgtaaaccccgttaaacccggttaaaccgggttaaccggggttaaaccgggttaacggggtaaacgggtaaccgggttaaaccccggggtttaaacccggggttaaaaccccggtttaaacccgggttttaaaccccggggtttaaaccccggggttaaaccccccgggggttaaaaccccccgggggttttaaaacccccccgggggggttttaaaagggtttttaaacccccccccccccccccccccccccccccccgggttttttaaaacgggttttttaaaccccgggggtttttaaacccgggggttttaaaaccccgggggtttaaaccccggggttaaacccggggtttaaacccccgggttttaaacccccccggggtttaaacccccgggggtttaaaacccccgggggttttaaacccccggggggtttaaaccccgggggttttaaaccccccgggggtttaaacccccccgggggtttaaacccccgggggtttaa

SEQ ID NO: 210002 - DNA, 796 bp, Homo sapiens
  misc_feature: GYAE6OF02IE1XQ.17.25.C03.1.454.CMB.1.raw
  modified_base (187)..(187): a, c, t, g, unknown or other
  misc_feature (187)..(187): n is a, c, g, or t
  modified_base (267)..(267): a, c, t, g, unknown or other
  misc_feature (267)..(267): n is a, c, g, or t
  modified_base (599)..(599): a, c, t, g, unknown or other
  misc_feature (599)..(599): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctctttcttggtggcaggcagctacaagtgcccactcccaggtcgcagctggtncagtcgtggggctggaggtagaagaacgccgtgggggcctacaggtgaacggttctacccgtggacgaacggtctttcgnggtactttccgtaccgtttttaccctccgttataggttacctacgtaacgttggggtacaccgtccgacggtcccgtgttaccgggaaccaaccgtaccgttggtacggtacgggtaggttgggggtaaccgttacggggaccctaaaacccccgttaagtaccgttcgggttacaccgtaacggtcggtttacgttccctaccctaccccgtagttcccccgggaccggtaaactaccgtaaacccttccgacgtaccgaaccccgtaaagtacccctacccgtaaacccaaacgtaaacccgcaagtaccccttaacgaggttaacgggngtttacggaacggtcgtacctagacctagtccgtacgaaccgaccgacgggttccttacgttaaccgttggtcggtacgaggttaaccgacccggttaccacgggttaccgttccgggtaacggtaccgtaaccccggtcggttaacggcggttaccggtttccgtttacgttacccggttccgggtaaccgggggg

SEQ ID NO: 210003 - DNA, 690 bp, Homo sapiens
  misc_feature: GYAE6OF02JBHVH.17.25.C03.1.454.CMB.1.raw
  modified_base (600)..(600): a, c, t, g, unknown or other
  misc_feature (600)..(600): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtgggcctcgagtgaaggtctacctgcaaggcttcgtggtacttcacgtttacctcctatagtactcaacgtgggtacgcgaccgtacggcccgcgtacgggacctaaccggaccgtggacgtcgggagtgggagtcggggaccaaaccccgtaacgtaccgttgggtctaccgacgtacgttcgttaccttaccaaccccgtatcccgtaccggggaacacggtaccttaaccacgtacggacccaaccggtaaccctccgtacctaaactaaaccaccgtaacgtaaccctaccgtaaggtacgggtaagttacggaacgggtacgtacccgtaagacctacggtaccgttacggaaccgaccgtacggtcccttacgtacgttacgngtacgcgtaaggtaccgtacctaacggtccgtaccgggttggaccgtaccgtacggcgacggtcccggttacttcgtacgtcggtacggg

SEQ ID NO: 210004 - DNA, 798 bp, Homo sapiens
  misc_feature: GYAE6OF02H8VDP.17.25.C03.1.454.CMB.1.raw
  modified_base (287)..(287): a, c, t, g, unknown or other
  misc_feature (287)..(287): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggactcctcttctggtggcagcagctacagtcgcccactcccaggtgcagcgtggtcgcagtcgtggggctggaggtgaagacgccgtgggcctcgaggtggtaaggtcctccgtgacgaacggtcttacgtggtaactttccgtaaccgttttaccncttaagtacgtacgtccgaacggtttgggccgtccgaccggacggtcccgacgttaacgggaacctaaccggtaccgtaggtacggtacgggaacggtcgggggtaacgtcggggaaccctaaacccgtacgtacggtcgggttcctacgtaccgtaggttccttaccgttacccgaaccctacgttcccggtaccgggactaacgtaccttaccagtaccgaccgtaacgtaccttcccgttaaccaacgtaaacgaccgtaacgtacccgttaacgtacgttacggtaggtttaaccggaacggaccgttccgtaacggtacctaaccgttacgtaccgggaaccgtaccggtaccgggttaccttaccgtttaacttaccggtggtaccgtcgggtaactcccggtacccgtaacgggtccgttacccgggtacggtaaccggtccggttaaccggcgtaacccgggtcccgttaaccgttttcggtacccggttgggtaccccgggg

SEQ ID NO: 210005 - DNA, 698 bp, Homo sapiens
  misc_feature: GYAE6OF02JDN3P.17.25.C03.1.454.CMB.1.raw
  modified_base (188)..(188): a, c, t, g, unknown or other
  misc_feature (188)..(188): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccacgtcccaggtgcagctggtgcngtcgtgggctggaggtagagaggccgtgggcctgacgtggaacggtcctccgtggacaagggtccttcgtggtacttacgtaccgtttacctactatagttactacgtaacggtggtcgccgaccgacggtccgtccgtacggaccgtaaccggacccgttgaacggtcgggtaggttgggaacggttacgggaccgtaaacccgtaaaccggtagtcgggttactaccggtacgtacgttcggttccttacgacccctacgtcccgtaccggacacgtacccgtacacgttcaaccgtaccgtaacctcctacctaactaaacgacctacgtacctacgtaacgtcggtaagttaggaacggacgtaccgacgtacgtacgtcgacgtaaccgaccgtaccggtccgttaaccttacttcgtagtcgtacggacgaccgtaccgacggtaccgtcggtcggacgtaccgtacgaccgcggtaccggttctcggtccttacgggtccggg

SEQ ID NO: 210006 - DNA, 625 bp, Homo sapiens
  misc_feature: GYAE6OF02FTSMX.17.25.C03.1.454.CMB.1.raw
  modified_base (241)..(241): a, c, t, g, unknown or other
  misc_feature (241)..(241): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctggggcctcagtgagtctctgcaggaaacttcnggacttctacgtttacctcctatagtatctaacgtgggtgcgccaggcccgcgtggacaccgtacctgaggtggagtggggatcggggacctaaaccccgtaacgacgttcgggtcgtaccgacgacgtcgtaccttacccacccgtacgtcccgtaccgggaccaagtacctttaacgacttcgaaccaccgtaaacctccctaacaactaaaccacgacgtacctacacgtcgtaagttcggaggtccgccgtagacacgttcaacggtaccacgaccgggtccttaccttaagttcctggtcgacgtagacgtcccgacgtcggttcggtcgacggtcccgtaggcgaccggtcgtcctttagtaccgttccggtacgggg

SEQ ID NO: 210007 - DNA, 785 bp, Homo sapiens
  misc_feature: GYAE6OF02G4ASD.17.25.C03.1.454.CMB.1.raw
  modified_base (64)..(64): a, c, t, g, unknown or other
  misc_feature (64)..(64): n is a, c, g, or t
  modified_base (153)..(153): a, c, t, g, unknown or other
  misc_feature (153)..(153): n is a, c, g, or t
  modified_base (199)..(199): a, c, t, g, unknown or other
  misc_feature (199)..(199): n is a, c, g, or t
  modified_base (692)..(692): a, c, t, g, unknown or other
  misc_feature (692)..(692): n is a, c, g, or t
  modified_base (699)..(699): a, c, t, g, unknown or other
  misc_feature (699)..(699): n is a, c, g, or t
tcagcgtagactagcacgaccggtgctcgatttagtagtgtagatttgggtttggggactcaanaaccacatctgtcctctaggacgaaaaccctgtagagcactagctcctcaccatggactggacctggagactccgtcttcttaggtggnagcagactaacgtaagtcgtccaacctcccaggtgcaggctggtancgtagtcgtagggctagaggtgaagacgcgtggacctctaggtagaagtccttcgagtcgaaggtctcgtacggtattacgtaccgtttaccacgtagttacgtacagtacgtaggtcgtaccgacgtaacggccgtacgtaacggtaaccaccggtacgttacgaggtagacggtacggggtacgtacccgggaacctaaccccgtttaagccggtttacgggtaaccttaccggtaaacccggttaggtttacccggttaaccgtttaacccccaacccgtacccggttaaccggggtaaaccccgtttaacggggtaaacctttaacccggttaaaccgttaacgtaaccccggaaacgtaaccgtaaaccccgttacgtaaccttaaacgtaaaccgtaaccgtaacgtaaacgtaacgaccgtaggtaagtacggtaaaggtcgaacgtacgtacaggtcgagtaacgtaccgtaagtctagtccgtntaacganaccgtagtaccgtacgaacgtcggtaccgtacgtacctaccggagttaccggaccgtacggttccgtaacgtcgttaccgtacggg

SEQ ID NO: 210008 - DNA, 529 bp, Homo sapiens
  misc_feature: GYAE6OF01A6EIS.41.64.F09.1.454.CMB.1.raw
  modified_base (509)..(509): a, c, t, g, unknown or other
  misc_feature (509)..(509): n is a, c, g, or t
tcagtctatactatcacgaccggtgctcgatttagcgcgtatacaaggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacaactcaaccctggtggtggcaggacaacctacgcacggaagttccaggacagagtcaccatgaccagggacacgtccgcgagtacagtctatttggaattggaggagagtgagatctgacgacacgggcctatttatattgtgcgagggaggggggtggggtcgcgtgacgtcggccccgtgtcgtacgttacgnggggccaggggaaccctggg

SEQ ID NO: 210009 - DNA, 530 bp, Homo sapiens
  misc_feature: GYAE6OF01BHRW1.41.64.F09.1.454.CMB.1.raw
  modified_base (510)..(510): a, c, t, g, unknown or other
  misc_feature (510)..(510): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacaactcaaccctggtggtggcaggacaacctacgcacggaagttccaggacagagtcaccatgaccagggacacgtccgcgagtacagtctatttggaattgagagagtgagatcgtgacgacacggcctatttattattgtgcggaggtagggggggtggggtcgcgtggacgtacggccccgtgtcgattacgnggggccagggtaccctcggg

SEQ ID NO: 210010 - DNA, 565 bp, Homo sapiens
  misc_feature: GYAE6OF01EAYHI.41.64.F09.1.454.CMB.1.raw
  modified_base (395)..(395): a, c, t, g, unknown or other
  misc_feature (395)..(395): n is a, c, g, or t
tcagtctatactatcacgaccggtgctcgatttagcgcgtatacaagggggcagtcatccaacaaccacactcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacaactcaacctggtgtgcaggacaacctacgcaacggaagttccaggacagagtcaccatgaccgagggacacgtccgngagtacagtctattggaattgagagagtgagatactaacgacacggcctaagttttacttaagttgtagcggtaggggacgggggggttggggtcgcgttgggacttacccggccccgtggtgtaaggttaccggtggggacccgaacggggtaacccctgggtaccccg

SEQ ID NO: 210011 - DNA, 553 bp, Homo sapiens
  misc_feature: GYAE6OF01C4OE1.41.64.F09.1.454.CMB.1.raw
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
  modified_base (528)..(528): a, c, t, g, unknown or other
  misc_feature (528)..(528): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgactactatatccactggtgcgacacggcccctggacgaggacttgagtggatgggacaactcaacccgtggtgtggcaggacaacctacgcacggaagttccgaggacagagtcaaccatacgaccgaagggaccacggtccgacgaagtacagtctagttaggaattgaggagngtgagntcgtgacgacacggtcctatttagttatgtggcgagggagggggggtgggcgtcgtaggaccttccggccccggtgtacgtagttacggnggggaccctaggggaacccctcggg

SEQ ID NO: 210012 - DNA, 538 bp, Homo sapiens
  misc_feature: GYAE6OF01AW2MA.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacaactcaaccctggtggtggcaggacaacctacgcacggaagttccaggacagagtcaccatgaccagggacacgtccgcgagtacagtctatttggaattgaggagagtgagatcgtgacgacacgggccatttattattggtgcggaggagggggggtggggtcggcgtggacgtaccggccccgtgtcgtacgttacgtgggggcccaggggaccctcggg

SEQ ID NO: 210013 - DNA, 519 bp, Homo sapiens
  misc_feature: GYAE6OF01DSKMY.41.64.F09.1.454.CMB.1.raw
  modified_base (463)..(463): a, c, t, g, unknown or other
  misc_feature (463)..(463): n is a, c, g, or t
  modified_base (478)..(478): a, c, t, g, unknown or other
  misc_feature (478)..(478): n is a, c, g, or t
  modified_base (504)..(504): a, c, t, g, unknown or other
  misc_feature (504)..(504): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactggtgcgacaggcccctggacgaggacttgagtggatgggacaactcaaccgtggtggtggcaggacaacctacgcacggaagtccaggacagagtcaccatgaccagggacacgtcgcgagtacagtctagtttggaattgagagagtgagatctgacgacacgggcctaatttattatgtgcggagggnggggggtggggtcgngtgacgtccgcccgtgcgtattacgngggccagggccctgg

SEQ ID NO: 210014 - DNA, 559 bp, Homo sapiens
  misc_feature: GYAE6OF01CT41T.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacacggcccctggacgaggacttgagtggatgggacactcaaccgtggtggtgcaggacaacctacgcacggagtccaggacagagtcacatcgacagggacacgtccgagacgtacagtactagtttaggaattggaggagtagtcgagtatcgtagacgacgacggacctagtttattagttgagcgtagggagggggggtggggtcgcgtaggacgtaccggccccggtagttcggactttaaccggtggggacccgtaaggggtaaccccgtggg

SEQ ID NO: 210015 - DNA, 613 bp, Homo sapiens
  misc_feature: GYAE6OF01ASBBI.41.64.F09.1.454.CMB.1.raw
  modified_base (405)..(405): a, c, t, g, unknown or other
  misc_feature (405)..(405): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctgaggtgaagaagccgtggggcctcagtgtaaaatttcctgccaggcatctggatacaccttcatcgacctactatactccacgtgggtgcgacacggcccctggacgaggacttggagtggagtgggacaactcaacccgtggtggtggcgaggaccaaccgtacgcgacggaagttccgaggacagagtcaccatcgaccgagggaccncggtccgacgaagtacgagttctagtttgggaattggaaggtagaggtgaagtactcgtagaccgacgacggtaccttaagttttacttagtgtaggcgggtaggggtaggggggggttcggggtcgcggtacggtaccggtacccggccccggttggtacggtaacgttacgggtcgggggaccctaacggggtaacccgttccggg

SEQ ID NO: 210016 - DNA, 531 bp, Homo sapiens
  misc_feature: GYAE6OF01CGYO6.41.64.F09.1.454.CMB.1.raw
  modified_base (228)..(228): a, c, t, g, unknown or other
  misc_feature (228)..(228): n is a, c, g, or t
  modified_base (360)..(360): a, c, t, g, unknown or other
  misc_feature (360)..(360): n is a, c, g, or t
  modified_base (425)..(425): a, c, t, g, unknown or other
  misc_feature (425)..(425): n is a, c, g, or t
  modified_base (461)..(461): a, c, t, g, unknown or other
  misc_feature (461)..(461): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtggagaagcctaggggctcagtgaaattcngccaggcatctggatacaccttcatgacctatatatccactgggtgcgacaggcccctggacgagacttggagtggagtggacaactcaaccgtggtggtgcaggacaacctacgcgacggatccagacagngtacaccgatacgaccgaggacaccgtcgacgagtacagtctagttgaattgagagagtgagatntgacgacgacggctattacttatggtagcggagggnggggggtgggtcgcgtagacgtaccggccccgtgtacgtacttacggtagggccgagggtacccgtcggg

SEQ ID NO: 210017 - DNA, 586 bp, Homo sapiens
  misc_feature: GYAE6OF01BDVQW.41.64.F09.1.454.CMB.1.raw
  modified_base (378)..(378): a, c, t, g, unknown or other
  misc_feature (378)..(378): n is a, c, g, or t
  modified_base (555)..(555): a, c, t, g, unknown or other
  misc_feature (555)..(555): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagccgtggggcctcagtgaaaatttcctgccaggcatctggatacaccttcatgacctatatatccactgggtgcgacacggccctggacgaggacttgagtggatgggacaactcaaccgtggtggtggacaggaaccaacgtacgcgacggaagtccgagacagagtcacancgaccgagggacacgtccgacgagtacagtcttattaggaattgaaggtgagtcgagtactcgtaggaaccgtacgacggtacttaagttttatcgttaggacgtacggaggggtagggggggtcgggtaccgcgttacggtaccgtcccgggcccgtttggacgtacgtttacggngggggtacccgtaacggggtacccgttcggg

SEQ ID NO: 210018 - DNA, 539 bp, Homo sapiens
  misc_feature: GYAE6OF01AQ3YW.41.64.F09.1.454.CMB.1.raw
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (481)..(481): a, c, t, g, unknown or other
  misc_feature (481)..(481): n is a, c, g, or t
  modified_base (515)..(515): a, c, t, g, unknown or other
  misc_feature (515)..(515): n is a, c, g, or t
tcagtctatactatcacgaccggtgctcgatttagcgcgtatacaagggggcagtcatccaacaaccacatcccttctctacagaagcctctgagaggaaagttcttcaccatggactggacctggagggtcttctgcttgctggctgtagctccaggtgctcactcccaggtgcagttggtgcagtctgggctgaggtgaagagcctggggcctcagtgaaaatttcctgccaggcatctggatacaccttcatgacctactatatccactgggtgcgacaggcccctggacgaggacttgagtggatgggacaactcaaccctggtggtggcaggacaacctacgcacggaagttccaggacagagtcaccatcgaccagggaccacgtcgcgagtacagtctattggaattggaggagagtganatcgngacgacacggcctatttatagttgtgcggaggagggggggttgggtcgngttggacgtacggccccgtgtacgtacgttacgnggggacctaggggaacccgtcggg

SEQ ID NO: 210019 - DNA, 696 bp, Homo sapiens
  misc_feature: GYAE6OF01BO1ZY.41.64.F09.1.454.CMB.1.raw
  modified_base (423)..(423): a, c, t, g, unknown or other
  misc_feature (423)..(423): n is a, c, g, or t
  modified_base (534)..(534): a, c, t, g, unknown or other
  misc_feature (534)..(534): n is a, c, g, or t
tcagtctatactatcacgaccggtgctcgatttagcgcgtatacaagggggcatcatccaacaaccacatcccttctctacagaagcctctgagaggaaagttcttaaccactggacgtggaccgtcggaggggtcgtttccttgcttgtcgtggcgtgtagctccacggtggctcacctcccacggtgcagttggttgcagtcgtgggcgtgaggtagaagaagccgtgggccgtcagtagtaaaatttccttcgccaggcatctgatacaccttcatgtacctactatactccacgtgggtgccgaccgacggccccgtggacgacggtacttggaggtggagtacgggaccaactacctacccgtaggtggtcggcacggaaccacctacgcgaacgagttccaggacagacgtcaccanagacgacggagtacccgtccgaggacgtacagttacttaagtttggaaagttggaaggagtagttaggatatcgtaggaaccgaccgaaccggtacttatttttaacgttnttgggtacggaggggtaacggggggtggggggggtttacggggtcccgttacgtacgggtacccgttaaccccgggttcccccgtagggtttacggtaacggtttttaccgggaccggggggaacccgtaaccggggttaaacccccggttgggtaccccgg

SEQ ID NO: 210020 - DNA, 527 bp, Homo sapiens
  misc_feature: GYAE6OF01AEJZE.41.64.F09.1.454.CMB.1.raw
  modified_base (514)..(514): a, c, t, g, unknown or other
  misc_feature (514)..(514): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacaactcaaccctggtggtggcaggacaacctacgcacggaagttccaggacagagtcaccatgaccagggacacgtccgcgagtacagtctattggaattgaggagagtgagatctgacgacacggtcctatttatattgtgcggaggagggggggtggggtcgcgtgacgtcgccccgtgtcgtagttacgtggggccngggacccgtcggg

SEQ ID NO: 210021 - DNA, 730 bp, Homo sapiens
  misc_feature: GYAE6OF01DUUA3.41.64.F09.1.454.CMB.1.raw
tcagtctatactatcacgaccggtgctcgatttagcgcgtatacaagggggcgtagtcatccaacaaccacatcccttctctacagaagcctctgagaggaaagttcttcaccatggactggacctggagggtacttctgcttgctggctgtagctccgaggtgctcactcccaggtgcagttggtgcagtcgtgggctgaggtgaacgacgccgtggggcctcgagtagtaaaactttccgtgccgaggcagtcgtaggactacctaccttcatcgacctacttatactccacgtgggtcgacgacgacggccccgtagggacgacggtacttggaggtggagtagggaccaacgtccaaccggtggtgggtcggacgaaggaccaaaccgtacgacgaacggtaacgttccgaaggacgagacgtccaaccgagtacgaccgagggaccgaccggtaccgacgacgtacgtacgttatttacgttaggaagtttcggaaggtaggtaggtaggaagtacgttcggtacgaaccggaccgtaccgggtacctttaatttttagttaacgtttgggtacgggtaccggggtaagggggtaacggggggggggttcggggttacccggtcgggtacggttaacccggtacccgggttccccgggttaggtacggttacggtttaccgggaccgggggtaccccggtaaggggtacccccggtttaccgggg

SEQ ID NO: 210022 - DNA, 607 bp, Homo sapiens
  misc_feature: GYAE6OF01D1CK1.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaaatttcctgccaggcatctggatacaccttcatgacctactatactccactgggtgcgacgacggccccgtggacgaggacttggagtggagtagggacaactccaaccgtggtggtggcaggaacaacctacgcgaacggaacgttccgaaggacagacgtacaccatcgaaccgagggaccaccgtccgacgaagtacgagtcttaagtttggaattggaaggagtaggtgaagtatcgtacgaccgaacgaccggtaccttaattttattagttggtacggacggagggggtagggggggtgggggtcgcggttggaacgttcccgggccccgttggtcgtacgtttacggcggggaccgtacggggtaaccccgtcggg

SEQ ID NO: 210023 - DNA, 599 bp, Homo sapiens
  misc_feature: GYAE6OF01AZFYY.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacacggccccgtggacgaggacttgaggtggatgggacaactcaaccgtggtggtggcaggaccaaccgtacgacgacggaagttccaggacagagcaccagtacgaccgacgggaccacgtccgacgtagtacagtcttaagtttaggtaagttggaggtagtaggtgagtatcgtacgaacgacgacggtacttaatttattagtggtgacgggtaggggtgggggggtggggtcgtcggtagtaccggtcccggtccccggtggttacggtacggttaccggtccggggtacccgtaacggggtacccgttccggg

SEQ ID NO: 210024 - DNA, 676 bp, Homo sapiens
  misc_feature: GYAE6OF01C7A8D.41.64.F09.1.454.CMB.1.raw
  modified_base (258)..(258): a, c, t, g, unknown or other
  misc_feature (258)..(258): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctggaggtgaagaagccgtggggcctcagtagaaatttcctgccgaggcatctggatacaccttnatgacctactatactccagtgggtgcgacacggcccctagggacgaggacgttggagtggagtcgggacaactcgtaacccgtgggtggtcggcaaggacctaaaccgtacggaccgaacggtaacgttccgaaggtacgagacggtaccaacgacgtacgaacccgagggaccaccggtccggacgacgtacctagtacttagttaggtaattagggaggagacggtagagtagtcgtaggaaccgacgacggtacttaagtttatttacgttggtacgcggggtaaggggtagggggggggttcggggccggtcggtacgggtaacccggttcccgggtccccggttagggttacggttaacggttaccggggttaccgggggacccggtaaccggggtacccccggttaccgggg

SEQ ID NO: 210025 - DNA, 611 bp, Homo sapiens
  misc_feature: GYAE6OF01CZ0KN.41.64.F09.1.454.CMB.1.raw
tcagtctatactatcacgaccggtgctcgatttagcgcgtatacaaggggcatcatccaacaaccacatcccttctctacagaagcctctgagaggaaagttcttcaccatggactggacctggagggtcttctgcttgctggctgtagctccaggtgctcactcccaggtgcagttggtgcagtcgtgggctgaggtgaagaagccgtggggcctcagtagtaaaatttcctgccaggcatctggatacaccttcatcgacctactatactccactggtgcgacgacggcccctggacgaggtacttggagtggatagggacaacgtcaaccgtggtcggtggcacggacaacctacgacgaacggaagttccgaggacagagtcacatacgaccgagggacaccggtcgacgacgtacacgtacgtagtttagattagaggagaggtagagtacgtcgtaggaaccgacgaacggtcctaatttattagttacgtggacggtagggggtacggggggtggggtccggtcgtacggaccgtaccgggtccccgttaggttacggtacgttacgggtacggggtacccgaacggggtaacccgttccgggg

SEQ ID NO: 210026 - DNA, 528 bp, Homo sapiens
  misc_feature: GYAE6OF01DG1DQ.41.64.F09.1.454.CMB.1.raw
  modified_base (395)..(395): a, c, t, g, unknown or other
  misc_feature (395)..(395): n is a, c, g, or t
  modified_base (429)..(429): a, c, t, g, unknown or other
  misc_feature (429)..(429): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
  modified_base (507)..(507): a, c, t, g, unknown or other
  misc_feature (507)..(507): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctggaggtgaagaagcctggggcctcagtgaaaatttcctgccaggcatctggatacaccttcatgacctactatatccactgggtgcgacaggcccctggacgaggacttgagtggatgggacaacgtcaaccgtggtaggtggcaggacaacctacgcacggaacgtccaggacagagtcacatgaccagggacacgtcgngagtacagtctattggattggaggagagtgagancgtgacgacacggctatttatattgngngaggaggggggtgggcgcgtgaccgtcggccccgtgacgtacgttacggnggggcctagggacccgtcggg

SEQ ID NO: 210027 - DNA, 623 bp, Homo sapiens
  misc_feature: GYAE6OF01EFHEG.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctggaggtgaagaagcctggggcctcagtgaaaatttcctgccaggcatctggatacaccttcatgacctactatatccactgggtgcgacacggcccctggacgaggacttggggagtggatgggacaactcaacccgtggtggtggcgagacaacctacgcgacggaacgtccgaggacagacgtccacatcgaccgagggacacgtccgacgagtacagttactagttaggaattggaggagagtagatagtcgtgaccgacgacgggtaccttaagtttattagttggtcggacgggtaagggggtagggggggggtcggggttccggaccgttacgggtaacccgttacccgggtcccccggttagggtacggttacgtttacgggtaccgggggtacccgtaaccggggtaaccccggttccggg

SEQ ID NO: 210028 - DNA, 551 bp, Homo sapiens
  misc_feature: GYAE6OF01AYEH9.41.64.F09.1.454.CMB.1.raw
  modified_base (432)..(432): a, c, t, g, unknown or other
  misc_feature (432)..(432): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacaactcaacctggtggtggcaggacactacgcacggagttcaggacagagtcaccatcgaccagggacacgtccgcgagtacaggtctagtttggaatttggaggtagagtgagagtntgacggacacggcctatttatagttgtgcggagggtagggggggtggggtccgcggttggacgtccggccccgttggtcggtagttacggacgggggccgtaggggtaacccgttcggg

SEQ ID NO: 210029 - DNA, 543 bp, Homo sapiens
  misc_feature: GYAE6OF01BPZRV.41.64.F09.1.454.CMB.1.raw
  modified_base (430)..(430): a, c, t, g, unknown or other
  misc_feature (430)..(430): n is a, c, g, or t
  modified_base (474)..(474): a, c, t, g, unknown or other
  misc_feature (474)..(474): n is a, c, g, or t
  modified_base (517)..(517): a, c, t, g, unknown or other
  misc_feature (517)..(517): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgataggcccctggacgaggacttgagtggatgggacaactcaaccctggtggtggcaggacaacctacgcacggaagttccaggacagagtcaccatacgaccagggacacggtccgcgagtacagtctatttggaattgaggagagtganatctaaacgacacggtcctaattttattattggtgcggtagggngggggggttggggcgcgtggactcggccccgtgtgattacggnggggacccaggggaccctgggtaccc

SEQ ID NO: 210030 - DNA, 578 bp, Homo sapiens
  misc_feature: GYAE6OF01EUX4Y.41.64.F09.1.454.CMB.1.raw
  modified_base (435)..(435): a, c, t, g, unknown or other
  misc_feature (435)..(435): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacacggcccctggacggaggaccgttgagtggatgggacaactcaacccgtggtggtggcaggacaactacgcgacggtaagtcgaggacagagtcacatgaccgagggaccacgtccgagagtacagtctagttggaagtgaggagagtgacgntacgtgaacgacgacggacctagttttattagttgcgacgggtagggtaggggggggtggggtcgtcggtacgaccgttaccggcccccggttagtcggttaacgttaccggagggggcccgaaacgggggacccttaccggg

SEQ ID NO: 210031 - DNA, 581 bp, Homo sapiens
  misc_feature: GYAE6OF01DDNQA.41.64.F09.1.454.CMB.1.raw
  modified_base (233)..(233): a, c, t, g, unknown or other
  misc_feature (233)..(233): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctgaggtgaagaagccgtggggcctcagtagaaatttccngccaggcatctggatactacttcatgacctactatactccacgtggtgcgacgacggcccctggacgaggacttgaggtggagtgggacaactcaaccgtggtggtggacaggacaaccgtacgacgaacggtaacgtccgaggacagacgtacaccagtacgaccgaaggacctacggcccgagacgtacacgttacttagttaggtaagttaggaggagtagtgagtatcgagaacgacgacggtctaatttacttagtgtaggtcggaggggacggggggtgggtcgacgtcggacgtaccggcccgttgtcgtacgttacggcgggaccgcgggtaccgtccgg

SEQ ID NO: 210032 - DNA, 590 bp, Homo sapiens
  misc_feature: GYAE6OF01AE2TH.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctggaggtgaagaagccgtggggcctcagtagaaatttcctgccaggcatctggatacaccttcatgacctactatactccacgtgggtgcgacgacggccccgtggacgaggacttgaggtggagtgggacaactcgaacccgtggtggtggcgaggaccaaccgtacgacgaacggaacgttccgaaggacagagtcaccagtcgaccgagggacacgtccgcgagtacgacgtacttagttggaagttggaggagaggtgagtatcgtagacgacgacggtcttaagttttattagttgtggacggtaggggtagggggggtgggtcggtcgtggaccgtccggccccggttgtcggtacgttacggtaggggacccgtacgggtacccgtcggg

SEQ ID NO: 210033 - DNA, 573 bp, Homo sapiens
  misc_feature: GYAE6OF01DILGU.41.64.F09.1.454.CMB.1.raw
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
  modified_base (550)..(550): a, c, t, g, unknown or other
  misc_feature (550)..(550): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagccgtggggcctcagtagaaaatttcctgccaggcatctggatacaccttcatgacctactatatccacgtgggtcgccgacacggcccctggacgaggactggagtggatgggacaactccaaccgtggtggtggcgacggacaacctacgacgacggtaacgtccgaggacagacgtacacagtcgaacgagggaccacggtccgacgacgtacaagttctagtttggaagttggaaggaggagtagagatcgtagaccgacgacggcttaatttattagttgngcggagggnggggggtgggtcgcgtggaccgtccggcccgttggtacgtacgttacggnggggacccgagggtcccgtcggg

SEQ ID NO: 210034 - DNA, 603 bp, Homo sapiens
  misc_feature: GYAE6OF01C4XTG.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagccgtggggcctcagtagtaaaatttcctgccaggcatcgtggatacaccttcatgacctactatactccagtgggtgcgacgacggcccctaggacgaggacttgaggtggagtgggacaactcgaaccgtggtggtgcgacggacaaccgtacgcgaacggtaacgtccgaaggacagacgtcaaccatcgaccagggacacgtccgacgagtacagtcttagttggaatgaaggagagtggagatgtacgacgacgacggtcctaatttagttagttggtaggcgggtaggggaggggggggttcggggtcgtcggtaggaacccgttccggtcccccggtggttacggtaacgttaccgggtagggggaccccgacggggtaacccgtccgggg

SEQ ID NO: 210035 - DNA, 533 bp, Homo sapiens
  misc_feature: GYAE6OF01ERBDS.41.64.F09.1.454.CMB.1.raw
  modified_base (435)..(435): a, c, t, g, unknown or other
  misc_feature (435)..(435): n is a, c, g, or t
  modified_base (511)..(511): a, c, t, g, unknown or other
  misc_feature (511)..(511): n is a, c, g, or t
tcagtctatactatcacgaccggtgctcgatttagcgcgtatacaagggggcatcatccaacaaccacatcccttctctacagaagcctctgagagaaagttcttcaccatggactggacctggagggtcttctgcttgctggctgtagctccaggtgctcactcccaggtgcagttggtgcagtctgggctgaggtgaagaagcctggggcctcagtgaaaatttcctgccaggcatctggatacaccttcatgacctactatactccacgtgggtcgcgacacggcccctggacgaggacttgagtggatgggacaactcaacccgtggtggtggcaggacaaccgtacgcgacggaagtccaggacagagtcaccatcgaccgagggacacggtccgacgagtacagtctagttgaattggagagagtgagntcagacgacacgctatttatatgagtcgagggtgggggtggtcgcgtagacctccggcccgtgtcgtacgtacggngggccctaagggtccctacggg

SEQ ID NO: 210036 - DNA, 606 bp, Homo sapiens
  misc_feature: GYAE6OF01CD1JN.41.64.F09.1.454.CMB.1.raw
  modified_base (535)..(535): a, c, t, g, unknown or other
  misc_feature (535)..(535): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacaactcaacccctggtggtggcgacggacaacctacgcacggaacgttccgaggtacaggacgtccacctatacggaccgacgggaaccaccggtccgaccggaaggtaaccaggttcctaagttttgggaatttggaacggagtaggtgagatcgtagacgacgacggtacctatttacgttagttgtggcggtaggggcggggggggtggggtaccggnggttacggacgttcccggtcccggtgtcggtacgttacggtacggggccgtaaggggtaccccgttacggg

SEQ ID NO: 210037 - DNA, 666 bp, Homo sapiens
  misc_feature: GYAE6OF01D3S1I.41.64.F09.1.454.CMB.1.raw
  modified_base (350)..(350): a, c, t, g, unknown or other
  misc_feature (350)..(350): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgctagttggtgcagtcgtgggctgaggtgaagagccgtgggcctacagtagtaaaatttcctgccaggcatctggactaccaccttcatcgacctacttatactccacgtgggtgccgacgacggccccgtgggacgaggacttggagtggatgggaacaactccaaccgtgggtggnggcgaggacctaacctacgacgaacggtaacgttccgaaggacgagacgtccaacgatacggaccgaacggaccaacggtcccgacggtaacgtacgtagtcttaagttaggtaagttggaaggtacgaggtacgaagtacgtacgtaggaaccgaaccgacggtaccttaagttttagttaagttcggtacggtcgggtagggggtaggggggggttcggggttacggtcgtacgggaccggttcccggtaccccggttggtacggtacgtttaaccgggccggggtacccggtaacggggtaccccgttacggg

SEQ ID NO: 210038 - DNA, 683 bp, Homo sapiens
  misc_feature: GYAE6OF01CEHB7.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctggaggtgaagaagccgtggggcctcgagtagtaaaatttcctgccaggcatctggatacaccttcatcgacctactatactccacgtgggtcgccgacgacggccccgtagggacgaggtacgttggaggtggagtcgggaaccaactccgaacccgtgggtggtcggcgaacggaaccaaccgtacgacgaacggtaacgttccgaaggacacggagtaccaccgtagtacggaacccgaagggacccgtaccggtcccggacggtaacgtaacgtacgttacgttaaggtttaggaaagttggaacgggtaggtaggtaggaagtacgttacgacggaaccgtaccgaccgggttacttaagtttttacttacgttggtcggtacggggtagggggtaggggggggttcggggtacgtcggtggacccggtccggtcccggtgtacggtacgttacgggcggggacccgtacgggtcccgtccggg

SEQ ID NO: 210039 - DNA, 619 bp, Homo sapiens
  misc_feature: GYAE6OF01EXW9V.41.64.F09.1.454.CMB.1.raw
  modified_base (276)..(276): a, c, t, g, unknown or other
  misc_feature (276)..(276): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctgggctgaggtgaagagcctggggcctcagtgaaaatttcctgccaggcatctggatacaccttcatgacctactatatccactgggtncgacacggcccctggacggaggacttggagtggatgggacaactcaaccgtggtggtggcgagacaccgtacgcacggagttcgaggacagacgtcaccatcgaccgagggacacgtccgacgagtacagttctagttggattgaggagagtgagatcgtagaccgacgtacggaccttaagttttaattagttacggtcggacgggtaagggggtacggggggggggttagggggtccgggtcggttacggtacccggttacccgggacccccggttagggtacgtaaccggtttaccggaggggggtaccccgtaacgggggtaaacccccgttacggggg

SEQ ID NO: 210040 - DNA, 837 bp, Homo sapiens
  misc_feature: GYAE6OF01DUKBY.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtgggctggaggtgaagaagccgtggggcctcagtagtaaaatttcctcgccgaggcatcgtaggtactacctaccttacacgtacgtaaccttactactactcccacgttgggtcgacggtaccgacggtccccgtaggaccgacggtacgttaggaggttaggaggtacgggaacctaaaccgtacccgtaaccccggttgggtacgggttacggaccgaacggaaccctaaacccggtaccggaccggaacgggtaacgttacccgaagggtaccgacggtacgtacccgaacctagtacggaacccgtacgggactacccgggtaccgacggtaaacgtaccgtaacggtttaccgtttaaggtttacgggaaagttttacggggaacgggttaggaacggttaggaaggtacgttacggtacggaacccggtaaccggacccgttaaccgtttaagtttttacgtttaaggtttacggtcggggtaacgggggtaggggggttacggggggggttaccggggttacgggtacccgttacgggtaccccggttaacccgggtccccgggtttaggtaccgggttacggtttaccggggacccggggttaccccgggtaacccggggttaacccggttaccccgggg

SEQ ID NO: 210041 - DNA, 713 bp, Homo sapiens
  misc_feature: GYAE6OF01CSNJA.41.64.F09.1.454.CMB.1.raw
  modified_base (235)..(235): a, c, t, g, unknown or other
  misc_feature (235)..(235): n is a, c, g, or t
tcagtctatactatcacgaccggtgctcgatttagcgcgtatacaagggggcatcatccaacaaccacatcccttctctacagaagcctctgagaggaagttcttcaccatggactggacctggagggtcttctgcttgctggctgtagctccaggtgctcactcccaggtgcagttggtgcagtcgtggggctggaggtgaagagccgtggggcctcgagtagtaaactttccngccgaggcatctaggactacaccttcatgaacctactatactccacgtggtcgcgacgacggccccgtaggacggaggtacttggacggttggagtacgggaacctaactccgaacccggttgggtgggtacggacgaacggaaccgtaacccgtacggaccgaacggtacgttaccgaaggtacgaggacgtacctaacagtacgaaccggaacgggaccgtaccgggtaccgacggtaacgtacgtaacggttaccgttaggttttacgggtaagtttagggaagggtaggaaggttaggtaagtagttcgtacgaacccggtaacgtaacccggtacttaagttttagttagttaggtcggtacgggtagggggtcgggggggttcgggtacggtcgttacggaccgttccgggccccggttaggtacgtacggtttacgggaccggggtaccgacggggtaccccgttccgggg

SEQ ID NO: 210042 - DNA, 663 bp, Homo sapiens
  misc_feature: GYAE6OF01DJJR2.41.64.F09.1.454.CMB.1.raw
  modified_base (263)..(263): a, c, t, g, unknown or other
  misc_feature (263)..(263): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctggaggtgaagaagccgtggggcctcagtgtaaaatttcctgccaggcatcgtggaatacctaccttanatcgtaaccctactatactccacgtggggtcgccggacacggccccgtaggaacggaggtacttggaggtggagtcgggaacaaactccaacccgtgggtggtcggacgaacggaaccaaacccgtacggacgtaaccgggtaacgttcccgaagggacgaggacgtacaccagtacggaaccgaacgggaccgaccggtccgacggaagtaccgtagttacgttagtttaggaagtttgggaaggagtaaggtgagtagtcgtagaccgaacgacgtcttaatttacttagttgtacgggaggtagggggagggggggttgggtcgacggtacggtaccggtccggtccccgggttgtacgttaggttaccgggtgggacccgtacgggtacccgtcgg

SEQ ID NO: 210043 - DNA, 554 bp, Homo sapiens
  misc_feature: GYAE6OF01B83VQ.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatactccactgggtgcgacacggcccctggacgaggacttggagtggatggacaactcaacctggtgtggcaggacaacctacgcacggaagtccaggacagagtcacatacgaccgagggaccacggtccgacgacgtaacgagtacttagtttaggaattggaggagaggtagagtatactaacgaacgacgcctatttattattgtgacggtagggaggggggtgggtcgcgtgacgtcggccccgtgtagacgttacgcgggaccgacgggtaccctgggtacccg

SEQ ID NO: 210044 - DNA, 626 bp, Homo sapiens
  misc_feature: GYAE6OF01DIOKO.41.64.F09.1.454.CMB.1.raw
  modified_base (249)..(249): a, c, t, g, unknown or other
  misc_feature (249)..(249): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacnccttcatgacctactatactccactgggtgcgacacggcccctggacgaggacttggagtggatgggacaactcaacccgtggtggtggcaggacaacctacgcaacggaagttccaggacagagtcacatgaccgagggaccacgtcgcgagtacagtctatttggaattgaggagtagtgagtagtcgtagacgtaccgaaccggtccttaagttttagttacgtttggtacggtaccgggtaagggggtacgggggggggttcggggggtacggtcgggttaggtaacccggttacccgggacccccggttagggttacggtacggtttaacggtggggggtaccccggtaaggggtaacccccgttccggggg

SEQ ID NO: 210045 - DNA, 784 bp, Homo sapiens
  misc_feature: GYAE6OF01C5TDQ.41.64.F09.1.454.CMB.1.raw
  modified_base (176)..(176): a, c, t, g, unknown or other
  misc_feature (176)..(176): n is a, c, g, or t
  modified_base (178)..(178): a, c, t, g, unknown or other
  misc_feature (178)..(178): n is a, c, g, or t
tcagtctatactatcacgaccggtgctcgatttagcgcgtatacaagggggcgagtcatccaacaaccacatcccttctctacagaagcctctgagaggaaagttcttcaccatcggactcggacctggagggtcttctgcttgctggctgtagctccaggtgctcactccaggtncngttgtgctagtcgtgggctgaggtgagacgcgtgggcctcgagtagtaaactttccagaccgtaggtcctagttcgttacggacttaacctaccgtttacaacgtacggtaacctaacgttaactaccgtaccgacgttgggtcaccgacgtaacggtccccgtaagggaccgtaacggtacgtttaggagttacggaacggtccgggaacctaaccgtaccgtaaaccggttgggtcgtacggaccgtaaggaaccctaacggtacggacggtaaacggtaacgttacccgaaggactaacggtacccgtactaaacccgtagtaccggaaccggtaacggaacccgtaccgggttaccgggaccgtaacggtaacccgtaggtttaacttaaggtttagggtaaccgtttagggagtaaggttaccggttaagtaagtcctttacgggacgtaaccggttaccggaacggttaccgttaagttttacgtacgggttaggtaaccggtggggtaaacggggtcgggggggttaacgccgtacgtacgggtaacccgtcccggccgttagtcgtaacgttacggcggtacgaaccgggtccgtacg

SEQ ID NO: 210046 - DNA, 561 bp, Homo sapiens
  misc_feature: GYAE6OF01DE15J.41.64.F09.1.454.CMB.1.raw
  modified_base (435)..(435): a, c, t, g, unknown or other
  misc_feature (435)..(435): n is a, c, g, or t
  modified_base (539)..(539): a, c, t, g, unknown or other
  misc_feature (539)..(539): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctgaggtgaagaagcctggggcctcagtgaaaatttcctgccaggcatctggatacaccttcatgacctactatatccactggtgcgacacggcccctggacgaggacttggagtggatgggacaactcaacccgtggtggtggcgaggaccaaccgtacgcgacggaacgttccaggacagacgtcaccatgaccgagggacacgtccgacgagtacagtctagtttaggaattggagganaggtgagatcgtagacgaccgacggtcctatttattagtgtggacggtagggagggggggtgggtcggcgtggaccgtaccggccccgtggtcgtagttacggnggggaccacgggacccgtcggg

SEQ ID NO: 210047 - DNA, 570 bp, Homo sapiens
  misc_feature: GYAE6OF01EO89B.41.64.F09.1.454.CMB.1.raw
  modified_base (279)..(279): a, c, t, g, unknown or other
  misc_feature (279)..(279): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacacccttcatgacctactatatccactgggtncgacaggcccctggacgaggacttgagtggatgggacaactcaacccgtggtggtgcaggacaacgtacgcacggaacgttccaggacagagtcacatcgacagggaccacgtccgcgagtacagttctagtttaggaattggaggagagtgagatacgaacgacaccggtactattttatagttagtggcgtaggggagggggggtggggtacgcgtcggaccgttaccggccccgttaggtcggtacttacgggacggggtacccgaggggtaacccctgggtaccccg

SEQ ID NO: 210048 - DNA, 592 bp, Homo sapiens
  misc_feature: GYAE6OF01B9HIP.41.64.F09.1.454.CMB.1.raw
  modified_base (235)..(235): a, c, t, g, unknown or other
  misc_feature (235)..(235): n is a, c, g, or t
  modified_base (337)..(337): a, c, t, g, unknown or other
  misc_feature (337)..(337): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactccaggtgcagttggtgcagtcgtggggctggaggtgaagaagccgtggggcctcagtagtaaaatttccngccgaggcatctggatacaccttcatcgaccttactatactccacgtggtgcgacacggccctggacgagtacttggagtgagtggacaactcaaccgtggnggtgacgagacaacctacgacacggaactccgaaggacagacgtacaccgatacgaccgaggacacgtccgagacgtacagttactagttaggaagttgaggtagagtagagatcgtagaacgacgacggtacctatttatacgttaggcgtacgggtaggggtagggggggtcgggtacggtcgtacggacgtcccggtccccgttggtacggtacgttacgggacgggtaccgaacgggtacccgttaccggg

SEQ ID NO: 210049 - DNA, 767 bp, Homo sapiens
  misc_feature: GYAE6OF01AZNBS.41.64.F09.1.454.CMB.1.raw
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccgaggtgcagttcggtgcagtctgggctgaggtgaagaagctggggcctcagtgaaacttcctgccaggcatcgtggatacaccttcatgacctactagtatccagtgggtncgacncggcccgtggacgaggacttggagtggagtgggaacctaactccgaaccgtgggtaggtcggacgacgggaacctaacccgtacggaccgtaacgggtaacggttcccgaaggggtaacacggtaacggttacccaacccgtaggtacggtaaccccggaaggggtaaccctaacccgggtccccggtacgggtaaaccgtaccgtaacgggtttacctttaaggttttacgggtaaacgtttagggaacggggtaagtaaggttaggacgtaacgtcgttacggtaaccggaccgtaacccgggttacccgttaaatttttaacgtttaagttcgggttacgggtaccggggtaagggggtaggggggggggttacggggtccggtccgttacgggtacccgtacccgggtccccgggttgtacgggttaacggtttaccgggagggggtacccgtaaacgggggttaccccgttaccgggg

SEQ ID NO: 210050 - DNA, 612 bp, Homo sapiens
  misc_feature: GYAE6OF01A51WN.41.64.F09.1.454.CMB.1.raw
  modified_base (455)..(455): a, c, t, g, unknown or other
  misc_feature (455)..(455): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatcgacctatatactccactggggtgcgacacggcccctggacgaggacttggagtggatcgggacactccaacccgtggtggtggcaggaccaaccgtacgcgaacggaacgttccgaggacagagtcaccatcgaccgagggaccacggtccgacgtagtacagtacttagttaggaattgaggagagtagagtatcgngaaccgacgaccggtacctaagttttacttagtcggtaggacgggaagggggtacggggggggtgggggttaccgtcggttacggacccggttaccggccccggttggtacgtacgtttacgggtacggggaccctacgggggtaccccgtaccggg

SEQ ID NO: 210051 - DNA, 645 bp, Homo sapiens
  misc_feature: GYAE6OF01DHM8A.41.64.F09.1.454.CMB.1.raw
  modified_base (235)..(235): a, c, t, g, unknown or other
  misc_feature (235)..(235): n is a, c, g, or t
  modified_base (616)..(616): a, c, t, g, unknown or other
  misc_feature (616)..(616): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctggaggtgaagaagccgtggggcctcagtagaaaatttccngccaggcatctggatacaccttcatgacctactatactcctacgtgggtcgcgaacacggccccgtggaacgaggacttgagtggatagggacaacgtaccaaccgtggtggtcggacgaaggaacaacccgtacgacgaacggtaaacgttccgaaggacaggacgtacaaccagacggaccgagggtacaccggtaccgcgaagtacgtagtacttagtttagaagttggaaggagagttggaagtacgttacgtggaaaccgtacgaaccgggtaccttaattttagtttacgtggttacgggacgggtaggggggaggggggtcggggtacgcgttagacccggtacggtccccgttggtacgtaacgtttacgggngggtacccggaaagggtaaccccgtcggg

SEQ ID NO: 210052 - DNA, 678 bp, Homo sapiens
  misc_feature: GYAE6OF01BO0Q5.41.64.F09.1.454.CMB.1.raw
  modified_base (584)..(584): a, c, t, g, unknown or other
  misc_feature (584)..(584): n is a, c, g, or t
tcagtctatactatcacgaccggtgctcgatttagcgcgtatacaagggggcatcatccaacaaccacatcccttctctacagaagcctctgagagaaagttcttcaccatggactggacctggagggtcttctgcttgctggctgtagctccaggtgctcactcccaggtgcagttggtgcagtcgtggggctgaggtgaagaagccgtggggcctcagtagtaaaactttcctgccaggcatcgtgatacaccttcatcgacctactatactccgacgtggtgcgacgaccggtccccgtaggacggaggtacgttggagtggagtcgggaacaacgtaccctaaccgtgggtcggtcggacgaacggaacctaacccgtaccgacgaacggtacgttaccgaggacgagacgtaccaccgagtacgaccgaagggaccaccggtccgacggtacgtacgtacgttacttagttaggtaagttggaagaggtagtagagtactcgagaaccgacgtacggtacttattttaagtttacgtggtacgggacgggtagggggtgggggggggttacgggtccgnggttaccggaaccccggttaccccgggtcccggttaggttaccggtacgtttacggggtaccgggggacccgtaccggggtaacccgttccggg

SEQ ID NO: 210053 - DNA, 616 bp, Homo sapiens
  misc_feature: GYAE6OF01AY6JQ.41.64.F09.1.454.CMB.1.raw
  modified_base (403)..(403): a, c, t, g, unknown or other
  misc_feature (403)..(403): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggctcagtgaaaatttcctgccaggcatctggatacacctttcatgacctactatactccactgggtgcgacacggcccctggacgaggacttgagtggatgggacaactcaacctggtggtggcaggacaactacgcacggaattcgaggacagagtcacgatcgaccgagggacaccggtcgcgagtacngttactagtttggaattggaaggtagaggtgaagattcgtagaaccgacgaccgggtaccttaattttaagttagttggtacggtacgggtaaggggtaggggggggggttcgggggtaccgtcggttaggaacccggttaccgggcccccggttaggttcggtaacgtttacgggtcggggggtaccccaagggggtaacccccgttcgggg

SEQ ID NO: 210054 - DNA, 607 bp, Homo sapiens
  misc_feature: GYAE6OF01E0ZQH.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaagcatctggatacaccttcatgacctactatatccacgtgggtgcgacacgggcccctggacgaggacgttgagtggatgggacaactcaaccctgggtggtggcgaggacaacccgtacgcacggaacgttccgaggacgagagtacaccgagtcgaaccgagggacacgtaccgcggacgtacgtagtctaagtttgggaacttggaggagagtgagtatcgtagacgaccgacggccttaattttatagttgtagggcggtaggggtacgggggggttgggtaccggtcgtagggacggttacccggccccggttaggtacggtacgttacgggtcggggacccggtacggggtaaccccgttacgggg

SEQ ID NO: 210055 - DNA, 676 bp, Homo sapiens
  misc_feature: GYAE6OF01A1JAI.41.64.F09.1.454.CMB.1.raw
  modified_base (279)..(279): a, c, t, g, unknown or other
  misc_feature (279)..(279): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatcgacctactatatccactgggtncgacacggcccctggacgaggacttggagtggatgggacaacgtcaacccgtggtggtggacaggaacaaccgtacgcacggaacgttaccgaggtacaggacgtacacgatacggaccaagggaccacggtccgcgaagtacctagtccgttaatttagggaatttggaacggtagtaggtgagtagtcgtaggtaaccgacgaaccggtccttaattttaagttacgtttagggacggtaccgggtaagggggtacgggggggggtcgggggggtttaccgcgggttacgggacccggttaacccgggtcccccggttagggttaccggtaaacgggtttaacccggtcggggggaaccccgttaaccggggggtaaacccccgtttaccggggg

SEQ ID NO: 210056 - DNA, 688 bp, Homo sapiens
  misc_feature: GYAE6OF01C03LK.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctggaggtgaagaaggccgtcggggcctcagtagaaaatttcctcgccaggcccatctggatacctaccttcatgaccctatatactccacgtgggtcgcgacgacggcccctaggacggaggacttggaggtggagtacgggaccaactaccgaacccggtgggtacggtggcgacggaaccaacccgtacgaccgaacgggtaacgttccgaaggtaccgacggtaacgtccaaccgacgtccggaaaccgtacgggggaccctaaccggtccccggtacggaacgttaaccgtaggttaccgttagttttaggggaactttgggaagggagaggttagagtactacgtagacggtacgacgggttcctagttttactaggttgtaggtaccggaaggggggtgggggggtcgggttcgcgttaggaccgtcccggcccggttggttacgtacggtttaccggcggggtacccggaaggggttcccgtacggg

SEQ ID NO: 210057 - DNA, 584 bp, Homo sapiens
  misc_feature: GYAE6OF01BT9GB.41.64.F09.1.454.CMB.1.raw
  modified_base (529)..(529): a, c, t, g, unknown or other
  misc_feature (529)..(529): n is a, c, g, or t
  modified_base (564)..(564): a, c, t, g, unknown or other
  misc_feature (564)..(564): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctgggctgaggtgaagaagcctggggcctcagtagaaaatttcctgccaggcatctggatacaccttcatcgacctactatatccacgtgggtgcgacacggccctggacggaggtacttggagtggatgggacaactcaaccgtggtggtgcacgacaaccgtacgcgacgacgtcaggacagagtcacatcgaccgaagggcaccggtccgacgtaagtaccagtcttaacgtttggaaagtttaggaaggtaggaggttcgaagtacgttcgtacgaaccggtaaccgacggtctaagtttttatagttgaggtcggagggggtgggggggtacgggttncggttgacgtcccggccgtaggtctacgttcgggngggtccacgggtaccgtcgg

SEQ ID NO: 210058 - DNA, 812 bp, Homo sapiens
  misc_feature: GYAE6OF01CPKE2.41.64.F09.1.454.CMB.1.raw
tcagtctatactatcacgaccggtgctcgatttagcgcgtatacaagggggcgatcatccaacaaccacatcccttctctacagaagcctctgagaggaaagttcttcaccatggactggacctggagggtcttctgcttgctggctgtagctccaggtgctcacctccaggtcgcgtaggttggtgctagtcgtggggctggaggtagaagacgccgtggggcctagaaggttataaaactttccaggtacccgtaggtccagttccgtcggtaactaacctaacctttaagtcgaaccttaactacttacctaccgtacgttcgggcgaccgacgacggtccccgtaggacgacgtcgttgaggtgagtacggaactacgtacccgtaaccggtgggtcggtacgaccgtacggaacctaaccgcggaaccgtacggaacgttcgaacggacgacgtacgtaccacgtacgacaacccggtaacggaccacggtaccgtacgtacgtaacgtacgttacgttaagtttaggtaacgttacgggaaggttaggagttagaagttacgtacggacgtaaccgaaccggtaacgtttaccttaagtttttacgttaagttcgggtaacgggtaacgggggttacgggggggacggggggggtttaccggggtacccggttaacgggttaaccccgggttaacccgggtaaccccggggtttccccgggttagggttaaacccgggttacggtttaacccggggccggggtaaacccggtaacccggggtacccgttccggggtttaacccccg

SEQ ID NO: 210059 - DNA, 707 bp, Homo sapiens
  misc_feature: GYAE6OF01BOJFV.41.64.F09.1.454.CMB.1.raw
  modified_base (428)..(428): a, c, t, g, unknown or other
  misc_feature (428)..(428): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctggaggtgaagaagccgtggggcctcgagtagtaaaatttcctgccgaggcatcgtggatacctaccttcatacgacctactatactccacgtggtgcgacgacggcccgtggacggaggtactggagtggagtcgggaacactaccgaaccgtggtggcggacgacgaaccaaccgtacgacgaacggtacgtaccgaggacgagacgtaccacagtacgaaccgagggaccnccggtaccgacggtaacgtacgtagttcgttaagttcgggtaagttgggaaggtaggtaagtggaagtacgttcggtacgaaccgtaaccgtaaccgggttacctttaagtttttacgtaggtttacggtacgggtacggggtaggggggttcggggggggttcggggtaccggtaccggttacggtaacccggttccccgggtacccggttaggttacggttaacggtttaccgggaccgggggtacccggtaaaccggggtaccccggtttccgggg

SEQ ID NO: 210060 - DNA, 617 bp, Homo sapiens
  misc_feature: GYAE6OF01CUINF.41.64.F09.1.454.CMB.1.raw
  modified_base (300)..(300): a, c, t, g, unknown or other
  misc_feature (300)..(300): n is a, c, g, or t
  modified_base (384)..(384): a, c, t, g, unknown or other
  misc_feature (384)..(384): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctgaggtgaagaagccgtggggcctcagtagaaaatttcctgccaggcatctggatacaccttcatgacctactatactccacgtgggtcgcgacgacggtcccccnggacgaggtactgaggtggagtgggacaactcaaccgtggtggcgcgagaccactacgcgacggactcgagacagagtcacganacggaaccgagggaccaccggtcccgacggaacgtaacgtacgttacgttacgtttagggaagttaggagggagtagtaggagtatcgtagacgaccgaccggtacttagtttattagttggtaggcgggtaagggggtgggggggttcggggtacgtccggttacggacggttacccggccccggttaggcgttaacgttacgggcgggtaccggacgggtacccgttcggg

SEQ ID NO: 210061 - DNA, 587 bp, Homo sapiens
  misc_feature: GYAE6OF01CN0DU.41.64.F09.1.454.CMB.1.raw
  modified_base (254)..(254): a, c, t, g, unknown or other
  misc_feature (254)..(254): n is a, c, g, or t
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttnatgacctatatatccactgggtgcgacacggcccctggacgaggacttgnggtggntgggacaactcaacctgggtggtggcaggaacaaccgtacgacgacggtaacgttccgaaggacaggacgtcaaccagtcgaccgaagggacacgtccgacgacgtacagtactagttaggtaattggaggagtaggtgagatcgtacgacgacgaccggcttatttattagttggtagcgggtaggggtagggggggtggggtcgcgtacggaccgtccgggccccgtggtacggtagtttacggaggggtacccgacggggtacccgttaccggg

SEQ ID NO: 210062 - DNA, 795 bp, Homo sapiens
  misc_feature: GYAE6OF01D4RSM.41.64.F09.1.454.CMB.1.raw
  modified_base (270)..(270): a, c, t, g, unknown or other
  misc_feature (270)..(270): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcctgctggctgtagctccaggtgctcacctcccgaggtgctaggttggtgcagtcgtggggctggaggtgaagacgccgtgggcctcgagtagtaacttccgcgaccgagctactcgtagtactacctaccttnactaccgtaaccttaactaatacctaccgtacggtcgggtacgaccgaccggacccggtcccggtagggacggtacggtacgttaggtaggtaggtacggtacggaacctaaccgtacccgtaaccggttgggtcggtacggacgaacggtaacccgtaaccggtaccggaccggtaacggtaaccgttaccggaacggtaaccgtacggtaccgtacccgaacgtacggtaaccggaaccggtacgggtaacccgtcccgggtaccgagggtaaccgttacgtaacgtttacgtttaaggtttagggtaacgtttaggggaaagggtagtaacggtaggacttagtacggtacgaaaccgtccgtaacccggtttacttttaagttttacgttaggttggacgggtacggggaaggggggggttcggggggtcgggttccctacggtaccgggtacccggttcccggtccggttggtacggttacgtcggggaccggggaccccgtaaacgggtcccgtaccgg

SEQ ID NO: 210063 - DNA, 721 bp, Homo sapiens
  misc_feature: GYAE6OF01DX1EO.41.64.F09.1.454.CMB.1.raw
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
tcagtctatactatcacgaccggtgctcgatttagcgcgtatacaagggggcatcatccaacaaccacatcccttctctacagaagcctctgagaggaaagttcttcaccatgactggacctggagggtcttctgcttgctggctgtagctccaggtgctcactcccaggtgcagttggtgcagtcgtggggctgaggtgaagaagccgtggggcctcagtagaaaactttcctgccaggcatcgtggatactaccttcatcgacctatatactccgacgtgggtagcgacgacggtccccgtggaaccggaggtacttaggaggtggagtcgggaactaaccgtcgaaacccgtgggtacggtcggacgacggaaccaaccgtaccgacgacggtaacgttccgaaggacaggacgtaccacagtcgaaccgagggaccaccgtccgacgtagtacgagttctagttgagttgagagtaggngagntacgtagacgacgtaccgggtcttaagtttacgttagtttcggtacgggtacgggtaacggggggtacggggggggtttcggggttaccgggtacggttaccgggaaccccggtttaaccccggggtcccccgggtttaggggtaaccccgtttaaacgggtttaacccccgggtaccgggggggtaaaccccgggttaaacccgggggtaacccccggttttaaccccggggg

SEQ ID NO: 210064 - DNA, 825 bp, Homo sapiens
  misc_feature: GYAE6OF01EZKE3.41.64.F09.1.454.CMB.1.raw
  modified_base (714)..(714): a, c, t, g, unknown or other
  misc_feature (714)..(714): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccgaggtgctccacctccccgtaggtcgcgtaggttgggtgacgtaggtcggtggggtctgggaaggtaggaaacggaacggtccggtcgggggccctacggtaaggttaacgttaaaactttccgtcggaccgaggctacgttcggtacggtaacttaaccaccgttcaacgtcgaacccttaacttataccgtccctaggttcggggtacgaccggtaaccgccgggtccccggttaagggaccggtaacggtaccgtttagggacggtacgggtaagtacggggaacctaaccttaccgtaaacccggttggggtacggtacggacgacggtaaacccaaccgtaccggacggtaaccggtaacgttacgaacggtaacgacgacgaccaaccgtagtacggaccggaacgggacctaaccgggtccgtacggacgtaacgtacggttacgtttagtacgggtaagttacgggaaggtacgtggtaaggacgtactcgtaaccggaacggaaccggtaccggtaacctttaagttttaagttacggttaggtaacgggnggggtaggggggtacggggggttcggtacgggcgttacggtacccgggtcccggtacggttgtacggttccggtacgggtaccgggcgggtaacccgtcggttaacccggg

SEQ ID NO: 210065 - DNA, 760 bp, Homo sapiens
  misc_feature: GYAE6OF01C1YB1.41.64.F09.1.454.CMB.1.raw
  modified_base (241)..(241): a, c, t, g, unknown or other
  misc_feature (241)..(241): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcacctcccgaggtgcaggttggtgcagtcgtgggctggaggtgaagaacgccgtggggcctcgagtagtaaactttccgngccaggcatcgtggactactaccttacactacgtaacctaacttactactccgtagtcgggtgccgacgtaccggcccgtaggacggagtcgtggaggtgagtacggaacaacgtccgtaaccgttgggtaggtcggacgtaacgaacgtaaccgacgacgaacggtaacgtacccgaggtacacgacgtaccacgacgtaccgacgacggacgaccggtaccgacgtacgtaacgtacgtacgttagttaggtaaggtacggtaggtaggtagtagtacgtacgtacggtaacggaaccggttttttttaaccgaccgtttaacgttaacgtttagtttacggttacggtacggggtacgggggtacgggggttacggggggttacggggttaccgggtaccgggtacccgggttacccgggttaccccggttaccgggttacggtttacggttaaccgggttaaccggggtacccgggtaaccggggtaaccccggggttaccgggttaaccccggg

SEQ ID NO: 210066 - DNA, 898 bp, Homo sapiens
  misc_feature: GYAE6OF01B05RF.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgcgtggctgtagctccaggtgctcactcccgaggtgctaggttggtgcgtagtcgtggggcttaggagggtaggaacggaacggtccggtcggggccttacgtaggttaacgtaaaacttttccgtcgaccgtagggactacgttacgtagggtaaccttaccttaacccgtttaccgtaacgttaccgtaaccctttaacgttaactttaaccgttacccgtaacgggtttcggggttacgacccggaacccggtacccgggtccccggttaggggaccggtaacgggttaccgttagggtaagggttgggtaacggtacggggaaacctaaccgttacccgtaaccggttggggtacggtcgggaaccggtaacggaaacctaacccggtacggaccgtaacgggtacgtaccgaaggacgacggtaacgtaccgaaccgagtaccgaaccggtaggacccgtaaccggtccgaacggtaacgtacgtacgtttaccgttaaggtttacggtaggttacggaacggtaagggtactagggaacgtacgtcggtaacgggaccgtaaccggtaaccggtttaacgttaacgtttttaagttacgggtttacgggtacgggtaacgggggtaagggggggttcgggggggtacgggttaccggcggttaacccggttaccgggtcccgggttcccgggttaggttacgttaccgggttcgggtacccgggtacggtaaacccgggtccgttacccgggg

SEQ ID NO: 210067 - DNA, 884 bp, Homo sapiens
  misc_feature: GYAE6OF01EI4V6.41.64.F09.1.454.CMB.1.raw
  modified_base (185)..(185): a, c, t, g, unknown or other
  misc_feature (185)..(185): n is a, c, g, or t
  modified_base (731)..(731): a, c, t, g, unknown or other
  misc_feature (731)..(731): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgcgtggctgtagctccaggtgctcacctcccaggtgctagtggtgnagtcgtgggcgtgaggtgaagacgcgtcgggtcctcgtagtagtaaacgttcgtcgcaggcagtctacggggactacctacctctactacgaacctacttactactaccgtacgtcgggtcgaccggacgtacccggacccggtacggaacggtacgggtaacgttacggtagtagggtaacggtacgggtaaccgtaaccgttaacccgtaaacccggttcggggtacgggttacgggaaccggttaaaccggaacccgtaaaccccgttaacccggaaccccgggtaaaccggtaaacccggttaacccggtaacgggaacgtaacggtaaccgtacccgtaaccgtaaccgtaaccgggaccgggtaaccggtaaacccgtccccgggttacggaacggttaaccgtacgttaacgtttaccgttaggtttaggtaacgttacgggagtaaggtacggttaacgagttacgtaccggacgaacggtaccccggtaacgttaaccgttttaagttttaacggtttacggtttggtaacccgggnggggggtaaaccgggggggttacggggggtacggttcccgggtacgggtaccgtaacccgggttaaccccggccggggtttagtacggtttaacccgggtcccggttaaaccggggcccggggtttaaaaccccggtccgggttttaccccgg

SEQ ID NO: 210068 - DNA, 615 bp, Homo sapiens
  misc_feature: GYAE6OF01BY6DY.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctgaggtgaagaagccgtggggcctcagtgaaaatttcctgccaggcatctggatacaccttcatcgacctactatatccactgggtgcgacacggcccctggacggaggacttggagtggagtcgggacaacgtcaacccgtggtcggtggcacggacaaccgacgacgaacgggtaatccgaggacagacgtaccacagtcgaccgagggacctacgtccgcgtagtacagttctagttggaattggagtagagtgagtatcgcgacgacgtacggaccttaattttagtagttggtacggcgggttaagggggacgggggggttggggtacggtccggtagggtaccggttacccgggtccccggtaggttacgacggtttacccgggagggacccggtaacgggtacccggtaccggg

SEQ ID NO: 210069 - DNA, 831 bp, Homo sapiens
  misc_feature: GYAE6OF01AY8ZZ.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccgaggtgctcgactccaggtgctaggttggtgcgagtcgtgggctggaggtagaagagccgtggggcctacgagtagaaactttccgtcgccgaggactagtcgtaggtactacctaccttaccgagtacgtaacccttaagttaacttactacccgtaaggtcggggtacgaccgtaaccggaccggggtcccccgtagggtaaccgagggtaccgttaggaggtaggtagtacgggaaacctaaccgtaccgtaaccggtgggtagggtccggaacgaccgggtaacctaaaccggtacccggtaacggtaaccggtaaacggttacccgaacgggacgtaacggtaccgtaaccgaacctacggtaaccgaacccgggtacgggtaaaccgaccggtacccggaacggtaacggtaaccgtaacggtttaacgttaaggtttacggtaaaggttacggaagggtacgtaaggtacgtaagtacgtacgtaacggaaccgacggtaaccgtacttaacgtttattacggtaggttacggtacggggtaaggggggtacgggggggttcgggtaccggttccgtaacgggtaccccgtaaccgggttcccggttaggtacggttacggttaaccggggtcggggtaaacccgtacgggggttaaccccgttaccggg

SEQ ID NO: 210070 - DNA, 752 bp, Homo sapiens
  misc_feature: GYAE6OF01CBUYT.41.64.F09.1.454.CMB.1.raw
  modified_base (150)..(150): a, c, t, g, unknown or other
  misc_feature (150)..(150): n is a, c, g, or t
  modified_base (578)..(578): a, c, t, g, unknown or other
  misc_feature (578)..(578): n is a, c, g, or t
tcagtctatactatcacgaccggtgctcgatttagcgcgtatacaagggggcatcatccaacaaccacatcccttctctacagaagcctctgagaggaagttcttcacatggactggacctgggagggtcttctgcttgctggctggtancctccgaggtgctacacctcccgaggtcgcgtggttggtgcgacgtcggttgggctggaaggtacggaaagaacggcccggtcggggtacctagtaagtaacgtaaaacgttttccgacggaccgaacggtcagttaccgtagggtaactaaccgttacccttacaacgttaccgaaccttaactaacggttaactacccggaagttcggggtgacccggaaccgtaccgggacccgtacgggaacggtacggttaacgttagtaacgggtaggtaacggtacgggaacctaacccgtacgaaccgggttgggacggtcggaacgaagaaccgacgtacgacgtaacgacgtacgaagacaaggactacactagcgacggagtacgacgaccgtagagtatacgtattagtagtacgaggagagcganagacgagtagaaccgacgtacgtattaagtttatacggttagcgggtaagggagggggtacgggggggtggttacccggtcggtacggaacccggtcccggttacccggtggttacgggtaacgttaaccggggtcgggtaacccgggtaaccggggttcccgtttaacccggg

SEQ ID NO: 210071 - DNA, 811 bp, Homo sapiens
  misc_feature: GYAE6OF01EZUDQ.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctgggagggtcttctgcttgctggctgtagctccaggtgctcacctcctaggtgcgtaggttggtgcgtaggtcggtggggcttaggagggtaggaaagacggtccgtcggggcctcgtaaggtaacgtaaaacttttcccgacggaccgaggtctacgttcgtaggaacttaaccctacttacaactaccgtaaccttaacttactactcccgtacggtcggggtcgaccgaccggaccggtcccggtaggacggacggtacggtaggaggtacggtagtacggaacctaacgtaccgtaccggttgggtaggcggtacgacggaccaaccgtacgacgacgtacgtacgaggacagtacgaccgacacggacgaaccggacggacgaccggtcgacgtagtaacgtacgttagttagtaaggtaaggtaggtaacggtagtaggtagtacgtacgtacgtaaggtaacccgaacggtaaccgttacctttaaggttttaagttacggtttacggtacgggggtaacgggggtaacggggggggtttccggggggggtaggtttacccgtaccggggttaaccggtaaccccgggttcccgggtacccgggtttaaggttacccgttaggggggtttaacccgacccggggggtaccggtaaaaccccggggtcccggttaacccgggg

SEQ ID NO: 210072 - DNA, 758 bp, Homo sapiens
  misc_feature: GYAE6OF01DMX1X.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagcctccgaggtgctcacctcccaggtgctaggttggtgctaggtcggtcggggcgtaggagggtaggaaaggacggtccggttcgggggccttacgtaaggttaagtaaaacttttccgaggtaccgaggctaacgttcgtacggtaacttaccctacctttaccacgtaccgtaaccttacttaactactcccgtacggttgggcgaccggtacgtaccgggtcccgtagggaccggtaggttacgttgggtacggtagggtaacggtacgggaacctaaaccgtccgtaaccggtggggtacgtaccggaacgacggaacctaaccgtcgaacgtacgtacgtacgagactagctacactagacgacgacggactccgtacgacgtagtactagtacgttagttacgggagttacggagggaagttggtacgacggttactacggtaacgaacgaccgggtacttaacgttgttttaacgttagttcgggacgggttaggggacgggggtacggggggttcggacctcggggtacgtaccgggttacccggcggtttacgaggttaccggttacgggccgggaacccggtaccggttcccgtacggg

SEQ ID NO: 210073 - DNA, 823 bp, Homo sapiens
  misc_feature: GYAE6OF01E29Y8.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctggaggtgaagagccgtggggcctcagtagtaaatttcctgccaggcatcgtaggataccaccttcatacgacctactatactccacgtgggtcgccgacgacggcccccgtaggaaccggaggacgtttggaggtggagtagggaaccaacgtaccgtaacccggtgggtcggtcggaccgaacggaaccgaaacccgttacggaccgtaacgggtaacgttacccgaagggtaaccgacggtacgtaacccgacccgtaacgtacgggaacccgtaacggggaacccgtaaccggtaccccgggacgtaacggttaaaccgtaggttaccgtttaacgttttaagggtaaacggtttagggaacgggtaacgggtagtacggtagtacgttacggaccgggtaaccggtaccggtaaccgttaagttttaacgttttaacgtttaggttacggtaccgggggtaaggggggtacggggggggttacggggggggttccgggttaccgggttacggtaacccgggttaaccccggtcccggggttacccggttagggtttaccgggttaccgggttaccggggtaccggggtaacccggggtaacccgggtacccgggttaccccggg

SEQ ID NO: 210074 - DNA, 636 bp, Homo sapiens
  misc_feature: GYAE6OF01AL5XY.41.64.F09.1.454.CMB.1.raw
  modified_base (235)..(235): a, c, t, g, unknown or other
  misc_feature (235)..(235): n is a, c, g, or t
  modified_base (505)..(505): a, c, t, g, unknown or other
  misc_feature (505)..(505): n is a, c, g, or t
  modified_base (537)..(537): a, c, t, g, unknown or other
  misc_feature (537)..(537): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctggaggtgaagagccgtggggcctcgagtagtaaatttccngccaggcatcgtggactactaccttcagtcgacctactatactaccacgtggggtcgaccgacgaccggccccgtaggacgaggtacttggaggtggagtacgggaccaacgtccgaaccgtgggtaggtcggacgaggtaaccctaaccgtacggcgaaacgggtaacgttccgaggtaaccgaggacgtaccaccgagtacggaccgacggaccgacggtaccgcgtagtacgagtacttagttacgaagttggagtagagtagagtnagtgacgacgacggtactagtttagtagttgnggtacggagggtacgggggggtgggtcgtcgtaggccgttccgggcccggtgttacggtacgttacggaccggggaccgtacgggtacccgttaccggg

SEQ ID NO: 210075 - DNA, 668 bp, Homo sapiens
  misc_feature: GYAE6OF01C9D4A.41.64.F09.1.454.CMB.1.raw
  modified_base (235)..(235): a, c, t, g, unknown or other
  misc_feature (235)..(235): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcaggttggtgcagtctggggctggaggtgaagaagccgtggggcctcagtagaaaatttccngccaggcatctaggactacaccttcatcgtaacctatataactccgacgtgggtcgacgaccgacgggtccccgagggaaccgaggtacctttggaggttgggaagtagggaccaacgtaccgaaccgtgggtggtcggacaaggaaactaacccgtacggacgaacggtaacgttaccgaaggactacggaagtaccaaccagtacggaaccgaacgggactaccggcgacgagtaccagttacttagttagagttagaggtagagtagacgatcgtagaacgtacgacgggtacttaagtttattacgttggtaggacgggtaggggtacgggggggtggggtacggtcgtacggtaccgtaccggcccccgggttagtcgggttaacgttaccgggagggggaccccgtaagggtaaccccggttccggg

SEQ ID NO: 210076 - DNA, 606 bp, Homo sapiens
  misc_feature: GYAE6OF01CS2AA.41.64.F09.1.454.CMB.1.raw
  modified_base (262)..(262): a, c, t, g, unknown or other
  misc_feature (262)..(262): n is a, c, g, or t
  modified_base (330)..(330): a, c, t, g, unknown or other
  misc_feature (330)..(330): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (442)..(442): a, c, t, g, unknown or other
  misc_feature (442)..(442): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
  modified_base (544)..(544): a, c, t, g, unknown or other
  misc_feature (544)..(544): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctggaggtgaagaagccgtggggcctcgagtagaaaattccgtgccaggccagtctggactacaccttnatgaccctatatatccagtggtgcgacgcgcccgtaggacgaggacgttgagtggagtaggactaacncctaaccgtgggtcggtcggacaaggaacctaaaccgtaacgacgaacggaacgttccgaaggtacagagtcacagagaaccgagggaacnccggtcnggaacgtatacgtntagttagtaagttgagggtacgngttcgaagntagtcgggaacgaccgaccggtaccttaattttagttatcggtgcgggaggggtaggggggtgggaccgnttcggaaccgtcccggtacggtgaccgttacggtacggtaggggacccagggtcccctcggg

SEQ ID NO: 210077 - DNA, 927 bp, Homo sapiens
  misc_feature: GYAE6OF01B3Y7D.41.64.F09.1.454.CMB.1.raw
  modified_base (719)..(719): a, c, t, g, unknown or other
  misc_feature (719)..(719): n is a, c, g, or t
  modified_base (727)..(727): a, c, t, g, unknown or other
  misc_feature (727)..(727): n is a, c, g, or t
tcagtctatactatcacgaccggtgctcgatttagcgcgtatacaagggggcatcatccaacaaccacatcccttctctacagaagcctctgagaggaaagttcttcaccatggactggacctgggagggtcttcgtgtcttgcgtgggtcttagtacgcctccgaggtcgacctaccaccgtcccgaggtcgacgtaggttggtcgaccgtaggtccggttggggccgttagggagggttaacggaaaggtaccggtcccgggttcggggaccttacgtaacgtttaagttaaaacctttccgacggaccgacggacgtactcgtacggtactaccgtaccttacgtacgtactaaccgttacttaacgtaccgtaccggtaacggttcgggaccgtaaccggacccgtacccgggtccccggtaaggggtacccggtaacggttaaccggtttaggggagggttacggggtaaaccgtacgggttaaccctaaaccccggttaccggtaaacccgggtttggggtaaccggtaccgggtaaacgaacccgggtaacccgtaaaccggtcccggtaaacgggttaccggaaccggttacggaacggtaccggtaacggtaccgtaccgacggtaacggaccgtaacccggacggaaccgttccggaccgttagaaccgttagtcttaacggttagttaacggaggttggtaaacgggntacgggtnaacttcgaacggtaccggtaccgtaaacgggttacttacgttttaacgtttagttacgtagggacgggtaggggggacggggtttacgggggttaccggtccgttaccggtaaccggtaccggttaccccggacggggtttagtaccgggtaacgggttacccgggtaccgggaacggttcccgggttaccccgttaagg

SEQ ID NO: 210078 - DNA, 694 bp, Homo sapiens
  misc_feature: GYAE6OF01B66KM.41.64.F09.1.454.CMB.1.raw
  modified_base (259)..(259): a, c, t, g, unknown or other
  misc_feature (259)..(259): n is a, c, g, or t
  modified_base (601)..(601): a, c, t, g, unknown or other
  misc_feature (601)..(601): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctgaggtgaagagccgtgggcctcagtagtaaatttccgtgccaggcatcgtggatacctaccttnagtcgtacctaacttatactaccgacgttgggtcgaccggtacgaccgggtcccccgtagggaccgtagggtacctttagggtacggtaggtaggtacgggacctaaaccgttacccgaacccgttggggtacgggtacggacgaacgggaacccgtaaaccgtaccggacggaaccgggtaaacgttcccgaagggtaaccaggtacgtaccaaccgacgtacgaaccgacgggaacctaccggtccgagtacggtactagttacgttagttaggtaattggaggagtagtaggagtactcgtacgacggacaccggtacttaagtttacttgtgtacggngggtaggggagggggggttcgggccgtgtcggaccgtccggtcccgtaggtacgttagttaccgggacgggaccgtacgggaccccggttcgg

SEQ ID NO: 210079 - DNA, 650 bp, Homo sapiens
  misc_feature: GYAE6OF01DR5O7.41.64.F09.1.454.CMB.1.raw
  modified_base (557)..(557): a, c, t, g, unknown or other
  misc_feature (557)..(557): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtgggctggaggtgaagaacgccgtggggcctcgagtagtaaaactttctcgccaggcatcgtggatactaccttcactgtacctactatactcacgtgggtcgcgacgacggccccgtaggacgaggtctgagtggatcgggaacactccaaccgtggtaggtcggacgtacggacaaccgtcggacgtacggtaacgttccgaggacagtacgtcaccagcgtaaccgacgggacctaccgtccggacgtaacgtacgtaacgttacttacggtttaggtaacgttgggaaggttagaagttcggagtagttcgaagtaccggaacgacgttaccttattttacgtagttcgaggtacgggtaggggngggggggtttcgggacgtcgtaggtacccggttccggcccggttagtacggttacgttacgggtacggggaccgacggggtacccgttacggg

SEQ ID NO: 210080 - DNA, 732 bp, Homo sapiens
  misc_feature: GYAE6OF01B1ME9.41.64.F09.1.454.CMB.1.raw
  modified_base (184)..(184): a, c, t, g, unknown or other
  misc_feature (184)..(184): n is a, c, g, or t
  modified_base (238)..(238): a, c, t, g, unknown or other
  misc_feature (238)..(238): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccgaggtgctcactcccaggtgctagttggtnactgtcgtggggctggaggtagaagagccgtgggcctcgagtataaactttccncgccgaggctagtcgtacggacttacctccttacacgtacgtaacccttaacttacttactaccgtacggttcgggtacgaccggaccgtaccgggtaccccggttagggaaccggacggtacggtttagggacgggttagggacgttacggggaacctaaaccgttacccgtaacccgggttgggtaccggtcggacgaacggaaccgtaacccgtaccggacgaaccgggtaactaccggaggacgtacgtacgtaccacgagtcgaaccgagggacctaccgacgtacgagtaccgtacgttacgttaggttaggtaacgtagggacgtagtacgagagtagacgtacgacgacgtcggtactttaagtttattagtagtacgggagggtacgggggtagggggttcgggtacgtcggtacgacccgttccgggcccgttaggtaaccgttcggttacggaccgggttaccggaccgggttcccgtccggg

SEQ ID NO: 210081 - DNA, 804 bp, Homo sapiens
  misc_feature: GYAE6OF01DYBBY.41.64.F09.1.454.CMB.1.raw
  modified_base (175)..(175): a, c, t, g, unknown or other
  misc_feature (175)..(175): n is a, c, g, or t
  modified_base (251)..(251): a, c, t, g, unknown or other
  misc_feature (251)..(251): n is a, c, g, or t
tcagtctatactatcacgaccggtgctcgatttagcgcgtatacaagggggcatcatccaacaaccacatcccttctctacagaagcctctgagagaaagttcttcaccatggactggacctggagggtcttctgcttgctggctgtagctccaggtgcctcacctcccgaggtnctaggttggtcgatagtccggtgggctggaggtagaagacgccgtggggtcctacgaagttagtaaaactttccgngccgaggtctatcgtagaactacctacttcaagtacgaaccttacttactaccgtcccgtaggtcggtagaccgacggtaccggtcccgtagggaacggtaggtaacgtggtaggtacggtacgtaacgggtaacctaaaccgtacccgtaaccgggttggggtaccggtacggaaccgttaccgggaaaacccgtaccccgtaaccggtaccggtaaacggttacggtaccggaacgggacgtacgtaacgaccgtaccggtagacccgggtaacggaaccggtacccggtaaccgttacggtaacggtaacgttaccggttaaggtttacgtttaacgggtttaacggtaggttaacgggaagtaaggtaacggtgtaacggttattaccggaacgtaacggacgtaaccggttacttaagtttagtttgtacgggtacggtacggggtagggggtacggggggggtcgtcggaccggttacggtaacccggtccggtccggttagtaccgttaggtaccgggttcggaacccggtacgtaccggtaccgg

SEQ ID NO: 210082 - DNA, 732 bp, Homo sapiens
  misc_feature: GYAE6OF01CQYVJ.41.64.F09.1.454.CMB.1.raw
  modified_base (241)..(241): a, c, t, g, unknown or other
  misc_feature (241)..(241): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccgaggtgcagttggtgcgagtcgtgggctggaggtagaagacgccgtcggggcctcgagtagtaaactttccgngaccaggctagtctacggacttaccgtacctttacacgtacgtaaccttaactaacttacctaccgtacggtcggggtacgaccgaaccgtaccggaccccgttagggaaccgaggtacgtggacggtagtacggtacgaacctaactccgtaaccggtgggtggtcgacgtacggaacctaacgtacgacgaacggtacgtacgaacgacacgtacacctacgagacgaaccggacgggtaccaaccgggtccgaaccggagttaaccgtacggttagtacgtttaggtaacgttgggaacgtagagggtgaagacgttcgaacggacgtaacgtaccgtaactttagtttacttaaggttcggtaggtacgggggtgggggtggggggttccgggtacggcggtttaaccgggaccggttaccccggggtcgtggttaacggtacccgtttacggggcccgggaacccggtacgggtacccgttccggg

SEQ ID NO: 210083 - DNA, 818 bp, Homo sapiens
  misc_feature: GYAE6OF01CCU3X.41.64.F09.1.454.CMB.1.raw
  modified_base (82)..(82): a, c, t, g, unknown or other
  misc_feature (82)..(82): n is a, c, g, or t
  modified_base (133)..(133): a, c, t, g, unknown or other
  misc_feature (133)..(133): n is a, c, g, or t
  modified_base (140)..(140): a, c, t, g, unknown or other
  misc_feature (140)..(140): n is a, c, g, or t
  modified_base (619)..(619): a, c, t, g, unknown or other
  misc_feature (619)..(619): n is a, c, g, or t
tcagtctatactatcacgaccggtgctcgatttagcgcgtatacaagggggcagtcatccaacaaccacatcccttctctanagaagcctctgagaggaaagttcttcaccatgactggacctggaggtcttntgcttgntggctgtgcctcgaggtcgctcactcccgaggtgcgtaggttggtgtcgaggtcggtggggtctggagggtagaaagacggccggtcggggtcctacgtagtaacgtaaaacgtttccgacggaccgaggtctagttcgtaggtaactaccttaccttactaacgtaccgtaaccttaacgtaacgttacctacccggtacggtaggggtaccgaccgggaccgtaccgggtcccgtaagggaaccgggtagtccgtaggaggtacgggagtaccgggaactaccgtacccggtaccgggttaggcgggtacgacgtaggtaacccaccgtacggaccgacggttaacgtacggacgtaacgtaggacctcgtaaacgcgtacggacccgtaaacgggtacccgtacccgggttgaaccggttacgtaggttacttaaacggtttagttagggtattaggggaaaggtacggggtttanacggttaacggtaccgttagaccgggttaaaccgacgtttaacgggtaccttttaagtttaacttttgggggcgttaaggggtccggggtaggggggttaccgggggggtccggtagtaccgggtaccggacccggttcggttccggtcggtaacgtaaccggttcgggaccggggtaaccggtcgggtccctaccggg

SEQ ID NO: 210084 - DNA, 713 bp, Homo sapiens
  misc_feature: GYAE6OF01BVQPC.41.64.F09.1.454.CMB.1.raw
  modified_base (245)..(245): a, c, t, g, unknown or other
  misc_feature (245)..(245): n is a, c, g, or t
tcagtctatactatcacgaccggtgctcgatttagcgcgtatacaagggggcatcatccaacaaccacatcccttctctacagaagcctctgagaggaaagttcttcaccatggactggacctgggagggtcttctgcttgctggctgtagctccaggtgctcactcccaggtgctaggttggtgctagtcggtggggctaggaggtggaagacgccgtggggcctcgagtagtaaactttccgngccaggctatcgtagacttactaccgttcatcgacctatatactccagttgggagccgacgacggtaccccgtgggaacggtacggtacgttggaggttcgaggtacggaccaaccgttaccgaacccgttagggttcgggaggaccgaagggaacctaaaccggtaccggacgtaaacgggtaactaccggaaggtacgacggtacgtaccaccgtaggtaccgaaccggacgggtaacccgtaccgggtccggaaccgtaaggtaaccgttacggttacgttagtttaagggtacgtttaagggaggtaagggtacgtagtaacggtctcgtaacggacgtaccgacgtactagtttactgttaggcgtagggtggggtggggtgggtcggtaccgtggtaccgtacgggtcccgtaggttcgtacggttacgggtaccggggacgttaaccgggtccgtaaccgg

SEQ ID NO: 210085 - DNA, 770 bp, Homo sapiens
  misc_feature: GYAE6OF01BRGM6.41.64.F09.1.454.CMB.1.raw
  modified_base (260)..(260): a, c, t, g, unknown or other
  misc_feature (260)..(260): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctcaggtgctcactcccaggtgctagttggtgcagtctggggctgaggtgaagacgctggggcctcgagtagtaaaactttccgtgccaggcagtctaggatactcctanatcgacctatactactcctacgtggtcgaccgtaccgtacgggtccccgtagggaaccggtagggtacgtttggacggtaggacgtacgggaactaaccttaccgaacccgttgggtacggtggacgaacgggtaaccaccgtacgcggtaaacccggtaggttaccgacggggtaaccacgggtacgtacccgaaccgtagtaccggaacccgaaggggaacccgtaccggtaccgggtaaccggaaggttaccgtacgtttacgtttacggtttaagggtaacgttagggtaagggaaggttacggtagggtaacgtacgtaacgtaaaccggtaaccgtaccggttaacctttaagttttagttttaacgttagggttccgggaagggttacgggggggtaggggggggttacgggtacggtcccggtagggtaacccgtcccgggttcccgtggtacggtacggtttcggacggggtcccgtacgggtacccggttggtacccccg

SEQ ID NO: 210086 - DNA, 777 bp, Homo sapiens
  misc_feature: GYAE6OF01EZBOF.41.64.F09.1.454.CMB.1.raw
  modified_base (299)..(299): a, c, t, g, unknown or other
  misc_feature (299)..(299): n is a, c, g, or t
tcagtctatactatcacgaccggtgctcgatttagcgcgtatacaaggggggcatcatccaacaaccacatccccttctctacagaagcctctgagaggtaaagttcttcaccagtggactggacctgggagggtcttctgcttgcgtggctgtagctcgaggtcgctcctacctcccgaggtcgcgtaggttggtgcgtaggtccggtggggctaggaggtagaagacggtccggtacgggccttacgagttaacgttaacttccgtcgccgagctagtcgagtacctactaccttanactactacttactactacgaccgtggtcggcgaccgaccggtacccggtccggagggacggtacggtacggttagggacggtacggtacggtacgtaaccgtaccgtaccggtacgggttggtcggacggaaccggaaccgtaaccgaccggtaccgacggtaacggtacgtaccgaagacgacgtacgaccacgtacggaccgacggaaccggaccgtcggtacggacgtaacgtacgttagttacgttagtaggtaaggtagggtaggtaggcgtaacggtactacgtacgaaccgtacggaccgttacgtacgttttagtttacgtacgggttacggggacgggtaggggggtacggggggttcggggtcggttacccggtcggtacccgggtacccggttccgggtaccggttagggtacccgggttacggggtcccgggaaccgggttacccgggtccgggtacccggttcgg

SEQ ID NO: 210087 - DNA, 859 bp, Homo sapiens
  misc_feature: GYAE6OF01BOIFB.41.64.F09.1.454.CMB.1.raw
tcagtctatactatcacgaccggtgctcgatttagcgcgtatacaagggggcatcatccaacaaccacatcccttctctacagaagcctctgagaggaagttcttcaccatggactggacctggagggtcttctgcttgctggctgtagctccgaggtcgctcaccgtcccgaggtcgcgtaggttcggtgaccgtaggtcggtggggcgttggagggtaggaaacggaacggtccggtcgggggtaccctacggtaagttaacggttaaaaacgttttcccgtacggaccgtacgggtactacgtttacggtacggtaaccttaacccgttaacctttacctaacggttaccgttaaacccttaacctttaagttaacccttacccgtaacgggtttcgggggtacgtaccgggaacccgtacccggggaccccgttacggggaaccgggtacggtaccgtttagggacggttggacggtaccgggtaacctaacccggtaccgtaacccgggttggggtacgggtacggaccggaacggtaaccgtaacccggtaacgaccggtaaacgggtaaccggttaccgaacgacgtaggtaacctaccgaaccgacgtacggaccgtaacgggacctaccggcggacagtactacgttacgttagttaggagttacggaggtacgagtagacgtacgtagacggaacgtaccgaacgttactttagtttaagtacggttagtcgggtagggtagggggtacggggggttcgggaccggtacggtcggtacccggtccggtacccggttaggtccggtcgggttaacggtcggggaccgttaccggggtcccgttaaccggg

SEQ ID NO: 210088 - DNA, 1081 bp, Homo sapiens
  misc_feature: GYAE6OF01BZPO2.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctgggagggtctttctgtcttgctggctgtagcctccgaggtgctcactcccgaggtgcgtaggttggtgcgtaggtcggtggggtcgtaggagggtaggaaaggaacggtccggtcgggggtccctacgtaaggttaagttaaaacttttcccgtcggaccgagggtacctacgttccgtacggtaacctttaaccgttacccctttacgtaacgtttaccggtaacccttaactttaacttaccttacccggttaacggttcggggttccggaccggtaacccggtaccccgggtacccccgggttacggggtaaccggggttaacggggttaccgtttaggggtaagggttacggggtaaggttaaccggggaaaccttaaaccccgttaccccggtaaaccccgggtttcgggggttacggggtaaccggggtaaccggaaccgggtaaaaaccccgtaaacccccgggttaacccggtaacccgggtaaacccggggtaaaacccgtttaacccgggaaaccgggtaaacccgtaaacgggtaaccggtaaccccgtaaacccggtaacgttaacccggggaaccccggtaacggggtaaaccccggtaccccggggtaccccggtaccgggttaaaccgggttaccgtaacggtttacgttttaacgggttaagggttaacggttaggggaagggtaacgggtaacggttagggtaacggtacgtcggtaacccggtaacggtaaccggtaaccgggtttaacctttaagtttttaaccgtttacgggtttacgggtagggggtacgggggttaacggggggggttcggggggggttccgggggttcggtaccggtaccgggttacccgggttcccggcccgggtttagggtaccgttaacggggttaccgggtaccgggggtaccccggtaaccggggttcccggttcccggg

SEQ ID NO: 210089 - DNA, 880 bp, Homo sapiens
  misc_feature: GYAE6OF01A3FWP.41.64.F09.1.454.CMB.1.raw
  modified_base (173)..(173): a, c, t, g, unknown or other
  misc_feature (173)..(173): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccgaggtcgctcacctcccgnggtgctaggttggtgcgtaggtcggtcggggcgttagggagggtaggaaaggacggtccggttcgggggtcctacgtaaggttaacgttaaaacgttttcccgtcggaccggtaggactacgttcgtaacggtaactacctaccttcagttaccgtacctacttacgtactaccgtaggttacggtcgaccgtaaccgaccgtcccggtaggaccggtacggtagtggaggtacggacggtacggtaacaccgttaccgtaaccgggtggtacggaccggtacggacgtaaccgaaaccgtcggaccgtaacggtaacgtacgacggtacgaacgtaccgaccacgacgtacgaccgtaacgggaccgtaccggtaccggaacggtaacgtaccgtacgttacttaagggtttacgtaaggttagggtaacgggtagtacggtaggtaaggtacgtacggttacggaacccgtacccgggtacgttaacgttttaagtttaaacggtttcggttaacggggtacggggtaacggggggttacggggggttaccgggggggggtacggttacccgggtacccgggttaggttaacccccggggttccgggttaccccggggttaacggtttaccggggttaaccggttaccccgggggtaaccggggtaccccggggttaaacccggggttccggttaacccccgggg

SEQ ID NO: 210090 - DNA, 868 bp, Homo sapiens
  misc_feature: GYAE6OF01ECZ4K.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccgaggtgctcactcccaggtgctaggttggtgccgaggtcgtcggggcgttgggagggttaggaaacggaacggccggtcggggccgtacgaggtagtaaaacctttccgtacgtaccgagggactacgtcgtacgggtaactaccgtaaccttacgaacgttccgtaacctttaacctactaactcccgtaacgtgggtaccggtacccggacgtaccgggtccccgtaggggaccggttacggtacggtttacggtaaggtgggtaacgtccggggtaaactaacccgttaccgtaaaccccggggtggtcgggtacgggaaccggtaacgggaaacccgtaacccgtaaccggaccgtaaacgggttaacggttacccggaaagggaacgtacggttacggtaaccaccgtaagtaccgaaccgggacgggtacctaaccgggttcccggaacgggttaccgttaacggttacgtttaacggttttacggttagggttaaccgtttaggggacggttacggaagggtttacggtagaacgttccgtaaggaacccgtaacgtaccgggtaatttacgtttaacgtttgtacgggttggtacgggtagggggttacgggggggtccgggttcgcggttaacggtcccggtaaccgttccgtaggtacgggttaccgttacggggaccgggacgttacccgggtacggtcccgg

SEQ ID NO: 210091 - DNA, 867 bp, Homo sapiens
  misc_feature: GYAE6OF01B6JSU.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctgggagggtcttcgtgtcttgcgtggcttgtagctccgaggtcgctccgacttcccgaggtgcgtaggttggtgacgtgtcggtggggcgtggaggtaacgaagacggtccggtcggggacctagtaaggttaactaaacgtttccgtcggaccgaggactacgttcgtagtaactacctacttctacgtacgtaacctaacttactacctccgtcgggttggtacggaccggtaaccgcccgggaccccggtagggtacggtacggttaccggttgggaacggtcgggtaaggacgggtaaaccctaaccggtaccccgtaaaccggttggggttaacgggtacggaccgtaaccggaacccgttaaccggaaccgtaccgggaacggtaaaccgtacggtaacggaaacgtaccggtaaccgaccgtacgtaaccggtacggaacccggaccgggtaacccgtaccggtaccggtaggtaacgtacgtacgtaagtttagtacggtaagtacggagaggtagaggtagtacgtacggtacgacgaacggtacccgtaatttacgttacgttagttagggttacggtacggggtaggggggttaccgggggttggggtaccgggttaccgggtaaccggtttaccgggtaccccgggttaccccgggttaggttaaccgttacggggtttacccgggacccggggtaaacccgggtaacccgggttcccgggttaaaccccggg

SEQ ID NO: 210092 - DNA, 674 bp, Homo sapiens
  misc_feature: GYAE6OF01CL545.41.64.F09.1.454.CMB.1.raw
  modified_base (175)..(175): a, c, t, g, unknown or other
  misc_feature (175)..(175): n is a, c, g, or t
  modified_base (185)..(185): a, c, t, g, unknown or other
  misc_feature (185)..(185): n is a, c, g, or t
  modified_base (246)..(246): a, c, t, g, unknown or other
  misc_feature (246)..(246): n is a, c, g, or t
  modified_base (274)..(274): a, c, t, g, unknown or other
  misc_feature (274)..(274): n is a, c, g, or t
tcagtctatactatcacgaccggtgctcgatttagcgcgtatacaaggggggcagtcatccaacaaccacatcccttctctacagaagcctctgagaggaaagttcttcacatggactggacctggagggtcttctgcttgctggctgtagctccgtaggtgctcactccaggtnctagttggtncaggtcgtggggctaggaggtggaagacgccgtggggcctcgaagttacgtaaaatttccnggtccaggcatcgtacggatccaccttntaacgtcgaacctatactactccgacggtgggtacgcggaacgcggtccccgtagggacggtagtaccgttaggacggtaggtatacggggacttaaaccgcctaacccgttgggtcggtacggacaacggtaaccgaaaccgtcggaccgaacggtaacgtaccgaagggtacaagtacgtaccacctagacgtaaccgaggtacaccgtcgactagtacagtcttaagtcggattacggagtagacgtgagtagtcaaggtacacgtaacgtcgtatttaagtagttggagcgggacggggtagggggggtccggtcgacgttacggtaccgtcccgggtaccgttcgttaaggtacggttaccggacgggggtaccaacgggggtaacccgttcggg

SEQ ID NO: 210093 - DNA, 807 bp, Homo sapiens
  misc_feature: GYAE6OF01BV1JX.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctggaggtaggaagaacgccgtgggggccctcgtagtagtaaactttccgtcgccgaggctagtaccgtaggacttaacctacctttaccaagttaccgtaacccgttaactttaactacttacccgtacggtacggggttcggtacccggaaccgtacccgggtacccccggttaggggaacccgtaaggggttaccgtttagggacggtgggtaaggttacgggaacctaacgtacccgtaaccggtggggtggtcggacgaacggaacctaacccgtaaccggaccgtaaacgggtaaccggttaccgaagggtaaccacgggtactacccgacgagtaccgggaacccggaacgggtaccgaccggtccgacggaacgtaacgtacgtacgttagttaggtaagttgaaggaggtaggtagacgagtacggtacgacggtacggtacgtacgttaatttacgttacggtaggtcggtagggtacgggggtagggggggttacgggtccggtcggtaccggttacccggtcccggtacccgggttagggttacggtaccgggttaccgggtaaccgggggcccggttaaaccgggtcccggttaacccggg

SEQ ID NO: 210094 - DNA, 731 bp, Homo sapiens
  misc_feature: GYAE6OF01EOGZ3.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgctagttggtgcagtcgtggggctggaggtagaagaagccgtggggcctcagtacgtaaaatttccgtgccgaggcatcgtaggactactaccgttcatacgaccttactagttactccgacggttgggtcgacgtaccgacggtccccgtagggaacggaggtacgttaggaggtggtacgtagggaacctaccgtaccgtaaccggtgggtggtcggacacggaacctaactacggacgaacgggtaaccgttacgacggaacgagtacgtaccacgagtacgaaccggacgggaccgacgtacccggacgtaacgtactacgttacgttaagtttagggaacgttaggaaggtacgtaggtaggaacgtgtacgtagaccgaacgtaccggtactttaagtttacgttagtggtcggtacggggtaggggtaggggggggttccgggttaggtccgggttaacggtacccggttcccgggaccccgggtttaggttaaccggtacgggttaacgggaccgggggtacccggtaacccgggtacccggtttaccggg

SEQ ID NO: 210095 - DNA, 710 bp, Homo sapiens
  misc_feature: GYAE6OF01C05PG.41.64.F09.1.454.CMB.1.raw
  modified_base (160)..(160): a, c, t, g, unknown or other
  misc_feature (160)..(160): n is a, c, g, or t
  modified_base (182)..(182): a, c, t, g, unknown or other
  misc_feature (182)..(182): n is a, c, g, or t
  modified_base (475)..(475): a, c, t, g, unknown or other
  misc_feature (475)..(475): n is a, c, g, or t
  modified_base (529)..(529): a, c, t, g, unknown or other
  misc_feature (529)..(529): n is a, c, g, or t
tcagtctatactatcacgaccggtgctcgatttagcgcgtatacaagggggcagtcatccaacaaccacatcccttctctacagaagcctctgagaggaaagttcttcaccatcggactggacctggagggtcttctgcttgctggctgtagctcaggtnctcactccaggtgctagttggngacgtgtcggtgggctggtaggagaagacggccgtcggggcctagtagtaagtaacgtttccgacgccgaggctacgtcgtaggtactccgtaccttcataccgtaacctattacgactacgacgttgggcacggaccgtaccggtcccgtaaggacggacgttacgtggaggtaggacgtacggaactacctcggtaaccgtgggtcggtacgacgaacgaccgtacgacgacgtacggtacgccgaagacaggacgaccagacgacgaccggacggactaccggacggtanaggtccgtaagttcgtttaaaggtggtaagtgggaacgagttaggtacgacgtnttacggtacggaacgtaccggtacggttactttaagttacgtcggttaggcgggtacggggtacgggggggtaggggttcccggtacgtccggttaagggttaccctcccggggttccgttagggtaacccggttacggggttcccggacgggtaaacccggtacggggtcccgttaacgg

SEQ ID NO: 210096 - DNA, 523 bp, Homo sapiens
  misc_feature: GYAE6OF02I35A8.41.64.F09.1.454.CMB.1.raw
  modified_base (479)..(479): a, c, t, g, unknown or other
  misc_feature (479)..(479): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacaactcaaccctggtggtggcaggacaacctacgcacggaagttccaggacagagtcaccatgaccagggacacgtccgcgagtacagtctatttggaattgaggagagtgagatctgacgacacggcctaatttattattgtgcgaggaggggggtggggtcgngtgactacggcccgtgtcgattaccgtgggccagggaccctcgg

SEQ ID NO: 210097 - DNA, 527 bp, Homo sapiens
  misc_feature: GYAE6OF02HCXQM.41.64.F09.1.454.CMB.1.raw
  modified_base (510)..(510): a, c, t, g, unknown or other
  misc_feature (510)..(510): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacaactcaaccctggtggtggcaggacaacctacgcacggaagttccaggacagagtcaccatgaccagggacacgtccgcgagtacagtctatttggaattgaggagagtgagatctgacgacacggcctaatttattattgtgcgagggaggggggttggggtcgcgtggacgtacggcccgtgtcgagttacgnggggccagggaccctgg

SEQ ID NO: 210098 - DNA, 523 bp, Homo sapiens
  misc_feature: GYAE6OF02FQ1WY.41.64.F09.1.454.CMB.1.raw
  modified_base (477)..(477): a, c, t, g, unknown or other
  misc_feature (477)..(477): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcaggggctgaggtgaagaagcctggggcctcagtgaaaattcctgccaggcatctggatacaccttcatgacctactatatccactgggtgcgacaggcccctggacgaggacttgagtggatgggacaactcaaccctggtggtggcagggacaacctacgcacggaagttccaggacagagtcaccatgaccagggacacgtccgcgagtacagtctattggaattgaggagagtgagatctgacgacacgggccagtttatattgtgcgaggaggggggtggggtcgngtgacgtacgccccgtgtcgattacgtggggccagggaccctcggg

SEQ ID NO: 210099 - DNA, 522 bp, Homo sapiens
  misc_feature: GYAE6OF02HRZ70.41.64.F09.1.454.CMB.1.raw
  modified_base (464)..(464): a, c, t, g, unknown or other
  misc_feature (464)..(464): n is a, c, g, or t
  modified_base (479)..(479): a, c, t, g, unknown or other
  misc_feature (479)..(479): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacaactcaaccctggtggtggcaggacaacctacgcacggagttccaggacagagtcacatgaccagggacacgtccgcgagtacagtctagttggaattgaggagagtgagatcgtgacgacacggcctatttacttattgtgcgagggnggggggtgggtcggngtgactacgcccgtgcgtacgttcgtggggccagggaccctgg

SEQ ID NO: 210100 - DNA, 521 bp, Homo sapiens
  misc_feature: GYAE6OF02FVA55.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacaactcaaccctggtggtggcaggacaacctacgcacggaagttccaggacagagtcaccatgaccagggacacgtccgcgagtacagtctattggattgaggagagtgagatctgacgacacggccatttatattgtgcgaggaggggggtggggtcgcgtgacgtacgccccgtgtgacgttacgtggggccagggaccctcggg

SEQ ID NO: 210101 - DNA, 560 bp, Homo sapiens
  misc_feature: GYAE6OF02IW5MG.41.64.F09.1.454.CMB.1.raw
  modified_base (473)..(473): a, c, t, g, unknown or other
  misc_feature (473)..(473): n is a, c, g, or t
  modified_base (481)..(481): a, c, t, g, unknown or other
  misc_feature (481)..(481): n is a, c, g, or t
  modified_base (490)..(490): a, c, t, g, unknown or other
  misc_feature (490)..(490): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctggaggtgaagaagccgtggggcctcgagtgaaaatttcctgccaggcatcgtggatacaccttcatgaccttactatatccacgtgggtgcgacacggccccgtggacgaggacgttgaggtggatgggacaactccgaaccgtggtggtggacaggaccaaccgtacgcgacggaacgtccgaggacagacgtcacatcgacgaggacacgtccgacgatacagtctagttggaattggaggtagacgtgagatcgtagacgacgacgctaagtttnttagttgngacgagggngggggtggtcgcgtcgacgtaccggcccgtaggtacgacgttacggtcggggacctacgggcccgtacgg

SEQ ID NO: 210102 - DNA, 523 bp, Homo sapiens
  misc_feature: GYAE6OF02G1SOM.41.64.F09.1.454.CMB.1.raw
  modified_base (503)..(503): a, c, t, g, unknown or other
  misc_feature (503)..(503): n is a, c, g, or t
tcagtctatactatcacgaccggtgctcgatttagcgcgtatacaaggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacaactcaaccctggtggtggcaggacaacctacgcacggaagttccaggacagagtcaccatgaccagggacacgtccgcgagtacagtctattggaattgaggagagtgagatcgtgacgacacggccatttattattgtgcgaggaggggggtggggtcgcgtgacgtacgccccgtgtgacttacgnggggccaggggaccctcggg

SEQ ID NO: 210103 - DNA, 525 bp, Homo sapiens
  misc_feature: GYAE6OF02FPTFF.41.64.F09.1.454.CMB.1.raw
  modified_base (504)..(504): a, c, t, g, unknown or other
  misc_feature (504)..(504): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacaactcaaccctggtggtggcaggacaacctacgcacggaagttccaggacagagtcaccatgaccagggacacgtccgcgagtacagtctattggaattgaggagagtgagatctgacgacacgcatttatattgtgcgaggaggggggtggggtcgcgtggacgtacgccccgtgtcgtagttaccgnggggccctagggaccctcggg

SEQ ID NO: 210104 - DNA, 520 bp, Homo sapiens
  misc_feature: GYAE6OF02HIRZP.41.64.F09.1.454.CMB.1.raw
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
  modified_base (461)..(461): a, c, t, g, unknown or other
  misc_feature (461)..(461): n is a, c, g, or t
  modified_base (469)..(469): a, c, t, g, unknown or other
  misc_feature (469)..(469): n is a, c, g, or t
  modified_base (479)..(479): a, c, t, g, unknown or other
  misc_feature (479)..(479): n is a, c, g, or t
  modified_base (503)..(503): a, c, t, g, unknown or other
  misc_feature (503)..(503): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatactccacgtgggtgcgacacggcccctggacgaggacttgagtggagtggacaactcaaccctgggtggtggcaggacaaccgtacgcaacggaagttccgaggacagagtcacatcgaccagggacacgtccgcgagtacagtctagttggaattgaggagagtganatcngacgacgacgctagtttatatgngcgagggngggggtggcngtgacgtcgcccgtgtgacttcgngggaccagggaccctgg

SEQ ID NO: 210105 - DNA, 543 bp, Homo sapiens
  misc_feature: GYAE6OF02ILLYR.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacactcaaccctggtgtggcaggacaactacgcacggaagttccaggacagagtcaccatgaccagggaccacgtccgcgagtacagtctagtttggaattgaggagagtgagatctgacgacgacgggcctaagttttattagttgtagcgtagggagggggggttggggtcgcgtaggacgtacggccccgtgtcgtacttacgtggggaccaggggtaaccctcggg

SEQ ID NO: 210106 - DNA, 570 bp, Homo sapiens
  misc_feature: GYAE6OF02JBL75.41.64.F09.1.454.CMB.1.raw
  modified_base (435)..(435): a, c, t, g, unknown or other
  misc_feature (435)..(435): n is a, c, g, or t
  modified_base (471)..(471): a, c, t, g, unknown or other
  misc_feature (471)..(471): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatcccactgggtgcgacgacggcccctggacgaggacttgagtggatgggacaactcaacctggtggtggcaggacaacctacgcacggagttccaggacagagtcaccatcgaccagggaccacgtcccgacgagtacagtctagtttggaattggaggagagtgagntcgtagacgacgacggcctaagtttattactttggngacggaggggagggggggttgggtcggcgttacggaccgtaccggccccggttagttcggacgtttaccggtcgggggacctacggggtacccgtcggg

SEQ ID NO: 210107 - DNA, 617 bp, Homo sapiens
  misc_feature: GYAE6OF02IXR5N.41.64.F09.1.454.CMB.1.raw
  modified_base (284)..(284): a, c, t, g, unknown or other
  misc_feature (284)..(284): n is a, c, g, or t
  modified_base (423)..(423): a, c, t, g, unknown or other
  misc_feature (423)..(423): n is a, c, g, or t
  modified_base (459)..(459): a, c, t, g, unknown or other
  misc_feature (459)..(459): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtgggctggaggtgaagaagccgtggggcctcagtagaaaatttcctgccaggcatctggatactaccttcatgacctactatactccacgtgggtncgacacggccccgtggacgaggtacttgagtggatgggaacaacgtccaaccgtgggtaggtggcgaaggaccaaccgtacgaccgtaacggaacgttccgaggacagacgtcacgatcgaccgagggacaccgtccgngacgtacagtctagttgaattgagagagtgagagtntgacgacgtaccggccttaattttaagttagttggtacggaggtacggggtaggggggggttacgggtccgtacgggtcggtaaccggtacccggttccccggtgggttacgtacgttacgggtacgggggacccgtaacggggaccccgtttacggg

SEQ ID NO: 210108 - DNA, 590 bp, Homo sapiens
  misc_feature: GYAE6OF02I1BM6.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatggacactcaaccctggtggtggcaggacaaccgtacgcgacggaagttccaggtacagagtccaaccagtcgaccagggaccacggtaccgcgagtacagtacgtatttaggaattggaggtagagtgagatcgtagacgaacaccgggcctaagttttacgttattcggtgacggaggggtacggggggggttggggtacggtcgtacggtaccgttaccggaccccgttggtacgtacgtttaccggtgggggacccgtacggggaccccgttacggg

SEQ ID NO: 210109 - DNA, 545 bp, Homo sapiens
  misc_feature: GYAE6OF02IKKQ4.41.64.F09.1.454.CMB.1.raw
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
  modified_base (434)..(434): a, c, t, g, unknown or other
  misc_feature (434)..(434): n is a, c, g, or t
  modified_base (463)..(463): a, c, t, g, unknown or other
  misc_feature (463)..(463): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgaccttactatatccactgggtgcgacaggccccctgggacgaggacttgagtggatgggacaactcaaccctggtggtggcaggacaacctacgcacggagttccagacagagtcaccatgaccgagggacncggccgcgagtacngtctagtttggaattgaggagagtgagatcngacgacacggctaatttattattggacgngagggtagggggggtggggtcggcggtgaccgtaccggccccgtggtcgatttaccggcggggaccacggggacccctcggg

SEQ ID NO: 210110 - DNA, 701 bp, Homo sapiens
  misc_feature: GYAE6OF02FPC81.41.64.F09.1.454.CMB.1.raw
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
tcagtctatactatcacgaccggtgctcgatttagcgcgtatacaaggggggcgagtcatccaacaaccacatcccttctctacagaagcctctgacgaggaaagttcttcaccgatggactggacctggagggtcttctgcttgctggctgtagctccaggtgctcactcccaggtgcagttggtgcagtctgggctgaggtgagacgcctggggcctcgagtgaaaactttcctgccaggcagtctggatacaccttcatcgacctactatacgtccactgggtncganacggcccctaggacgacggtacttggacggttggacgtacggggacaacgtcctaacccgtggtacggtcggactacgggacgtaacctacggacgtaacgggtaacgttaccgaagggtaccaaggtacgtaccaaccgtagtcggacccgtagggaaccaacggtcccggacggacgttaacgtacgttaccgttaagtttacgggaaattttcgggaacgggtaggtacggttagaagtacgtcttagaccggtaccgacgggttacctaagttttacgttaagttcggtaggtacgggtaagggggtacgggggggtcgggtaccggtcggtacggttaccgtacccggtcccggtaggtacggtacgtttaccggcggggtacccgtacgggacccgttaccggg

SEQ ID NO: 210111 - DNA, 577 bp, Homo sapiens
  misc_feature: GYAE6OF02GRXXW.41.64.F09.1.454.CMB.1.raw
  modified_base (438)..(438): a, c, t, g, unknown or other
  misc_feature (438)..(438): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacacggcccctggaccgaggacttggagtggatgggacaactcaacccgtggtggtggcaggaccaacgtacgcgacggagttccaggacagagtcaccatcgaccagggacgcgtccgacgagtacagtctattggaattgaggtagagtgagatcngacgacgacggccttatttagtttattaggtgacggaggggtagggggggttgggtcgggtcgttaggaccgttaccgggccccggttaggtacggtacgtttacgggtcgggggtacccacgggggtacccttcgggg

SEQ ID NO: 210112 - DNA, 988 bp, Homo sapiens
  misc_feature: GYAE6OF02J1COY.41.64.F09.1.454.CMB.1.raw
  modified_base (203)..(203): a, c, t, g, unknown or other
  misc_feature (203)..(203): n is a, c, g, or t
  modified_base (258)..(258): a, c, t, g, unknown or other
  misc_feature (258)..(258): n is a, c, g, or t
tcagtctatactatcacgaccggtgctcgatttagcgcgtatacaaggggcatcatccaacaaccacatcccttctctacagaagcctctgagaggaaagttcttcaccatggactggacctggagggtcttctgtcttgctggctgtagctccgaggtgctcacctcccgaggtgcgtagttggtgcgtagtcggtcggggngttggaggtaggaaggacggccgtggggccttacgagttacgtaaacttttccgngacccgaggcagttcgtaggtacttacctaccttcacgtacgtaccttaacttaacgtacttacccgtacggtcgggtcggaccggtaaccgaccgggtcccccgttagggaaccggtaacgggtacgttttagggaacgggttggtaaccgggttacgggaaaccctaaccggttacccggtaaccccggtttgggggttccgggttaaccggaaccggtaacgggtaaaaccccgtaacccggttaaccggaccggtaaaccggggttaaccgttaccggaacgggtaacctaaacgggtaccgtacccggaaaccgtaacggttaaccgggaacccggtaagggtaacccccgtaaccgggtacccggtaaacgggtaaacggtttacccgtaaggtttttacccggttaaggttttaacgggtaaacgtttacggggaagggttaaacggtagggttaacgtaaggtacccggtttaacgggttaaccggaaccgggtaaccccggtttaacgggttaaccttttaaagtttttaccgggtttaaagtttccgggggaggggttaaccggggggaaggggggggtttcggggggttacccggggtttacgggtcggtaaccggttaaccggtcccccgggttaccgggtttaaggttaccggttaaccgggttacccggggtcccgggtaaacccgggttaacccggggtaccccgtttaccgggg

SEQ ID NO: 210113 - DNA, 541 bp, Homo sapiens
  misc_feature: GYAE6OF02HFUBF.41.64.F09.1.454.CMB.1.raw
  modified_base (471)..(471): a, c, t, g, unknown or other
  misc_feature (471)..(471): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacaactcaaccgtggtggtggcaggacaacctacgcacggaagttccaggacagagtcaccatgaccgagggaccacgtccgcgagtacagtctagtttggaattggaggagagtgagatcgtagacgacacgggcctatttattatgtgcggagggnggggggtgggtcgcgtggacgtaccggcccgtggtcgacgttacggtggggacccgtagggaccctcggg

SEQ ID NO: 210114 - DNA, 628 bp, Homo sapiens
  misc_feature: GYAE6OF02ILTY1.41.64.F09.1.454.CMB.1.raw
  modified_base (239)..(239): a, c, t, g, unknown or other
  misc_feature (239)..(239): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgctaggttggtgcagtcgtggggctggaggtagaagaagccgtggggcctgagtagaaaatttccgngccaggcatcgtaggatacaccttcatgacctatatacgcacgtggncganacggccctggacgagtacttgagtgaggtcggaacacgtaccgaaccgtggggtgtggacgaacggaaccaaccgtacgacgaacggtaacgttccgaaggaacaggacgtacaaccgagcgaaccgagggaaccaccggtaccggacgtaaacggtataaacggttcttaaggtttacggtaaagttagggaggaagttaggagagtaacttcaggtaaccgacgtacggaccttaattttagtaacgttggcgtaaggagggtaggggggtcggtgacgtagacgtacccgccggtatacggacggtttacggccgggactacggggtacctacgg

SEQ ID NO: 210115 - DNA, 634 bp, Homo sapiens
  misc_feature: GYAE6OF02IOG2Y.41.64.F09.1.454.CMB.1.raw
  modified_base (262)..(262): a, c, t, g, unknown or other
  misc_feature (262)..(262): n is a, c, g, or t
  modified_base (292)..(292): a, c, t, g, unknown or other
  misc_feature (292)..(292): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccgaggtgcagttggtgcagtcgtggggctggaggtgaagaaggccgtggggcctcagtagtaaaatttcgtgccaggcagtctggatacaccttnatcgacctactatactcactgggtgcgacncggccctggacgaggacttggagtggagtgggacaactcgaaccgtgggtggtcggacgagaaccaaccgtacgcgaacggtacgtccgaaggacaggactccacgagtacgaaccgagggaacctacggtaccggacgagtacgtagtcttaagttagaagttggaggagtagtagacgtagtcgacggacgaaccgacggtactagtttaatttagtcggtaggtacgggtaaggggtacgggggggttggggtccgtcgggtacggtaccggtaaccggtccccgggtagtacggtacgttaccgggagggggacccggtacgggtaccgttaccgggg

SEQ ID NO: 210116 - DNA, 541 bp, Homo sapiens
  misc_feature: GYAE6OF02IH0SY.41.64.F09.1.454.CMB.1.raw
  modified_base (336)..(336): a, c, t, g, unknown or other
  misc_feature (336)..(336): n is a, c, g, or t
  modified_base (453)..(453): a, c, t, g, unknown or other
  misc_feature (453)..(453): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (478)..(478): a, c, t, g, unknown or other
  misc_feature (478)..(478): n is a, c, g, or t
  modified_base (521)..(521): a, c, t, g, unknown or other
  misc_feature (521)..(521): n is a, c, g, or t
tcagtctatactatcacgaccggtgctcgatttagcgcgtatacaagggggcgatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactaatatccactgggtgcgacaggcccctggacgaggacttgagtggatgggacacgtcaacccgtggtcggnggcgacggacaacctacgacacggaacgttccgaggacagagtcaccgatacgaccgagggacacggtccgcgagtacagtctagtttggaattgaggagaggtgagatcgagacgnacggcctatttatntgngngagggnggggggtgggtcgcgtgactaccgcccgtgcgtacgttacggnggggcctagggaccctcggg

SEQ ID NO: 210117 - DNA, 621 bp, Homo sapiens
  misc_feature: GYAE6OF02GUF8L.41.64.F09.1.454.CMB.1.raw
tcagtctatactatcacgaccggtgctcgatttagcgcgtatacaagggggcgatcatccaacaaccacatcccttctctacagaagcctctgagaggaaagttcttcaccatggactggacctggagggtcttctgcttgctggctgtagctccaggtgctcactcccaggtgcagttggtgcagtctgggctgaggtgaagaagcctggggcctcagtgaaaatttcctgccaggcatctggatacaccttcatgacctactatactcactggtgcgacacggcccctggacgaggacttgagtggatgggaacactcaacccgtggtggtgcgaggacaacctacgacgaacggaacgttaccaaggacaaggacgtacaccagtcgaaccaagggaccacggtccgcggaagtacagttacctatttacgggaaattcgggaaggtacgagttggaagtatcgtagaaccggaccgaccggaccttaagtttttatacgtttggtacgggacggtaaggggtgggggggggttcgggtacgtcgtaggtacccgtacccggtcccggttggtacggactttaccgggcggggacccgacggggtaacccccttgggg

SEQ ID NO: 210118 - DNA, 606 bp, Homo sapiens
  misc_feature: GYAE6OF02IWLAL.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctgggctgaggtgaagaagcctggggcctcgagtgaaaatttcctgccaggcatctggatacaccttcatcgacctacatactcccactgggtgcgacacggcccctggacggaggacttgaggtggatgggacaactcaacccgtggtggtggcagggacaaccgtacgcgaacggaagttccaggacagacgtcaccatcgaccgagggacaccggtccgacggagtacagtctagttaggtaattggaggagtaggtgagagtctaggacgacgacggtacctatttagtttagtaggtgtacgggtaggggtaggggggggttcggggtcggtcggttacggacccgtaaccggtccccggttaggtacggtacggtttacggtccgggggaccgtacggggtaaccccgttcggg

SEQ ID NO: 210119 - DNA, 798 bp, Homo sapiens
  misc_feature: GYAE6OF02IJAJY.41.64.F09.1.454.CMB.1.raw
  modified_base (264)..(264): a, c, t, g, unknown or other
  misc_feature (264)..(264): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttcgtgcttgctggctgtagctccaggtgctcactcccgaggtgctaggttggtgcagtcgtggggctggaggtgaagaagccgtggggcctcgagtagaaatttcgtgccgaggcatcgtggatacaccttnatgacctactatactccacgtgggtcgacggacgacggccccctagggaaccggacggtaccgttggaggtgggagtcggggaactaaccgtccgaacccgttgggtgggtcggacgacgggaccaaaccgtacggaccgaacgggaacgttccgaacgggtaacacggtaacgtaccgaacctaacgtacgggaaacccgaaggggtaacccaacccgggtcccgacggtacggtaacgtaacggtttccttaagtttacgggaaagttttaggaacggggtataacgggttgggaaagttaacgttccggttaaacgggaaccgaaacccgggtaacccgggtacccgtttaaagtttttttaacgtaacgggttttaggaccggggtaacgggtaaggggggggtaccgggggggggggtggggttacccgtacgggttacgggaacccggttacccgggtaccccgggtggtttaaccggtacggttaccgggtaccgggggtacctaaccggggggtacccctcggggg

SEQ ID NO: 210120 - DNA, 616 bp, Homo sapiens
  misc_feature: GYAE6OF02GXF73.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctgaggtgaagaagccgtggggcctcgagtagtaaaatttcctgccaggcatcgtggatacaccttcatgacctactatactccacgtgggtgcgacacggccccgtggacgaggtacgttgaggtggagtggacctaacgtccaacccgtgggtcggtcggacgaggaaccaaccgtacgacgaacggtacgttccgaggacgagacgtaccaccgagtcgaaccgagggaccaccggtccgacgaacgtacagttacttagtttggaattggaggtagagtgagtatcgagaccgacgacgtacttaattttattagtgtacgcggtaggggtgggggggtgggtccgcgtacggaccgtaccggcccggttgtacggtacggttaccgggaccggggaccgtacgggtaccccgttacgg

SEQ ID NO: 210121 - DNA, 541 bp, Homo sapiens
  misc_feature: GYAE6OF02IXPYH.41.64.F09.1.454.CMB.1.raw
  modified_base (460)..(460): a, c, t, g, unknown or other
  misc_feature (460)..(460): n is a, c, g, or t
  modified_base (470)..(470): a, c, t, g, unknown or other
  misc_feature (470)..(470): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctgggctgaggtgaagaagcctggggcctcagtgaaaatttcctgccaggcatctggatacaccttcatgacctactatactccactgggtgcgacgaggcccctggacgaggacttgagtggatgggacaactcaacctggtggtgcgagacaaccgtacgcacggagttccgaggacagacgtcaccatgaccgaggacacgtccgcgagtacagttctagttaggaattggagagagtgagatcgagacgacacggcctatttattattgngcggtagggnggggggttgggtcgcgttcggacgtcggccccgttgtcgtacgttacgcggggaccgagggtacccgtcgg

SEQ ID NO: 210122 - DNA, 638 bp, Homo sapiens
  misc_feature: GYAE6OF02HEY4H.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtagaaatttctgccaggcatctggactacaccttcatcgacctactatactaccacgtgggtcgcgaccacggccccgtggacgaggacttggaggtggagtcgggacaacgtccaacccgtgggtggtcggacgaggacaaccgtacgacgacggaacgttccgaaggacagagtcaccgagtacgaccgagggaccacgtccgacgagtacagttcttaagtttagaattggaaggtagtaggtgagatcgtaggaccgaccgacgtaccgttagtttagtttagttggtacggtacgggagggggtaggggggggttcggggtaccggtcggttacggaccggtaaccgggtccccggtaggttacggttacgttacgggtaccggggtacccggtacggggtaccccgttccggg

SEQ ID NO: 210123 - DNA, 557 bp, Homo sapiens
  misc_feature: GYAE6OF02FYMWA.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacgacggccccgtggacgaggacttggaggtggagtgggacaacgtccaacccgtggtggtggtacgacaaccgtacgacacggaagttccgaggacagacgtcaccatacgaccgagggaccacggtccgcgagtacagtctagttggaattgaggagaggtgagtatcgtagacgacacggctatttattagttgtgcgaggggtaggggggtgggcgcgtgacgtccggcccgtgtagacgttacggcggggaccacgggtaccctggtacccg

SEQ ID NO: 210124 - DNA, 567 bp, Homo sapiens
  misc_feature: GYAE6OF02FNY34.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccatgggtcgcgacacggcccctggacgaggacttgagtggatgggacaactcaacccgtggtggtggcaggacaacctacgcacggagttcaggacagagtcaccagtcgaccgagggacacggtccgcgagtacagtctagtttggaattggaggtagagtgagtatctggacgacgaccgcctaatttactttagttcgtgacggagggacgggggggttcggggtcggtcgtaggaccgtaccggccccgttggttacgacgtttaccggcggggtcctacggggacccttcggg

SEQ ID NO: 210125 - DNA, 539 bp, Homo sapiens
  misc_feature: GYAE6OF02F09BH.41.64.F09.1.454.CMB.1.raw
  modified_base (431)..(431): a, c, t, g, unknown or other
  misc_feature (431)..(431): n is a, c, g, or t
  modified_base (452)..(452): a, c, t, g, unknown or other
  misc_feature (452)..(452): n is a, c, g, or t
  modified_base (466)..(466): a, c, t, g, unknown or other
  misc_feature (466)..(466): n is a, c, g, or t
  modified_base (517)..(517): a, c, t, g, unknown or other
  misc_feature (517)..(517): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggcttgagtggatgggacaactcaaccctggtggtggcaggacaacctacgcacggaacgttcgagtacagagtcaccatgaccagggacacgtccgcgagacagtctattggaattggaggagagtgagtatcngacgcgacggcttatttattnttgtgacgtagggngggggggtgggtcggtcgtgaccgtaccggtcccgtggtcgagtttacggngggaccgtacgggaccctcggg

SEQ ID NO: 210126 - DNA, 637 bp, Homo sapiens
  misc_feature: GYAE6OF02JJLCV.41.64.F09.1.454.CMB.1.raw
  modified_base (279)..(279): a, c, t, g, unknown or other
  misc_feature (279)..(279): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgccagtctggggctgaggtgagaagcctggggcctcagtgaaaatttcctgcctaggcatctggatacaccttcatcgacctactatatccatgggtncgacacggcccctggacgaggacttgagtggatagggacaactcaacccgttgggtcggtcggacgacgggaccaaccgtacggacaacgggtaacgttccgagggacagacgtacaacctatcgaaccagggtacacgtccgacgagtacgagttctaagtttcggaatttcggaaggtacgaagtagacgtaagtcgtacggaaacgaccgtaccggtaaccttaacttttaagtttacgttagttcgggaaccgggtaggggtaacgggggggttcgggggctaaccggtagaaccggtcccggtacccggttgtacgtacgttaccggtgggacccgtacgggtacccctaggg

SEQ ID NO: 210127 - DNA, 524 bp, Homo sapiens
  misc_feature: GYAE6OF02FIP7R.41.64.F09.1.454.CMB.1.raw
  modified_base (232)..(232): a, c, t, g, unknown or other
  misc_feature (232)..(232): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (508)..(508): a, c, t, g, unknown or other
  misc_feature (508)..(508): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctgggggcctcagtgaaaatttccngccaggcatctggatacaccttcatgacctactatatccactgggtgcgacaggcccctggacgaggacttgagtggatgggacaactcaaccctggtggtggcaggacaacctacgcacggaatccgaggacagagtcaccatcgaccagggcacgtcgcgagtacagtctagttggaattgaggagagtgagatcgtagacgacgacggcctagtttatattgngngagggaggggggtgggtcgctggacctacggcccgtgtcgagttacgngggccagggaccctgg

SEQ ID NO: 210128 - DNA, 560 bp, Homo sapiens
  misc_feature: GYAE6OF02HC8YI.41.64.F09.1.454.CMB.1.raw
  modified_base (278)..(278): a, c, t, g, unknown or other
  misc_feature (278)..(278): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtncgacacggcccctggacgaggacttggagtggagtgggacaactcaacctggtggtgcaggacaacctcgcacggaagtccgaggacagacgtcaccatgaaccagggaccacggtccgacgagtacgagttctagtttggaatttggaggtagagtgagatcagaccagacggcctattttatattgtgacggtaggggtagggggggtcgggtcgcgtaggaccgtccggtccccggtgtacggtacgttcgggcggggacctacggggaaccctcgggg

SEQ ID NO: 210129 - DNA, 565 bp, Homo sapiens
  misc_feature: GYAE6OF02J2R4G.41.64.F09.1.454.CMB.1.raw
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (470)..(470): a, c, t, g, unknown or other
  misc_feature (470)..(470): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatactcccactgggtgcgacgacggccccgtggacgaggacttggagtggagtgggacactcaacccgtggtggtggcaggaccaactacgcacggaacgttccgaggacagagtcacatcgaccagggacacggtcgcgagtacagtctattggattgaggagagtgaanttnagacgacgacggcctaattttagtattggagnggtaggggtagggggggtggggtaccgtggtacgacgtacccggtcccgtggtacgtacggtacggtcggggtacccgagggtaaccccttcggg

SEQ ID NO: 210130 - DNA, 559 bp, Homo sapiens
  misc_feature: GYAE6OF02I2B82.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctgggctgaggtgaagaagcctgggcctcagtgaaaattcctgccaggcatctggatacaccttcatgacctactatatcactggtgcgacaggcccctggacgaggacttgagtggatgggacaactcaacccgtggtggtggacaggacaacgtacgcacggaagttccaggacagacgtcaccatcgacaggacacgtcgcgaagtacagtctattggaatgagagagtgagatcgagacgacacggacctattttaatcgttagtagacggagggtagggggggtacgggtcgtcggtagtaaccgtaaccggccccgttaggtacgtaacggttaccgtgggggaccctaaggggaaccccttccggg

SEQ ID NO: 210131 - DNA, 573 bp, Homo sapiens
  misc_feature: GYAE6OF02JC65J.41.64.F09.1.454.CMB.1.raw
  modified_base (397)..(397): a, c, t, g, unknown or other
  misc_feature (397)..(397): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacaactcaacccgtggtggtggcaggacaacctacgcacggaacgttccaggacagagtcaccatgaccagggaccaggtccgngagtacagtctagttggaattgaggagagtagagatcgtagacgacgacggcctatttattattgtgacggaggaggggggggtgggtacgtcggtcggaaccgttaccggccccggttaggtacggtacgtttaaccggtcgggggacccgtaaccgggggtaccccttacgggg

SEQ ID NO: 210132 - DNA, 697 bp, Homo sapiens
  misc_feature: GYAE6OF02H20Q0.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctggaggtgaagaagccgtggggcctcagtagaaaatttcctagccaggcatctggactactaccttcatcgacctactatactccacgtgggtagccgacgacggtcccctaggacggagtacgttgagtggagtcgggaactaactccgaacccgtggtaggcggcaacggacaaccgtacgaccgaacggtaacgtccgaacggacagacgtacaaccgagtacgaaccgacgggacaaccggtacgacgtagtacgtacgtattagtttaggaattcggaaggtaggtaagtaggagtacgttcgtacggaaccgaccgaccggtaccttaagttttaagtttagttcggtacggtaccggggtaaggggtacggggggggtacggggttccggtaccggttacggtaccccggtacccggtacccccggttagggttacggtaaccggtttaccggggtccggggtaccccggtaacgggggttaccccttacccgggg

SEQ ID NO: 210133 - DNA, 686 bp, Homo sapiens
  misc_feature: GYAE6OF02IM8YI.41.64.F09.1.454.CMB.1.raw
  modified_base (238)..(238): a, c, t, g, unknown or other
  misc_feature (238)..(238): n is a, c, g, or t
  modified_base (293)..(293): a, c, t, g, unknown or other
  misc_feature (293)..(293): n is a, c, g, or t
  modified_base (339)..(339): a, c, t, g, unknown or other
  misc_feature (339)..(339): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcacctccaggtgctagttggtgcagtcgtgggtctggaggtgaagaagccgtggggctcgtagtagtaaatttccgngccgagccatcgtaggataccgaccttacatcgaacctatatactcacgtggtanaccgacgaccggccctggaacggtaggacgttgagtggacgagganaccgtacgtacccgtgggtacggtggacgaacggaaccaaccgtacggaccgaacggtacgtaccgaggaacgagacgtcaaccgatacgaacgacggaacgtaccggtaccggacgtaagtaacgagttacgttaagttacggtaagttacggtaaggacggtaaggtagaagtacggttgaaccggtaacggacctaaccggaccttaacgttttagtaccgtttaggtacgtgggtaaggggtacgggggggttggtcggtacggtacgtaccggtaacccggttcccggtggttaacggtaggttaccggtaggggtaaccggtaccgggacccgttaccggg

SEQ ID NO: 210134 - DNA, 524 bp, Homo sapiens
  misc_feature: GYAE6OF02G4SH6.41.64.F09.1.454.CMB.1.raw
  modified_base (454)..(454): a, c, t, g, unknown or other
  misc_feature (454)..(454): n is a, c, g, or t
  modified_base (498)..(498): a, c, t, g, unknown or other
  misc_feature (498)..(498): n is a, c, g, or t
  modified_base (506)..(506): a, c, t, g, unknown or other
  misc_feature (506)..(506): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaattcctgccaggcatctggatacaccttcatgacctactatatccactgggtgcgacacggcccctggacgaggacttgagtggatgggacaactcaacccgtggtggtgcaggacaacctacgcacggagttcgagacagacgtcaccatgaccagggacacgtccgcgagtacagtctattggaatttgaggagtgtgagtatcgtgacgacgacgcctaatttattnttgtgacgagggaggggggtgggtcgcggtgacgtcgcccgtgngtattcgngggccacgggtacctcgg

SEQ ID NO: 210135 - DNA, 591 bp, Homo sapiens
  misc_feature: GYAE6OF02JNEOF.41.64.F09.1.454.CMB.1.raw
  modified_base (232)..(232): a, c, t, g, unknown or other
  misc_feature (232)..(232): n is a, c, g, or t
  modified_base (269)..(269): a, c, t, g, unknown or other
  misc_feature (269)..(269): n is a, c, g, or t
  modified_base (475)..(475): a, c, t, g, unknown or other
  misc_feature (475)..(475): n is a, c, g, or t
  modified_base (523)..(523): a, c, t, g, unknown or other
  misc_feature (523)..(523): n is a, c, g, or t
  modified_base (536)..(536): a, c, t, g, unknown or other
  misc_feature (536)..(536): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgctagttggtgcagtcgtgggctgaggtgaagagccgtgggcctcagtagtaaatttccngccaggcatcgtggactacactcatcgacctacttanattccgacgtgggtcgaccgacgacggcccccgtaggacggacggtacgttggaggtggtacgtggaaccaaccttaccgaacccgtgggtcggtacggcgaagggtaaccgaacctacgacgtaacggaacgtccgaaggacgagacgtacacgtatcggacaggactacgacgacgagtacagtacttagtaggatgtaggagngtagatagtcgagacgacgacgtacttatttagtagtgtgaggcgggngggggtaggtcgnggtacgacgtccgccgttagaggtacgttacggacgggtcgtaacggccgtacgg

SEQ ID NO: 210136 - DNA, 663 bp, Homo sapiens
  misc_feature: GYAE6OF02HZYQU.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctgaggtgaagaagccgtggggcctcgagtagtaaaatttcctgaccgaggcatcgtaggactactaccttcactcgaacccttactatactcccacgtgggtgacgacgacggccccgtggaacgaggtacgttggagtggagtacgggacaactactaaccgtggtggtggacgacggacaacctacggacgaacggtaacgtccgaaggacagacgtacaccagtcgaccgacgggacaccggtccgacggacgtacacgttacgttagtttaggaagttggaaggtaggtagtagtaagattacgtagaacgaacgacggtaccttaagttttattagttggtacgggtacgggtaggggtacggggggggttcgggtacggcggttacggtaccgtacccgggtcccgttggtacggttacggttaccgggtcggggtacccgtaccggggtaccgttacccggg

SEQ ID NO: 210137 - DNA, 522 bp, Homo sapiens
  misc_feature: GYAE6OF02F1U77.41.64.F09.1.454.CMB.1.raw
  modified_base (387)..(387): a, c, t, g, unknown or other
  misc_feature (387)..(387): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (472)..(472): a, c, t, g, unknown or other
  misc_feature (472)..(472): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctgggctgaggtgagaagcctgggcctcagtgaaaatttcctgccaggcatctggatacaccttcatgacctactatatccactgggtgcgacaggcccctggacgaggcttggagtggatgggacaactcaaccctggtggtggcaggacaacctcgcacggagttccaggacagagtcacatgaccgaggacacgtcgngagtcagtctattggattgaggagagtgagtntcgnggacgacgacgctagtttattattgagcggaggtaggggggtgggtcgngtgacgtccgcccgtgtgtacgttacggtgggcctacgggacccttcggg

SEQ ID NO: 210138 - DNA, 901 bp, Homo sapiens
  misc_feature: GYAE6OF02IEZ45.41.64.F09.1.454.CMB.1.raw
tcagtctatactatcacgaccggtgctcgatttagcgcgtatacaagggggcagtcatccaacaaccacatccctttctctacagaagcctctgagaggaaagttcttcaccatggactggacctggagggtcttctgcttgctggctgtagctccaggtgctcactcccaggtcgcagttggtgcagtcgtggggctggaggtgaagagccgtggggcctcagtgaaaatttcctcgccaggcatctaggatacacctttcagtgaaccttactactactcccaacgttggggtcgaccgaccgacggtccccgtagggacggagggtaccttggaacggtgggacggttacggggaacctaaaccgtcccgtaaaccccgttggggttcgggtcgggtaccgaacgggtaaccaaacccgttacggaccgaaccgggtaacggtttacccgaacggggtaaccgaacggtaacggtacccgtaacccgtacgttacggaaacccggacggggaacccgtacccgggtacccggaccgggtaagttaaccgacggtttactttacgttttaacgggtaaagtttacgggaaagggtagggtaaggttcgggtaaacggtacgtttaccgggtacgggtaaccgggaaccgtaccggggtaaccccgttttaagtttttttaacgttaacggttttcgggttacgggtaccgggggttaaagggggggttaccggggggggggggttaggggggttacccgggtccggtttaaccggggtaacccggtttaccccggggttaccccccggggtttgggttacccgggttaacgggttttccccgggttaccggggggggaaccccggtttaccgggggaaacccccggttttcccgggggg

SEQ ID NO: 210139 - DNA, 690 bp, Homo sapiens
  misc_feature: GYAE6OF02HRPFI.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaattctgccaggcatctggatacaccttcatgacctactatatccactgggtgcgacgacgcccctaggacgaggacttgagtggatgggacaactcaaccctggtggtggcaggacaacctacgcgaacggaagttccaaggacaagagtccaacatacggacgagggaccaacgggtcccgacgaagtacgaagttacttaacgttttagggaaactttgggaagggaaaggtacggtaggaaacggtacttacgttacgggaaaccgtaaccgacccgggttaacctaagttttttaaacgtttagtggttaacgggaccggtaagggggtacggggggggggttcggggtaccggtaccgttacgggaaccggtttaaccccggccccggttaggttacggttaaggtttacccggttacggggggtaccccgtaaacggggggtaccccctttaaccggggg

SEQ ID NO: 210140 - DNA, 712 bp, Homo sapiens
  misc_feature: GYAE6OF02HNJI1.41.64.F09.1.454.CMB.1.raw
  modified_base (258)..(258): a, c, t, g, unknown or other
  misc_feature (258)..(258): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctgaggtgaagagccgtggggcctcgagtagtaaaatttcctgccaggcatctggatacaccttnatcgacctactatactccagtggtgacgacgacggccccgtggacgaggtacgttgaggtggagtagggaacaacgtccaacccgtgggtggtggcgacggacaccgtacgcgaacggtacgttccgaggacgagacgtcaaccagtacgaccgacgggacctaccgtccggacgacgtacgtacgttcttaacggtttaggaacgttaggagggtaagtaggtagagtaggtacttacggaacggtaaccgaccgggttacttaattttaagtttagtttcggtacgggtacggggtacgggggtaggggggggggtttcggggttaccgggtacggttaccgggtacccggttacccggggtccccgggtttagggttaccggttacgggtttacccggggtaccgggggtaaccccgggttaaccgggggtaacccccgtttacccggggg

SEQ ID NO: 210141 - DNA, 594 bp, Homo sapiens
  misc_feature: GYAE6OF02GF0MF.41.64.F09.1.454.CMB.1.raw
  modified_base (235)..(235): a, c, t, g, unknown or other
  misc_feature (235)..(235): n is a, c, g, or t
  modified_base (358)..(358): a, c, t, g, unknown or other
  misc_feature (358)..(358): n is a, c, g, or t
  modified_base (455)..(455): a, c, t, g, unknown or other
  misc_feature (455)..(455): n is a, c, g, or t
  modified_base (518)..(518): a, c, t, g, unknown or other
  misc_feature (518)..(518): n is a, c, g, or t
tcagtctatactatcacgaccggtgctcgatttagcgcgtatacaagggggcatcatccaacaaccacatcccttctctacagaagcctctgagaggaaagttcttcaccatcggactggacctggagggtcttctgcttgctgggctgtagctccaggtgctcactcccaggtgcagttggtgcgagtctggggctgacggtgaagaagcctggggcctcagtgaaaatttccngccaggcattctggatacaccttcatgacctactatatcctacgtgggtgcgacacggcccctggacgaggacttggagtggagtgggacactcaacctggtggtcgcgaggacaaccgtacncacggacgttccaggactagacgtcaaccgagtcgaccggagggaccacggtccgacggaagtacagttcttagttggaattggaggagagtcgagntctgaacgacgacggcctaagtttattagttgtagcggtagggtggggggggtagggtccggngttacggacgtaacccggccccggttaggtacggtacgttacggtaccggggtccgaaccggggtacccttcgggg

SEQ ID NO: 210142 - DNA, 584 bp, Homo sapiens
  misc_feature: GYAE6OF02F2A3D.41.64.F09.1.454.CMB.1.raw
  modified_base (400)..(400): a, c, t, g, unknown or other
  misc_feature (400)..(400): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttggagtggatgggacaactcaacctggtcggtggcaggacaacctacgacgacggagttccgaaggacagagtaccaccgatcgaaccgacgggaaccnccggtaccgcggaagtaccgaggttctagtttaggaatttggaaggtgagtgagtagtcgtagacgacacggcctatttattattgtagcgggtagggagggggggtgggtaccggtgtcggaacgtccggtacccgttgtaggtacttaacgggtcgggacccgtacgggaacccgttccggg

SEQ ID NO: 210143 - DNA, 626 bp, Homo sapiens
  misc_feature: GYAE6OF02HK03H.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtgggctgaggtgaagaagcctggggcctcagtgaaaatttcctgccaggcatctggatacaccttcatgacctactatactccacgtggtgcgacacggcccctggacgaggacttgagtggagtggacaactcgaacccgtggtggtggacgagggaccaaccgtacgcgaacggtacgttcgaaggacagacgtacaccagtcgaccgagggaccaccggtccgacggaagtacgagttcttagtttaggaagttggaggtagagtgagtatcgtaggacgacgtaccggaccttaattttacgtttaagttggtacggacgggtagggggtaggggggggttcggggtacggtcggtacggtaccgtacccggtccccggtaggttacggtaggttaccggtcgggggacccggtacggggtaccccgttcgggg

SEQ ID NO: 210144 - DNA, 662 bp, Homo sapiens
  misc_feature: GYAE6OF02FS2N4.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctgggctgaggtgaagaagcctggggcctcagtgaaaatttcctgccaggcatctggatacaccttcatgacctactatatccactgggtgcgacaggcccctggacgaggacttggagtggagtgggacaactccaaccctggtggtcggcaggacaacctacgcgacggaacgttccgaaggacacggagtcaccatcggaccaagggacacgtccgacggacgtaacacgttcttaattgggaatttggaggagtagtagagagtctaggaacgacgtaccgggaccttagttttaagttacgtttaggtacggtccgggtaagggggtacggggggggggttcggggggttaccggtacgggttacgggtaacccggttaaccccgggtcccccggttagggttacggtaacgttttaccgggtaccggggggtacccggttaacccggggggtaaccccgtttaccggggg

SEQ ID NO: 210145 - DNA, 655 bp, Homo sapiens
  misc_feature: GYAE6OF02I7JTI.41.64.F09.1.454.CMB.1.raw
  modified_base (246)..(246): a, c, t, g, unknown or other
  misc_feature (246)..(246): n is a, c, g, or t
  modified_base (501)..(501): a, c, t, g, unknown or other
  misc_feature (501)..(501): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcacctcccaggtgcagttggtgcagtctggggctggaggtgaagaagccgtggggcctcgagtagaaaactttcctgccaggcanctgatacaccttcatgacctactatatccacgtggtgcgacacggcccctggcgaggcgtggaggtcggagtacgggacaaccgtacgaacccgtggtcgggtggacgaagggaacctaaccgtaccggacgaaccgggtaacgttcccgaaagggacaagtacgtaccaacccgtagtacggaaccggacgggaacaccgggtcccgagacgttacacgttactagttacgtaagtggaggaggagtagacgtntacgtaggaaccacgacgtacttagttttagttaagttgagggtagggagggggtagggggggtcgggtcgtcggtcggtaccgtaccgggttccccgttggtacggttaacgtccgggtacgggggacccgtaaccggggtacccgttacggg

SEQ ID NO: 210146 - DNA, 691 bp, Homo sapiens
  misc_feature: GYAE6OF02HZ8QM.41.64.F09.1.454.CMB.1.raw
  modified_base (301)..(301): a, c, t, g, unknown or other
  misc_feature (301)..(301): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcaggttggtgcagtcgtggggctggaggtggaagaggccgtggggcctcgagtagtaaatttcctggcctaggctatcgtggatacacctttcatgacctatactactaccacgtgggtcacggaccnccggaccccgtgggaacggaggtaccttggaggtggagtacggggacaacgtaccaaccgtgggtcggtggacgacggaactaaccgtcgaccgaacgggtaacttcgagggacaggacgtacaaccgatacgaacgacgggacaccggtaccggacgactaacgcgttacgttagttttagggaacttacgggtaagggaacgtagggttaacgagtacgttacgtacggtaacggacgtaaccgggtacctacgttttaaacgttgttacggtacggtacgggaagggggtacggggggggtttcggggtacggtccggtacggtaaccgtccggtacccggtggtacggtacgttacgggcgggtacgaccgggggtccttaccggg

SEQ ID NO: 210147 - DNA, 776 bp, Homo sapiens
  misc_feature: GYAE6OF02JWHPK.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcaggttggtgcgagtcgtggggctggaggtgaagagccgtggggcctcgagtagtaaagttcctgccaggcagtcgtggactaccgtaccttcacttcgacctactaactactccaacgttgggtacgacgtacgaccggtccccgtaggaccggtaggtaccttggtacggtggtacggtacgggaacctaaccgtaccgtaaccccggttggggtacggtacggaccggaacgggtaaccctaaaccccgtacggaccggaaaccgggtacgttacccggaacggtaaccggaggtaaccggtaccaaccggacgttacggaaccgaacgggaccgaccggttaccggacggtaacgtacgtacgttcgtaagttttaggaagttagagggtacgtaaggttaggagtacgtcgtacggaacgtaccggaacgtctttaacgttactttaacggttaggtacgggtacgggaagggggtgggggggttacgggggttacggtcgggtaacggtaccggttacccgggcccgggtttaggtacggttaaccgggttaacggttccggggggtaacccgttaccgggacccgggttacccggg

SEQ ID NO: 210148 - DNA, 594 bp, Homo sapiens
  misc_feature: GYAE6OF02HJKKM.41.64.F09.1.454.CMB.1.raw
  modified_base (236)..(236): a, c, t, g, unknown or other
  misc_feature (236)..(236): n is a, c, g, or t
  modified_base (262)..(262): a, c, t, g, unknown or other
  misc_feature (262)..(262): n is a, c, g, or t
  modified_base (421)..(421): a, c, t, g, unknown or other
  misc_feature (421)..(421): n is a, c, g, or t
  modified_base (464)..(464): a, c, t, g, unknown or other
  misc_feature (464)..(464): n is a, c, g, or t
  modified_base (504)..(504): a, c, t, g, unknown or other
  misc_feature (504)..(504): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctgaggtgaagaagccgtggggcctcgagtagtaaaatttacncgccaggctatcgtggatacaccttnatcgaccttatatactccacgtgggtgacgacgacggcccctaggacgaggacttgagtggagtgggaacaaccgtcaacccgtgggtcggtggacgaggaaccaaccgtacgacgaacggagttccgaggacagatacaccatagaccgagggaaccnccggtaccgacgacgtacagtacttagttagaattggaggagngtgagatagtacgagacgacggtacctagtttattgtggngtacgggagggtaggggggttcgggtcggcgtggacgtaccggcccgtgtacgtacggtacggtcgggtaccgtacgggtacccgtacgg

SEQ ID NO: 210149 - DNA, 677 bp, Homo sapiens
  misc_feature: GYAE6OF02GVJVW.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctggaggtgaagaagccgtggggcctcagtagtaaaatttcctgccaggcatctggatacctaccttcatcgaccttactatactccactgggtcgcgacacggcccctaggacgaggtacttggagtggagtcgggacaactccgaccgtggtggtcggcgaaggtaccaaccgtacggacgtaacggaacgttccgaaggacgaaggacgtaccaacctaagtacggaccgaagggaccctaccggtcccggacggaagtactagtacttaagtttaggaagttaggaaggtaagaggtaggacgtagttccgtaggaacccgtcgaaccggttaccttaagttttatttaacggttggtacggacgggtaaggggtaggggggggttcggggtaccgtacggttaggacccgttaccggtccccggttggtacgttacggttaccgggtccggggaaccgtaccggggtaaccccgttcggg

SEQ ID NO: 210150 - DNA, 702 bp, Homo sapiens
  misc_feature: GYAE6OF02F5QQ0.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctaggatacaccttcatgacctaacttatactaccacgttggggtcgcgacacggtcccccgtaggacggaggtaccttggaggttggagtagggacctaactccgaaacccgttgggtacgggtggaccgaaggaccgaaccgtacggacgaacggtaacgttccgagggaacgaacgtacgtacaccagtacgacccgagggaccgaccggtccggacgtacgtacacgtaccgtttagttacggtaagttacggtaggaagtacggtaggaaggtattcgtacggaccgtacggaaccggacctttattttaatttagttggtacggtacgggtaaggggtacggggggggttaggggtccggtacggtaccgggtacccggttaacccggtcccggttaggttacggtacggtttacccgggaccggggtaccgggacccgggttaacccgtccgggg

SEQ ID NO: 210151 - DNA, 859 bp, Homo sapiens
  misc_feature: GYAE6OF02JE284.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggaggtcttctgcttgctggctgtagctccaggtgctcactcccaggtgcagttggtgcagtctgggctggaggtgaagagcctgggcctcagtagaaatttcctgccaggcatgtggatacaccttcatcgtacctactatactccgacgttcggtgcgacacggacccctgggaacgacggtaccgttggacgttgggagtaggggtaactaacctccgtaaaccccgttggggttagggttcgggaccgaaacgggtaacctaaaccggttaacccggaccggtaaccggggtaaaacggttttaccccggaaagggggaacccgtaagggtaaaccgttacccgaaacccgtaagtaacccggggtaaaccccggaacggggaaacccgtaaccccgggttaccccggaacgggtaaaccggtaaaccgtacgggtttacccgtttaaaggttttacggggttaaacgttagggaacggggtaacggtaacggttagggtaaacggtactttccgtaagggtaacccggaaccgtaacccgggtaaccctttaagttttaactttaacgggtttcggtacgggtcggggtaacggggtaagggggggggggtttccgggtccggtaacggttacggggtaacccgttaccccggacccggtttacggttaacggttaacgggtttaccggttacgggggacccgggtaaccgggttaccccggttacccggg

SEQ ID NO: 210152 - DNA, 963 bp, Homo sapiens
  misc_feature: GYAE6OF02I7HUT.41.64.F09.1.454.CMB.1.raw
  modified_base (237)..(237): a, c, t, g, unknown or other
  misc_feature (237)..(237): n is a, c, g, or t
  modified_base (261)..(261): a, c, t, g, unknown or other
  misc_feature (261)..(261): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctggaggtagaagaagccgtggggcctcgtagtagaaatttccngccaggcatcgtggatacaccttnatacgaccctaactaactataccctacgttggggtcgaccgtaaccgaccggggtaccccccgttaggggaaccggtaacgggtaaccgtttacgggaaggggtttagggaaggttaccggggaaaccctaaaccgttaccccgtaaaaccccggtttggggttacggggttacggggacccgtaaacggggaaaccctaaaccccggttaccggaacccggaaacgggttaaacggtttacccgaaacggggtaacccgtaacggtaaacggttacccgaacccgtaacttaaccggggaaaccccggtaaacggggtaacccgtaacccgggtaaccgggtaaccgggtaaacggttaaccgtaacggtttaccgttttaaaggttttaacggggtaaacgtttaacgggaaagggtaaacgggttacgggtaacggtaaacggtaacgtttaccgtaacgggaacccgtaaccgtaacccggggtactttaacgtttttaaacgttttaacgttttcgggtaacggtaacggggttaccgggggggttaaggggggggggtttccgggggtaccgggtaccggtttaacgggtaacccggttaaccccggttaccccgggttacggttacggttaaccggtttacccgggtaacccggggggtaacccgtaacccgggggtaaccccgtttacccgggg

SEQ ID NO: 210153 - DNA, 844 bp, Homo sapiens
  misc_feature: GYAE6OF02HFY2E.41.64.F09.1.454.CMB.1.raw
  modified_base (286)..(286): a, c, t, g, unknown or other
  misc_feature (286)..(286): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtgggctgaggtgaagagccgtgggcctcagtagtaaattcctgccgaggcatcgtgactacaccttcatcgacctaatactactccctagtgggtacnccggaacgaccggtcccccgtagggaacggtacggtacgttagagggttcgggacgttacggggaaaccctaaacccgttaccgtaaaccccggttcgggttaggggtaccgggaccgtaaacgggaaccctaaacccggtaaccggaccggtaaacgggtaaacggttacccgaagggtaaccgaagtaccgttaaccgaaccttagacggaaccggaacgggtaaccgacggtacccggacggacgttaccgagttaccgtttaagtttacgggtaagttgggaaacggttaggtaacggggttgtaaaccggtacttacggtaacggtaaccgaaccgtaacccggttaaccgttaagtttttaagttaacccggttaggtaccgggtacggggtaaggggggggttacgggggggggtttacgggtcccgggtaactttacggggggaaaccctttccccgggaccccgggtttaagggttcggttaaccggttttaacccggggaccggggggaaccccgtaaacccggggggtacccctttaacccgggggg

SEQ ID NO: 210154 - DNA, 582 bp, Homo sapiens
  misc_feature: GYAE6OF02G3V0R.41.64.F09.1.454.CMB.1.raw
  modified_base (217)..(217): a, c, t, g, unknown or other
  misc_feature (217)..(217): n is a, c, g, or t
  modified_base (254)..(254): a, c, t, g, unknown or other
  misc_feature (254)..(254): n is a, c, g, or t
  modified_base (350)..(350): a, c, t, g, unknown or other
  misc_feature (350)..(350): n is a, c, g, or t
  modified_base (437)..(437): a, c, t, g, unknown or other
  misc_feature (437)..(437): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttgtgcagtcgtggggctgaggtgaagaagcctggggcctnagtgtaaaattcctgccaggcatctggatacaccttnatgacctaactatatccacgtgggtgccgacacggccctaggacgaggacttggagtggatgggacactcaaccgtggtggtgcagacaactacgngacgacgttcgagtacagatcaccatcgacacgggacacggtcgacgagtacacgtctaagtttggaattaggaggagagtgaagtntacgtaggaccgtacgacggctaagttttacttaagttcggtgacggtgggggacgggggggtcgggtccgtcgtagggtaaccgtacggtaccccggtgttacggtggttacggtcgggggacccttaggggtacccgtacggg

SEQ ID NO: 210155 - DNA, 738 bp, Homo sapiens
  misc_feature: GYAE6OF02HARWJ.41.64.F09.1.454.CMB.1.raw
  modified_base (227)..(227): a, c, t, g, unknown or other
  misc_feature (227)..(227): n is a, c, g, or t
  modified_base (279)..(279): a, c, t, g, unknown or other
  misc_feature (279)..(279): n is a, c, g, or t
  modified_base (466)..(466): a, c, t, g, unknown or other
  misc_feature (466)..(466): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctgggctgagtgaagagcgtgggctcgagtagaaaatttcngccaggcatcgtggactacctaccttcatgacctactatactccatgggttncgactacggcccgtaggaccggtaggtacctggtagtagggacgtgggaactaacctaccaaccgtgggtacggtggacaacgggaacaaccgtacgacgaacgggaagttcccgaaggtaccaaggacgtacccactaactcgaaccgagggaccgaaccgggtccgacggtaactacgaacgttnttaagtttaggaagtttacggagggagtagtagagttagtcgacggtaacgtaaccgtacgggaacctttaagttttaaggtttaagtacggtttacgggaacggggaaacggggggttggggggggggttacggggttaccggtaccggttacgggttaaaccccgggttacccgtaccccccgggggtttgtaacgggttttaccggttaacccggggttaccggggggtttaaccccggacccggggggtttaaacccccgtcccgggg

SEQ ID NO: 210156 - DNA, 606 bp, Homo sapiens
  misc_feature: GYAE6OF02IVCB3.41.64.F09.1.454.CMB.1.raw
  modified_base (285)..(285): a, c, t, g, unknown or other
  misc_feature (285)..(285): n is a, c, g, or t
  modified_base (468)..(468): a, c, t, g, unknown or other
  misc_feature (468)..(468): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagccgtggggcctcagtagaaaatttccgtgccaggctatcgtggactactaccttcatgacctactatactcacgtggtncgacacggcccctggacgaggacttgagtggagtggaacaactaccgaacccgtgggtggtggacgaggaccaaccgtacgcgaacggtaacgttccgaggacagacgtacacctagtacgaccgagggaaccacggtcccgacgagtacagttctaagtttcggaagttgaaggtagagtanagactcgtagacgactacggctaagtttattagttgtgacggaggggtaggggggtcgggtcggacgtacggaccggtcccggtacccggttggtacgtacgttacggcggggtaccgtaaccgggtacccgttcggg

SEQ ID NO: 210157 - DNA, 823 bp, Homo sapiens
  misc_feature: GYAE6OF02IENS4.41.64.F09.1.454.CMB.1.raw
  modified_base (262)..(262): a, c, t, g, unknown or other
  misc_feature (262)..(262): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctgaggtgaagaagccgtggggcctcgagtagtaaaactttcctgccaggcatctggactactaccttnatcgacctactatactcctacgtgggtcgcgacgacggtcccctagggaccgtaggtacttggacggtggacgtcgggaactaaccgtaccgtaacccggttgggtgggtacggaccgtacgggaacctaacccgtacggaccgtaaccgggtaacgttaccggaacgggtaacaacgggtacgtaccgaaccgtaacgtaccggaaacccggacgggaacccgtaaccgggtcccggaacggtaacggtaaccgtaacggttccgtttaaggtttaagggttaaacgtttagggaagggttaaggtaacgggttaggaacggtaagttcggtaacgggtaaaccgtaaccggtaacccgggttacctttaagtttttaacgtttacggttagggtacgggtaacggggtaacgggggggttacgggggggggtttcggggttccggtaccgggttaaccggtaacccgggttaccccgggttaccccggttagggttacggtaccgggtttaaccggggccggggttaacccggtaccggggttaacccggttcccgggg

SEQ ID NO: 210158 - DNA, 526 bp, Homo sapiens
  misc_feature: GYAE6OF02HBDV3.41.64.F09.1.454.CMB.1.raw
  modified_base (468)..(468): a, c, t, g, unknown or other
  misc_feature (468)..(468): n is a, c, g, or t
  modified_base (474)..(474): a, c, t, g, unknown or other
  misc_feature (474)..(474): n is a, c, g, or t
  modified_base (487)..(487): a, c, t, g, unknown or other
  misc_feature (487)..(487): n is a, c, g, or t
  modified_base (509)..(509): a, c, t, g, unknown or other
  misc_feature (509)..(509): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagccgtggggcctcagtagaaaatttcctgccaggcatctggatacaccttcatgacctactatatcccatgggtgcgacacggccccctggacgagggacttggagtggatgggacaactccaacctggtggtggcaggacaacctacgcacggaacgttcaggacagagtcaaccagtcgaccgagggaccacgccgacgagtacagtcttagttggattggaggagagtgagatctgacgacgcggctatttatattgtgngagggngggggtgggtcgngtgctaccgccgtgtgagtcgngggccaggtaccgtcgg

SEQ ID NO: 210159 - DNA, 737 bp, Homo sapiens
  misc_feature: GYAE6OF02I3GSH.41.64.F09.1.454.CMB.1.raw
  modified_base (271)..(271): a, c, t, g, unknown or other
  misc_feature (271)..(271): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctgaggtagaagaagtccgtggggcctcaggtagaaaacgtttcctagcccaggcagtctaggaactaccacctttanatacgtacctactaatactcccacgttcgggtgccgaacgtaaccgggcccccttagggaaccggaaggtaccttggtaacggtgggtactaggggaacctaactaccgaaccccgtgggttaggcggacgaagggtaaccaaccgtacgacgaacggtaaacgttccaagggacacgtacggtaccaaccagtcgaaccgacgggaccacggtacccgacggtagtaaccgagttaccgtagtttaggaagtttacggaggaagttaggacgtacggacttacggtacggaaccgtacgaacgggtacccttaagttttaacgtttaagtttaggtaccggtacggggtaagggggtacgggggggggttacggggtccggtacggttacggttaaccgtacccgggtaccccggtaggtacgtaacgtttaccggtacggggaccctacggggacccgttacgg

SEQ ID NO: 210160 - DNA, 659 bp, Homo sapiens
  misc_feature: GYAE6OF02HLCJQ.41.64.F09.1.454.CMB.1.raw
  modified_base (173)..(173): a, c, t, g, unknown or other
  misc_feature (173)..(173): n is a, c, g, or t
  modified_base (189)..(189): a, c, t, g, unknown or other
  misc_feature (189)..(189): n is a, c, g, or t
  modified_base (293)..(293): a, c, t, g, unknown or other
  misc_feature (293)..(293): n is a, c, g, or t
tcagtctatactatcacgaccggtgctcgatttagcgcgtatacaagggggcagtcatccaacaaccacatcccttctctacagaagcctctgagaggaaagttcttcaccatggactggacctggaggtcttctgcttgctggctgtagctccaggtgctcactcccaggtncagttggtgcagtcgngggctgacggtgaagacgccgtggggctacgagtagtaaaacttcctgccgaggcatcgtaggatactaccttacatacgaccttatactactcctagtcggancggacacggccccgtaggacgaggtactgagtcgagtcggactaacgtacaaccggtggtcggtcggacgaagaccgtaaaccgtaccgacgtaacgggtaacgttccgaacggaacgtacggacgtacccaccgagtacgaaccgagggaccgaccgtcggacgtacgtacaagttccttaaggttcgtaagttgtaacggagtagagtaagcgttacgtagaaccgtaccgaacggtcctaagttttacgtttagtacggtagtacgggtaggggtacggggggtacgggtttcggaacgtcgtaccggtccgtacccggttgaccgttaggttaccgtacgggaccgtacgggacccttacgg

SEQ ID NO: 210161 - DNA, 678 bp, Homo sapiens
  misc_feature: GYAE6OF02F8K97.41.64.F09.1.454.CMB.1.raw
  modified_base (238)..(238): a, c, t, g, unknown or other
  misc_feature (238)..(238): n is a, c, g, or t
  modified_base (355)..(355): a, c, t, g, unknown or other
  misc_feature (355)..(355): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgctagttggtgcagtcgtggggctggaggtagaagaagccgtggggcctcgagtagaaaatttccngccgaggctatcgtggactacctaccttcagtcgtacctactatactcctagtgggtcgcgacgacggcccgtggacgaggtactggagtggagtggacaacgtcaaccgtggtggnggacgagacacctacgacgacggtacgtcgagacgaggtacgtacacgagtacggacgacggtaccaccggttccggacggtagtacgtacgttacgtagtttacggtaagttcggaagggtacgtagtagagtactcgtacggtaccgacgtaccgtacttactttaagttcttgggttacggaacgggttaggggggtacgggggggttcggggtcccgttggtaccgggtaacccgttcccgggaccccggtttggttaccgggttacggttccgggttaccgggggtacccgttaccgggggtaccccgtttaccgggg

SEQ ID NO: 210162 - DNA, 795 bp, Homo sapiens
  misc_feature: GYAE6OF02GB325.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctgaggtagaagaagccgtggggcctcgagtagtaaaactttcctgccgaggcatctggatacaccttacatcgacctactatactcctacgtgggtgccgtaccgacggtccccgaggacgacggtacttaggagtgggacgtacgggaacaaccgtacctaacccggtgggtacgggtacggacgaacggaacccaaccgtaccggaccgaaacgggtaacgttaccggaaggaacgtacggacgttaccgaacccgaacgtacggaaccggaaccggggtaccgtaaccccggtccgggaccggtaacggtaaccgtacgttacgttttaacgttacgggttaacggttaggaagggttaacggacggtaaggtaacgtagtaccgtaacggaaccggtaaccgaccggttaccttaaagtttttacgttaacggtttaggtacggtaaggggtacggggggttaggggggggttacggggttaccggtacgggttaccgggttaaccggttccccgggttccgggttacgttacggttaacggtttaccggggtaccgggggtaaccccggtacgggggtaccccgtttaacccgggg

SEQ ID NO: 210163 - DNA, 553 bp, Homo sapiens
  misc_feature: GYAE6OF02HY5HO.41.64.F09.1.454.CMB.1.raw
  modified_base (256)..(256): a, c, t, g, unknown or other
  misc_feature (256)..(256): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcgagtagaaatttcctagccaggcatctggatacaccttnatcgacctactatatccactgggtgacgacacggcccctaggacgaggacttgagtggatgggacaactccaaccgtggtggtgcgaggacaacctacgcacggagtccaggacagagtcacagtcgaccgagggtaccacggtcgacgagtactagtctagtttggaacttggaggagagtagagtatcgtagacgaacgcgactatttattactgtgcgagggtaggggggtcgggcgtgtacggacgtaccgcccggtgtacgtcgttacgcggggtacacgggtaccctcggg

SEQ ID NO: 210164 - DNA, 544 bp, Homo sapiens
  misc_feature: GYAE6OF02GHMHM.41.64.F09.1.454.CMB.1.raw
  modified_base (399)..(399): a, c, t, g, unknown or other
  misc_feature (399)..(399): n is a, c, g, or t
  modified_base (438)..(438): a, c, t, g, unknown or other
  misc_feature (438)..(438): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacacctcatgacctactatactccactgggtgcgacacggcccctggacgaggacttgagtggatgggacaactccaaccctggtggtggcaggacaacgtacgacacggaacgttccgaggacagagtcaccatgaccagggacacgtccgngagtacagtctagttgaattgaggtagagtgagtatcgngacgacacggtcctaatttacttatgtgcgagggaggggggtgggtcgcgtgaccgtaccggtcccgtggtacgtacgttacgcggggaccgaggggtaccctggg

SEQ ID NO: 210165 - DNA, 695 bp, Homo sapiens
  misc_feature: GYAE6OF02H13SI.41.64.F09.1.454.CMB.1.raw
  modified_base (155)..(155): a, c, t, g, unknown or other
  misc_feature (155)..(155): n is a, c, g, or t
  modified_base (189)..(189): a, c, t, g, unknown or other
  misc_feature (189)..(189): n is a, c, g, or t
  modified_base (270)..(270): a, c, t, g, unknown or other
  misc_feature (270)..(270): n is a, c, g, or t
  modified_base (542)..(542): a, c, t, g, unknown or other
  misc_feature (542)..(542): n is a, c, g, or t
tcagtctatactatcacgaccggtgctcgatttagcgcgtatacaagggggcagtcatccaacaaccacatcccttctctacagaagcctctgagaggaagttcttcaccatggactggacctggagggtcttctgcttgctggctgtagctccnggtgctcacctccaggtgcagttggtgcagtcgnggggctggaggtgaagagccgtggggcctcgagtagaaactttccgtcgaccgaggctactcgtaggactactaacccttnagtacgacctaatactactcccacgtgggtgaccggtacgaccggcccccgtagggaccggtacggtacttgggaggtcgggtacgttggggaactaaccgtcccgaaccccggttggggtacgggtcggccgaacgggaacctaaaccgtacggaccggaacggtaacggttaccgagggaactacggtacggtccaactacggtacgaccgagggacgaccgttaccggacgtacgtatacgtcgttaagttgaagtttggagtagtagngtagtacgtcgtaggaacgaccggtacgtactttatttaacgttagtaggtcggtaagggtaggggtagggggggttcggtcgggtacgtcggaccggtacccgtcggtacggttacgacggttaggtccgggtcggtacggtaccgtaccgg

SEQ ID NO: 210166 - DNA, 857 bp, Homo sapiens
  misc_feature: GYAE6OF02FF0EC.41.64.F09.1.454.CMB.1.raw
  modified_base (158)..(158): a, c, t, g, unknown or other
  misc_feature (158)..(158): n is a, c, g, or t
  modified_base (230)..(230): a, c, t, g, unknown or other
  misc_feature (230)..(230): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctcaggtnctcactccaggtgcagttgtgcagtcgtgggctgaggtgaagagccgtggggcctcagtagtaaactttccngccgaggcagtctggataccaccttcatcgtacctactactatccgtacgttgggtcgccgacgacggtcccccgtaggaaccggtaggtacttaggagttagggacgtcggggaaacctaaccgtaccgtaaaccccggttggggtacgggtacgggtacccgaacgggaaccctaacccggttaaccggtaccgtaaaccgggttaaacggtttacccggaaacgggtaacccgtaaacggtaacggttaacccgaaccctaacgttaccggaaacccggtaacgggaacccgtacccgggtaacccggtaccggtaaacggttaacccgtaacggtttaacccgtttaacggtttaacgggtaaacgttttacgggaaacggggtaacgggttaaccggtaggtaaacggtaccgttaaccggtacggtaaccggtacccgtaaccggttacccgtttaagttttttaacgtagttttaccgggtaggtaccggggtaggggggttacgggggggtcgggttaccggtaccggttaacggtaccccgttaaccgggtcccggttagggtacggttaggttaacccgggtcggggacccggtaacgggttaccccgttaccgggg

SEQ ID NO: 210167 - DNA, 634 bp, Homo sapiens
  misc_feature: GYAE6OF02I35PF.41.64.F09.1.454.CMB.1.raw
  modified_base (465)..(465): a, c, t, g, unknown or other
  misc_feature (465)..(465): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtgggctgaggtagaagaacggccgtggggcctcgagtagaaaactttcctgaccgaggcatcgtgataccaccttacatgacctactatactcctagtgggtcgctacgaccggccccgtggacggaggacgttggaggtggagtcgggacactaccaccgtggtggtggacgacggacaaccgtacgccgaacgtacgtccgaacgacagacgtaccaaccgagtcgaccgacggacgaccgtcgacgagtacagtctagtgtagtagaggagagngtagagtcgacgtacgcgacgtaccttatttaagttttattggtagacggggtaggggtacgggggggttcggggtaccggtcggttacggtacccggtaacccgggtccccggttggtacggttagggtttaccgggtcggggtaccggaccgggtaccggtcccggg

SEQ ID NO: 210168 - DNA, 570 bp, Homo sapiens
  misc_feature: GYAE6OF02JAY87.41.64.F09.1.454.CMB.1.raw
  modified_base (189)..(189): a, c, t, g, unknown or other
  misc_feature (189)..(189): n is a, c, g, or t
  modified_base (232)..(232): a, c, t, g, unknown or other
  misc_feature (232)..(232): n is a, c, g, or t
  modified_base (255)..(255): a, c, t, g, unknown or other
  misc_feature (255)..(255): n is a, c, g, or t
  modified_base (315)..(315): a, c, t, g, unknown or other
  misc_feature (315)..(315): n is a, c, g, or t
  modified_base (420)..(420): a, c, t, g, unknown or other
  misc_feature (420)..(420): n is a, c, g, or t
  modified_base (500)..(500): a, c, t, g, unknown or other
  misc_feature (500)..(500): n is a, c, g, or t
  modified_base (558)..(558): a, c, t, g, unknown or other
  misc_feature (558)..(558): n is a, c, g, or t
  modified_base (560)..(566): a, c, t, g, unknown or other
  misc_feature (560)..(566): n is a, c, g, or t
  modified_base (568)..(570): a, c, t, g, unknown or other
  misc_feature (568)..(570): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgngggctgaggtgaagagcctggggcctgagtagaaaattttccngccaggctagtctaggactaacnccttgaatcgaaccttataattactcccgaacgtggggtacgccgaactagggtcccccngggacacggcttgagttcggatcgggacaacctccaaccgtggttcgagggcaacgggacaactcggactaacggaagttccgaaggacaggtagtccaacgtanaccgaacgaacgggtacaaccggccggacgaacggtcgagtcttattggtaagtttaggagaggacgtgacgattaacgngaacgacgacgactagttacttagtggtagagggtagggtgggggtgggtcgtcggtngnnnnnnncnnn

SEQ ID NO: 210169 - DNA, 812 bp, Homo sapiens
  misc_feature: GYAE6OF02I076J.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcacctcccgaggtgctagttggtgcaggttcgtgggctggaggtgaagagccgtcgggcctacgagtagtaaactttccgtcgaccgaggtcacgtcgtaggactaccgtaccttacactacgtaaccgttaacttacttaacctccgtacggttcggggtcggaccggtaaccgacccgggtacccccgtaggggaaccgggtacgggtaacgtttcgggtaagggtagggtagtaacggggaaccctaaccgtacccgtaacccgggttagggtcggttacggacgtaacggaacctaaccgtaccgacgtaacgggtacgtacgacggacgagacgtacacagtcgaaccgacggacgtaccgtccgacgtacgtacgtacgttacgttaagtttaggaaagtttggaacggggttaagtacgggtaagtacgtacgttacgacggtaaccgaccggtaaccggttaccttttaagtttttagtaacggtttcggtaggggtaaccggggttggggggggttacggggggttcgggggtacggtcccgttacgggtaacccggttccggttacccggttaggttaccgttacggggttaccggggtaacccgggggacccggttaacccgggggtaccccgttacggg

SEQ ID NO: 210170 - DNA, 888 bp, Homo sapiens
  misc_feature: GYAE6OF02INLYZ.41.64.F09.1.454.CMB.1.raw
tcagtctatactatcacgaccggtgctcgatttagcgcgtatacaagggggcgatcatccaacaaccacatcccttctctacagaagcctctgagaggaaagttcttcaccatggactggacctggagggtcttctgcttgctggctgtagctccaggtgctcactcccaggtgcagttggtgcagtcgtgggctgaggtgaagaagccgtggggcctcagtagtaaaactttcctgccaaggtcactccgtaggacttaccgtacctttacacttacggtaacccttaactacttactaccctaaccggttggggtacggacccggtaccgtaccgggtaccccccgttagggaaccgggtaacgggtaccgtttggaaggttagggacggtacgggtaacctaaacccgttacccgtaaaccccggtttggggtacgggttacgggaccgaacgggaacccgtaacccgttaaccgggaccgaaccgggttaaccggttacccggaacgggtaacgaacggtaccggtaccaacccgacggtaccggaacccggtaacggggaccctaaccggggttacccggaaccgggtaaacggttacccgtaaggtttacccgttaaacggttttaggggtaaacgtttgggaaacgggtacgttaaggtaggtaacgtagtttaccgacggtaaccgtacccgtaacggttaccttaagttttacgtttaaggtcggtagggtaacggggtacggggggtacggggggggttacggggttaccgtaggttacccgggtaccgttacccgggttaccccggttaggttaccggttaaacggtttccgggttacccgggggaacccgttaaccgggggtaaccccttcggggg

SEQ ID NO: 210171 - DNA, 860 bp, Homo sapiens
  misc_feature: GYAE6OF02JVQKI.41.64.F09.1.454.CMB.1.raw
tcagtctatactatcacgaccggtgctcgatttagcgcgtatacaagggggcatcatccaacaaccacatcccttctctacagaagcctctgagaggaagttcttcaccatggactggaccgtgggaggggtcctttctgtcttcggctggtcgttggtacgtccgtccgagggttcgccttaccacccgtcccgtagggttcgcgttaggttggtgcgtacgttcgggtggggtcaggagggtaggaagggaccgccgggttacttcgaagttggtaaaaacttttccccgtgcccgtaagggccaagtccttacgggtaattaccctaacccgtttccaattgaacccctttaacttaacgtacttacccgtaccggttgggggtggccggaacctacgggacccccgtgggaccggaggtacgttaggcgggtacgtagggtccggaaaccgtacgtacccgtacccggtggtagggtccgtacggtacgaccgttaaaccggccgtaccggaagggtacctacgggacgacgaacggtactaccgacctaggtacccgacgggaccggacgtaccggtaccggtaaccgagttacgttcgtacggttaagttcggtaaggtaaggtaggtaacggtagtaagtcgtagtaccggtaagaccgttaaccggtacgtttaactttaacgtttagttacgggttaacggaagggtacggggggggggtttcgggggtacgtacgggtaacttaccggggacccccgggtttcggtcggtacgttttaacccgttggggggtaacccccaggggggtaaacccccttggggggacccttaacccgggtccttaccccggg

SEQ ID NO: 210172 - DNA, 792 bp, Homo sapiens
  misc_feature: GYAE6OF02GZ94L.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagccgtggggcctcgagtagtaaaatttcctgccgaggcatctggactacaccttcatgacctactatactccacgtgggtgcgaccgacggcccctagggacgagggtacctttggaggttggagtacggggaaccaaccgttccgaaccccgttggggttcggtcggaccgaacgggtaaccaaaccgtacggacgtaaccgggtaacggttcccgaacgggaacgtacgacgtacccgtaaccagtacgaacccggagggaaccgtacccggtaccggaccggtaacgtacgtaacgttacgttaacgttagggtaaacgttgggaacgggtagtaagggttagaacggtaacgttacgtacggaaccggaccgtaaccggaccgttaacgtttttaagtttaacgtttggttaccgggtacggtaacggggggttacgggggggggttcgggggttaaccggggtccggtttacggtaacccgggttacccgggtcccccgggtttaaggttccgggttaaccggtttaccggggttaccgggggtaccccgggttaaccgggggaaccccgtttacccggggg

SEQ ID NO: 210173 - DNA, 832 bp, Homo sapiens
  misc_feature: GYAE6OF02JWYGU.41.64.F09.1.454.CMB.1.raw
  modified_base (183)..(183): a, c, t, g, unknown or other
  misc_feature (183)..(183): n is a, c, g, or t
  modified_base (522)..(522): a, c, t, g, unknown or other
  misc_feature (522)..(522): n is a, c, g, or t
  modified_base (701)..(701): a, c, t, g, unknown or other
  misc_feature (701)..(701): n is a, c, g, or t
tcagtctatactatcacgaccggtgctcgatttagcgcgtatacaagggggcatcatccaacaaccacatcccttctctacagaagcctctgagaggaaagttcttcaccatggactggactggaggtcttctgcttgctggctgtagctccgaggtgctcactcccaggtgcgagttggtancagtcgtgggctggaggtagaagacgccgtgggcctcagtagtaaattccgtcgcccaggccagtcgtaggtacttacctaccgttcacgttacggacccttaagtacttaacctccgtaaccgttggggtccgaccggacctaccggggcccccgtacgggtaccggacggtaaccgtcgggacggttcgggaacggtaccggggtaacctaacccgttacccgtaaccgggtcggggttacggttacggggaccgaacggggaaacctaaaccccgggttcggacggaaaccgggttaccggttacccgaaagggtacacggtaacgcctaaaccgngtacgaaccgggacggaacccgccgtacgggaccgaaggttacccagggtttattaaacgggttggtaaaggtttaggaaccggggtaaggtaaggtacccggtaagttaaggttacccgaaggggaaaccgttaacccgaccgttacccgttaagtttttaagttaacggttccgggnggaagggggttacccgggggggtaaggggggtccgggttccaaaaccgggttcggaaccgttccccgggcccggttaggtacggttacgtaaacggggttccgggaaccggtttacccggaaccccgttgg

SEQ ID NO: 210174 - DNA, 750 bp, Homo sapiens
  misc_feature: GYAE6OF02JUATW.41.64.F09.1.454.CMB.1.raw
  modified_base (192)..(192): a, c, t, g, unknown or other
  misc_feature (192)..(192): n is a, c, g, or t
  modified_base (647)..(647): a, c, t, g, unknown or other
  misc_feature (647)..(647): n is a, c, g, or t
tcagtctatactatcacgaccggtgctcgatttagcgcgtatacaagggggcagtcatccaacaaccacatcccttctctacagaagcctctgagaggaaagttcttcaccatggactggacctggagggtcttctgcttgctggctgtagctccaggtgctcacctcccaggtcgctacggttggtgaccnggtcgtggggctggaggtgaagaacgccgtcgggcctacgtaggtaactaaaacgtttccgagcccaaggtccaagttccgtaggacttactacctttcacgttacgaccttaactacgtactacccacgtggtaccgacgacgaccggtccccgaggtaccggaaggtaccgttggtaggtacggtacggtacggggaacctaaccgtacccgtaacccgggttggtacgggtacggaccgaaccggtaaccctaaccgtaccggacggtaacggtaacgttccgaacggtacgtacggacgtaccaacgtggtaccgaccggaacgggacctacggccggactagtaccgtacgttacgttacgtttagggtaagttacgggtaggtaacgtaaggtagaacgtaagtccgaaggtaccgaacgtccggtaacttagttttacgtgttacggnggtaacgggtggggtacggggggttcggcgtacggtacgtacgtcccgggttaccgtgtacccgttagtacccgggtgggtaccccggtacggtacccgtcgg

SEQ ID NO: 210175 - DNA, 857 bp, Homo sapiens
  misc_feature: GYAE6OF02JJOSQ.41.64.F09.1.454.CMB.1.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
tcagtctatactatcacgaccggtgctcgatttagcgcgtatacaagggggcatcatccaacaaccacatcccttctctacagaagcctctgagagggaaaagttcttcaccatggactggacctggagggtcttctgcttgctggctgtagctccaggtgctcactcccaggtgctagttggtgcagttcgtggggctaggaggtagaagaagccgtggggacctcgagttanaaaacgtttcncgccgacggcactcgtaggactaaccgtacgttcctagtacgaaccttactattactcctaagtggggtacgtacgacgaccggtaccccgtaggacggacggtacgttaggaggttagggactcggggaacctaacctccgtaaacccggtggttcgggaggtaccggaacggaaccctaaccggtacggaccgtaaccgggtaacgtttcccgaaagggtaccgtaaggaagttacccgtacccgaaagttccggaacccggaaacgggtaacgtaccggtacccggaacggtaaccgtagaacggtttacttacgggtttaagttaaccggttaggtaagggtaacgtagggtacgtaggtaaactcgttacggtaaaccgaaccggacggttaccccgttaagtttaaccgtttaaagtttaccggtgggttacccggggtaagggggttacgggggggggttacggggttacccggtaaccggggttaaccggttaaacccgggttaacccgggtccccgggttttaacggggtacggttaacccgggttaaccgggttccgggggtaaaccccggggttacggggttaaccccggtttacccgggg

SEQ ID NO: 210176 - DNA, 609 bp, Homo sapiens
  misc_feature: GYAE6OF02JBA95.41.64.F09.1.454.CMB.1.raw
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (482)..(482): a, c, t, g, unknown or other
  misc_feature (482)..(482): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgccagtctggggctgaggtgaagaagcctggggcctcgagtgaaatttcctgccaggcatcgtaggatacnccttnatcgacctactatactccagtgggtcgcgacaacgccccgttggaccgaggacttggacgtgggactgggacaacgtccaaccggttggtacggtcgacgtacgggacctaaccgtacgctaacgggacgtttaccgacggaacacggtacgtacaccagtgacccgaggacacggtccgcgagtacagtactagtttaggacttagacggtataggtagagtancgtacgtacgacgtaccgggacttagtttattatcgtagtcgagggtaggggggtggtacggtcgacggtacgaccggtcccggtgtacggtacgttaccggtcgggccggtacggtacccggtcgg

SEQ ID NO: 210177 - DNA, 528 bp, Homo sapiens
  misc_feature: GYAE6OF02HC5OB.41.64.F09.1.454.CMB.1.raw
  modified_base (277)..(277): a, c, t, g, unknown or other
  misc_feature (277)..(277): n is a, c, g, or t
  modified_base (420)..(420): a, c, t, g, unknown or other
  misc_feature (420)..(420): n is a, c, g, or t
  modified_base (483)..(483): a, c, t, g, unknown or other
  misc_feature (483)..(483): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactggtncgacaggcccctggacgaggacttgagtggatgggacaactcaaccctggtggtggcaggacaacctacgcacggaagttccaggacagagtcaccatcgaccaggacacgtccgcgagtacagtctagttggaattgagganagtgagatctagacgacacggcctaatttacttagttgtagtcgaggtaggggggtgggtcgngtcgacgtcgccccgtgtcgattacgtgggacctaggaccctcgg

SEQ ID NO: 210178 - DNA, 763 bp, Homo sapiens
  misc_feature: GYAE6OF02GXZ2T.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctggaggtgaagaagccgtggggcctcgagtagtaaaactttccgtgccaggctatcgtaggaatacctacctttcaagtacgtaacccttaatattaactccctacgtggggtacgaccgaacgaccgggtcccccgttaggggaaccggaacgggtacgtttgggaacggttagggagttaacggggaacctaacctacccgtaaacccggttgggtcgggtacggaggaacggaaccctaaaccgtaccggaccgtaacgggtaacgttaccgaagggaactaacgtaggttacccaaacgtacgtacgaaccggaacggaccaaccggtccgaacgtacgtacgtaggttacttaggttaggtaacgttaggaaggagtacgggtagaacgtagtacgtacggtaaccgacggtaaaccggtccttaaattttaacgttaggtttacgagggtaggacggggggttagggggggtcgggtacggtccggtaggtacccgttaccggtcccggttgggtactacggtttaccggacggggtacccgggtaacggtacccggttaccgg

SEQ ID NO: 210179 - DNA, 665 bp, Homo sapiens
  misc_feature: GYAE6OF02HCJ1C.41.64.F09.1.454.CMB.1.raw
  modified_base (234)..(234): a, c, t, g, unknown or other
  misc_feature (234)..(234): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcaggttggtgcagtcgtggggctggaggtagaagagccgtgggcctcagtagaaatttccngccaggcatcgaggactacaccttcatcgacctactatactccacgtgggtgaccgacgacggcccccgtggacgacgtacgttggaggtggagtagggaacaactaccaacccgtggtggtcggacacggaaaccaaccgtaccggaccgaacggtaaccgttccgaacgggacaaggtacgtaccaacccgagtacgacccgaagggacccaccggtcccgacggtaacgtacgacgttacgtaagtttggaacgttaggagggacgtaggtagagtatcgtaggaaccgacgaccgtaccttagttttattagtttacggtgacgggtaggggacgggggggttgggtacggtcgtaccggaccggttaccggtccccggtggttacgtacggttacggtcggggaccgtacggggacccgttccggg

SEQ ID NO: 210180 - DNA, 814 bp, Homo sapiens
  misc_feature: GYAE6OF02G5C31.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtcgtggggctgaggtgaagagcctggggcctcgagtagtaaatttcctgccaggcatctggataccaccttcatcgacctactatactcctacgtggggtcgcgtaccgacgggtcccccgtagggaccggtagggtaccgttgggacggttgggagttacggggaacctaaccgttaccgtaaaccccggtggggttacgggtcggaccgaagggaaccctaaccgtaccggacggtaaccgggtaacgtttacccggaagggaaccgtaggaacggttaccaacccgagtaccggaacccgaacggggaaccctaccgggtacccgggaccggtaacggtaaccgtaacggttaccgtttaaggttttacgggtaaacgttacgggaagggtaacggtaagggttacgggtaacggtacgttacccgttacgggtaacccgtaaccggtaacccgggtaccttaagtttttaacgtttaaggttcggtacgggtacgggtaagggggtacgggggggggttcggggttaccggtcgggttaccggtaccggttacccgggaccccggtttggttaccggtacggttaccgggtacgggggacccgtaacggggtaccccgttacggg

SEQ ID NO: 210181 - DNA, 799 bp, Homo sapiens
  misc_feature: GYAE6OF02F3PFE.41.64.F09.1.454.CMB.1.raw
  modified_base (679)..(679): a, c, t, g, unknown or other
  misc_feature (679)..(679): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccgaggtcgctaggttcggtgacgagttcgtcggggcgttaggagggtagaacgtaaggccgtcggggtcctacgtagtagttaaaactttccgtacggaccgaggactataccgtggtaacttaccgtacccttgtaccgtacggtaacccttaacttaaatccttaccccgaccgttggggtccgacgaacgtacccgggtccccgttaggggaaccggtacggttaacctggtaacgggttaaggccgtaacgggaaccttaaaccgtaccgttaaaccccggtgggttgggtacggacgtaaccggaacctaacccgtaggaaccgtaccggttaaacggttacccgaagggtaaccaggtacgttaccgaaccgtagaccgaaccggaacgggaaccggttacgaccggtcgtaaacggtaccgtagttacgttaagttacggtagttacgggaggtacggagttacgagttacgtgtacgacggaacgacgccgtttaattacgttnttacggtggacggggtaggggtacggggggtcgggttacggtcgtaccggtacgttacccgggtccgttaggttaccgttacggttacggaccgggttacggaccgggtaccgtaccggg

SEQ ID NO: 210182 - DNA, 831 bp, Homo sapiens
  misc_feature: GYAE6OF02JKAP2.41.64.F09.1.454.CMB.1.raw
  modified_base (172)..(172): a, c, t, g, unknown or other
  misc_feature (172)..(172): n is a, c, g, or t
  modified_base (236)..(236): a, c, t, g, unknown or other
  misc_feature (236)..(236): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctcaggtgctcactcccaggtncgagttggtgcagtctggggctgaggtgaagaagtccgtggggcctcgagtagtaaactttccngaccaggcatcgtggatacgtacctcgatcgtaactactactactccgtacgtggggtcgtacggaaccgaccgggccccgtaggaccggtaggtacttaggaagtcggaggtcggaactaacgacctaacccgttggtcggtcgcgaacggaccaacgtacgacgaaggtaccgtaccgaaggtacgaacgtagtacccgacgttaagacggaacccggtaaagggtcccaaccgggttacccccggtaggtaaacccgttacccggtaagtttacccggtttacggtttaaaggtaaccggtttagggaagggttacggaagggttggtaacccggtagttaaccggttacgggaaaccgttaaccggacccgttaccggttttaaagttttttacgtacggtttacgggttacgggacgggggttaaccgggggggttggggggggggttaccggggtaccttaccggggtaacgggttaaaccccgtacccggggtttccccgggtttaacgggggttcggttaaaccgttacccggggggttaacccgggtacccggggtaaaaccgggttccccggtttaacccggggg

SEQ ID NO: 210183 - DNA, 569 bp, Homo sapiens
  misc_feature: GYAE6OF02GXK9B.41.64.F09.1.454.CMB.1.raw
  modified_base (234)..(234): a, c, t, g, unknown or other
  misc_feature (234)..(234): n is a, c, g, or t
  modified_base (452)..(452): a, c, t, g, unknown or other
  misc_feature (452)..(452): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcagttggtgcagtctggggctgaggtgaagaagccgtggggcctcagtagtaaaatttccngccaggcatctggataccaccttcatcgacctactatactccacgtgggtcgcgacgacggcccctaggacgaggtactgagtggagtggacactcaaccgtggtggtggcgacggacacctacgacgacggagtaccgagacagacgtaccacagtcgaccgaggaccacggtccgacgacgtacagttcttagttaggaattggagtagagtgagntcgagacgacgacgtacttatttagttagttgtagcgggagggtaggggggttgggcggtgtacgtacgtaccgtccggtgtacgtacgttccggcgggccgtacggtacccgtcgg

SEQ ID NO: 210184 - DNA, 665 bp, Homo sapiens
  misc_feature: GYAE6OF02FZ07R.41.64.F09.1.454.CMB.1.raw
  modified_base (363)..(363): a, c, t, g, unknown or other
  misc_feature (363)..(363): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcaggttggtgcagtcgtggggctggaggtaggaagaagccgtggggcctcagtagtaaaactttcctgccgaggcagtcgtggatacctaccttacatacgacctactatactccacgtgggtcgacgacgacggccccgtaggacgaggacttggaggtggagaggaacaactccgaaccgtggtcggnggacgtacggaccaaccgtacgacgacggtaacgttacgacggacagacgtaccaccgatacggacgaacgggaccaccggtccggacgtacgtacgtatacttagttacggtaagttggaacggaaggtagtcggagtactacgtacggaacgtaccgacggtactttaattttagtacgttaggtcggacgggtagggggtaggggggtcggtacggtcgtacggtacccggttccggtacccggttagtacggttacggtttaccggtacgggggacccgtacggggtacccgttcggg

SEQ ID NO: 210185 - DNA, 667 bp, Homo sapiens
  misc_feature: GYAE6OF02HB42G.41.64.F09.1.454.CMB.1.raw
  modified_base (300)..(300): a, c, t, g, unknown or other
  misc_feature (300)..(300): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgcaggttggtgcagtcgtggggctggaggtgaaggaagccgtggggcctcgagtagtaaaatttcctcgccgaggcatcgtaggactaccaccttacatcgaaccttactatactccacgtgggtacncgacgacggccccgtagggaccgaggtacttggacgtgggacgtgggaaccaaccgtccgaaccgtgggtggtcgacgaggaccaacgtcgacgacggacgtcgagacagactaccacgacgagaccgacggacgtacggacccgcgacgtacgagttacgttaagttacgtaggttaggaggacggtaggtacgagtacgtacgtcgaccggtacgaccgtaccgttaagtttacgtttagttggtaggtacgggtaggggtacggggggggttcggggtacgggtcggtccggtaaccggtacccggtcccgtgggtacggttacggttccgggtcggggtaccggtacgggtacccgtaccggg

SEQ ID NO: 210186 - DNA, 979 bp, Homo sapiens
  misc_feature: GYAE6OF02HBCM6.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactccaggtgcagttggtgcagtcgtgggctgaggtgaagagccgtggggcctcgagtagtaaactttccgtcgacctaggctagtcgtacggaataacctaccttcatcgacctacgtatactacctacggttcgggcgtaccggaaccgtacccgggtacccccgtacgggaaccgggtacggtaccggtttagggacggttacggggtaagttccggggtaaaacccgtaacccgttaaccccgttaacccgggttagggttcggggtaccggtacggaaaccgggaacccgtaaaaccccggttaaccgggaccggtaaacccgggggtaacgtttaacccggaaacgggaccgtaaacggaaccgttacccgaaccgtaacgtaccggaaacccgggtacggggaaaccctaccccgggttcccggaaccggtaaacgtaaccggtacgttacgttttaaacggtttacgggtaaacgtttaggggtaaacgggtaaggtaagggttacgtaacggttaaccttacgggtaaccgggtaaaccgggtaacccgggtaaacccggtacgtttttaaaccgttttttaacgtttaaggttttcgggttaacggggtacgggggtttaacgggggggggtaacgggggggggggtttacgggttaaccccgggggtacgggttaacccgggttaaaccggttaccccccgggtttacccgggggttaacggttcggggttttaaccgggtttaacccgggggttacccgggggtaaccccgggttaacccgggggtaccccggtttaccccgggg

SEQ ID NO: 210187 - DNA, 721 bp, Homo sapiens
  misc_feature: GYAE6OF02I07F0.41.64.F09.1.454.CMB.1.raw
  modified_base (458)..(458): a, c, t, g, unknown or other
  misc_feature (458)..(458): n is a, c, g, or t
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcacctcccgaggtgcaggttggtgctagtcgtgggctggaggtagaagacgccgtgggcctgagtagtaaacttcctgaccgagctatcgtagtatacctaccttacagtacgaaccttaactactactacccgtaggttcggtcgaccgaccgaccggccccggtaggaccgacggtacgttaggagtggacgtacgggaaccaaccgtaccgaacccgttgggtacggtcggacgaacggtaaccaaccgtcgaccgaagggtactaccggaacgacgaagtactaccaccgtanaccggtaaccgacggaaccaccggtccgtacggaacgtaccgtacgttacgttaagttagtaacgttggaaggtaagtacgtagatacgtcgtaagaccgaacgtacgtacttatttaacgttagtcggtaggacgggttaggggtacgggggggttcggtccgtacgggtacggttaaccggtccccgggttacccgttagggtaacggttacccggttaccgggtaccgggggtaccccgtaacggggtaccccttacggg

SEQ ID NO: 210188 - DNA, 694 bp, Homo sapiens
  misc_feature: GYAE6OF02HTRDI.41.64.F09.1.454.CMB.1.raw
  modified_base (173)..(173): a, c, t, g, unknown or other
  misc_feature (173)..(173): n is a, c, g, or t
  modified_base (182)..(182): a, c, t, g, unknown or other
  misc_feature (182)..(182): n is a, c, g, or t
  modified_base (276)..(276): a, c, t, g, unknown or other
  misc_feature (276)..(276): n is a, c, g, or t
  modified_base (474)..(474): a, c, t, g, unknown or other
  misc_feature (474)..(474): n is a, c, g, or t
  modified_base (491)..(491): a, c, t, g, unknown or other
  misc_feature (491)..(491): n is a, c, g, or t
tcagtctatactatcacgaccggtgctcgatttagcgcgtatacaagggggcatcatcccaacaaccacatcccttctctacagaagcctctgagaggaaagttcttcaccatgactggacctaggaggtcttctgcttgctgctgtagctccaggtgctcactcccaggtcncagttggtncagtcgtgggctggacggtgaagacgccgtgggcctacgagtactaaatttctacgaccaggtctagttcgtacggtaactacctaaccctttnacgttacgaaccttaactaattaaccgtccgaacgttggggttacgacggtaaccgtaccggtacccccgtaggggtaaccgtagggtacttgggtaggtggaacgtcggtaacaaccgtccgtaaccggtggtggtacgacgaggaaccctaaccgacgaccgtacggtaacgttaccgagacgagtacgccaacgngtaccgagacggtaccncggtacacgaacttacgagttactagtagtagtaggaggaacgtgtagagtacgtacgagtaccgacggtacctattaacgtttagtcgttgtagaccggggtaggggtacgggggtttccggaccgtgtaaccggtccgtacccggtaccgttagtacggttacggttacggaccggggtaaccgaccgggtaccgttccgg

SEQ ID NO: 210189 - DNA, 871 bp, Homo sapiens
  misc_feature: GYAE6OF02I6J64.41.64.F09.1.454.CMB.1.raw
  modified_base (161)..(161): a, c, t, g, unknown or other
  misc_feature (161)..(161): n is a, c, g, or t
tcagtctatactatcacgaccggtgctcgatttagcgcgtatacaagggggcatcatccaacaaccacatcccttctctacagaagcctctgagaggaaagttcttcaccatggactggacctgggagggtcttcgtgtcttgctggcgtgtaggctccgnggtcgctcaacctcccgaggtcgctaggttggtggactggtcgtggggactggaggtagaaggacgtccggtcggggacctcggtacgtaagtaaaacgttcccgtgaccgtaaggcgtacgttacggtgggtaaccttaaccgtaaccttaacgtacgttaccgtaaaccttacttaaccgtaaccgtacccgttacgggttaggggttaccgaaccggtaaccgtacccgggtccccggttaagggacggtaacggtacgtaggtaacggtgggtaaccgttacggaaccgtaactaccggttaccggtggggtacggtagaccgtaacggaccgaaccgtcggaacgtacggtaacggtcggaacgacgtaagacgtacacgtaagccggaacggtacgacggtccgacggtacgtacgtaaccgtacgttcgtaacgttagggaacgttagggtaacggtaagggtaggtacgtagggtaacctacggtaaggtaaccggtaaccgggtacgtttaaccgttaagtttaacgggttttacggtacggttacgggaacgggggttacgggggggttacgggggggttacgggttccgggtaaaccgggttccgggtaaaaccgggttcccggtacccgggtttaggtacggtaaccggtttccggggaccgggtaacccgggtaccgggtaaccgggttaacccggg

SEQ ID NO: 210190 - DNA, 740 bp, Homo sapiens
  misc_feature: GYAE6OF02H0M86.41.64.F09.1.454.CMB.1.raw
  modified_base (181)..(181): a, c, t, g, unknown or other
  misc_feature (181)..(181): n is a, c, g, or t
  modified_base (638)..(638): a, c, t, g, unknown or other
  misc_feature (638)..(638): n is a, c, g, or t
  modified_base (666)..(666): a, c, t, g, unknown or other
  misc_feature (666)..(666): n is a, c, g, or t
tcagtctatactatcacgaccggtgctcgatttagcgcgtatacaaggggggcatcatccaacaaccacatcccttctctacagaagcctctgagaggaaagttcttcaccatggactggacctggagggtcttctgcttgctggctgtagctccaggtgctcacctccaggtgcagttgngcagtcgtggggctgaggtagaagaagccgtggggcctcgagttagtaaaactttccgtcgaccgtaggctagttcgtagggtaactaccgtaccgtttccagttaccgaaccttaactacgtactacccgtaccggttgggtacgaccgaaccgtaccggtaccccggtagggaccggtacggtacgttaggaggtcgggtaagtacgggaactaaccgtaccaacccggttggttgggtcggaacgtacggtaaccctaaccgtaccgacgtaaccgggtacgttaccgaacggacaacggtacgtacccgaacctacgtacggaaacccgacggggacctacccgggtaccggaacggtacgtaaccgtacgttgtttaacgttagggtaattcgggaagttacgagtaggactagtcgtacggaacacggtacgacttatttaagtcgttggngtacgggtaggggtaggggggtcggtcncggttacggaccgttccccggaccggtttggaacgttacggttccgggtacggggcctaacccggggtctacgg

SEQ ID NO: 210191 - DNA, 847 bp, Homo sapiens
  misc_feature: GYAE6OF02GJHQ0.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcactcccaggtgctagttggtgcagtcgtgggctggaggtgaagagccgtggggcctcgagtagtaaacttcctgccaggcagtgtggtataccgtaccttcatcgaccttactatactaccagtgggtacgacgtaccgacgggtccccgtaggaccggacgggtacttaggacggtaggacgtacgggaactaacgtaccgtaaacccgttggggtcggtacggacgaacgggaacctaacccgtaccggaacgaaccgggtaacgttaccgaaaggaccgtaggtaacgtaccgtaaccaacggtacggacccggtaacgggaaccgtaccgggccggtacgtacgtaaacgtcgttacgtttagttacgggtaagttggaaacgggttaggaacgggtcgaaacggttacgtaccggtaacggtaacccggacggtaaacccgttaccgttttaaagtttttaacgttaacgggtttaccgggtacgggtaaccggggggtaggggggggttaccggggggggggtttagggggtaccccgtttacggggggtacccggttaaccccgggttaccccgggggttaccccggtttaaggggtttacccggttacgggttttaacccgggggtcccggggggtaaaccccgtttacccggggggacccccgttttaaccggggg

SEQ ID NO: 210192 - DNA, 752 bp, Homo sapiens
  misc_feature: GYAE6OF02IU11H.41.64.F09.1.454.CMB.1.raw
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
tcagtctatactatcacgaccggtgctcgatttagcgcgtatacaagggggcatcatccaacaaccacatcccttctctacagaagcctctgagaggaaagttcttcaccatggactggacctgggagggtcttctgcttgctggctgtagctccgaggtgctcacctcccgaggtgctagttggtgctaggtcgtggggcgtggaggtaggaagaggccgtgggctctaggtagtaaacgttccgtgaccgtaggctagtcgtggtactacctactcagtacgtacctattagtactccgagtgggtcncggaaccnccgggtcccgtaggacgtacgtcgtggaggtcgaagtcgggaacacctaccggaccgtgggtcgggtacacggacgtaactaaaccgcggtagaccggtaactccggaaggtaacagtacctacggtaacacggtcggaacgaaccgggacgtaacccggtccggtacgtaggtaaccgtagttacctttaagggtacgtaaggttaacggtacgggtaagtcgggaagtagtactcggtacgaacgaccgtaccggtacttacgttttaggtaacttcgggtaacggacggggttaaggggggtcggggggtaaccgggttccgggtaacggttaacccgggtacggtacccccggtacggtttaagggtccggttaaccgggttccgggttaccggggtaaccccggaaccgggtttcccgggtaaccccgg

SEQ ID NO: 210193 - DNA, 1024 bp, Homo sapiens
  misc_feature: GYAE6OF02H937D.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgcctggctgtagctccaggtgctcactcccaggtgctagttggtagcagtcgtgggctgaggtcgaaggagccgtaggggcctacgaacgttgtaaaaattttccgtcggaccgagggtcaacgttccgttagggtacttaacgtacccttttacgaacgttacgtaacccttaaacttaacgttaaccgttaacccgtaacccggttgggggttacggaccggtaaccgtaccccggggtacccccggtttacggggtaaccgggtaacgggtaacctttaagggtaacggttcggggtaacgtttacgggggaaaccgtaaacccgttaccgtaaaaccccccggtttgggggttacggggttaccgggggaacccgtaacgggggaaaccctaaacccggttaaccgggacccgtaaaccggggtaaaccggttttaaacccggacgggtaaccgaaaggtaaccggttaccgaacccggtaacgttaccgggaaccggtaaacggggtaacccaaccggggttcccggaacggtaaacggttacggtaacggttacgtttaacggttttaacgggaactttaggggaaacgggtaaggttagggttaacggtaacggtaacgttccggttaaacggaacccgggttaaccgtaaccgggggtaacccctttaagtttttaacggttaacgtttaccgggtaagggtacggggtaaggggggttacgggggggggttaccgggggttcccggtaaccgggttaccggttaccggtaaccccgggtttaccccgggttagggttccggtttaacggtttaaccccgggggttagggggtaaccccgggtttaaaccccgggggtaacccctttaacccggggg

SEQ ID NO: 210194 - DNA, 798 bp, Homo sapiens
  misc_feature: GYAE6OF02FJX0W.41.64.F09.1.454.CMB.1.raw
tcagtctatactatcacgaccggtgctcgatttagcgcgtatacaagggggcatcatccaacaaccacatcccttctctacagaagcctctgagaggaaagttcttcaccatggactggacctggagggtcttctgcttgctggctgtagctccaggtgctcacctcccaggtgcagttggtgcagtcgtggggctgaggtgaagaagccgtcgggcctcagtagtaaaactttcctagccgaggcatctggactaccaccttcatcgacctaacttatactccgacgtgggtcgtaccgacgacggtcccccgttggaccggaggtacgttgagtggagtgggactaaccgtaccgtaaccccgtgggtacgggtggacgaacgggaaccgtaaccgtaaccggacgtaaacgggtaaccgtttaccggaaggaacccgtaggtaacggtacctaaccaacggttacgaacccgtaacggggaacccaaccgggttcccggaaccggtaagtaaacccgtaaggttacctttaaggtttacgggtaaaggtttacggaaggtacggtagggttacggaaaggtactacggttaacggacccggtaaccggtaccggtaacccttaacgttttttaaagttaggtttacggttaagggtacccgggttaggggaggggggggggtttacgggggtccggggaccggttaccggaacccggttacccggacccccgtttagggttaccggtaacggtttaaccggccggggtaacccgtaccggggaccccttacgggg

SEQ ID NO: 210195 - DNA, 1036 bp, Homo sapiens
  misc_feature: GYAE6OF02FNAJ0.41.64.F09.1.454.CMB.1.raw
  modified_base (206)..(206): a, c, t, g, unknown or other
  misc_feature (206)..(206): n is a, c, g, or t
tcagtctatactatcacgaccggtgctcgattttagcgcgtatacaagggggcgatcaagtccaacaaccacactcccttctcctacagaagcctcctgagagggaaagttcttcaccatggactggacccgtggacgggtcttctgtcttgctggtctgtagcgtccgaggtgctacgacctcccgaggttgcgtaggttcggtncgtaggttcgtggggtctgggtagggtacggaaagaacgtccggtagggggtacccctagtaagggtaacgttaaaaaccttttcccgtcggacccgtacgggacctaaacgttccggttagggtaaacctaccccttaaacccggtttttaccaaggtttaaccgttaaccccctttaaacttaacgttaacctcccgttaacggttcggggtacggacccgtaacgtacccgggttaaccccggtggggaaaccgggtacggtaccgttacggggtaggtaacggtacggtaaccggggtaaactaaccccggttaccggtaaaccccggtttggggttcgggttcggaaccgggtaacggtaaacccggtacccgtaacccggggtaccgtaaacggttaaaccgggtttacccgtaaaggggacccaaagggttacgtaaccccgtaaccgttaaccgggacgaaaccggttaacccggggaacccggttaaccgacccggggtttaaccgaaagggtttcccggttaacggttaacgtttaacgggttttacggacgggtttaggaaacgggttagggttaacctgggtaaacttagggtactacccgggggtacgaaacccgttaccggtaacctttacgtttttaaatcgggttttaacgggtaacgggtacgggggttaggggggggtaaccgggggggttccggggttacggttaccggggaccgggtttaaacccgtcccgggtacccggttttagggttacccgttaacgggttcgggggtaaccgggtacccggttacggggtaccctttacccgggg

SEQ ID NO: 210196 - DNA, 858 bp, Homo sapiens
  misc_feature: GYAE6OF02H5DGC.41.64.F09.1.454.CMB.1.raw
tcagtctatactatcacgaccggtgctcgatttagcgcgtatacaagggggcatcatccaacaaccacatcccttctctacagaagcctctgagaggaagttcttcaccatggactggacctggagggtcttctgcttcgcgtggtctagtagtcctacccgaggtcgcctacctacctcccgaaggttcgcgtaggtttcggtcgcgtacggtcggtcggggtcgtggtaggtaagtaaagaaccggtcccgggtcggggtccctcggtaacggttacgttaaaaccgtttccgtacggaccgaggtacctacgttcgtacgggtactaaccgttaccttacgtacgttaccgtaaccttaaccttaactaccgtaccgtacggtagggtaccggaacggtacgacccggtccccgttagggaaccggtacggttaccggttaggtaggtacggtacgtacggtaaccaaccgttaccgtaaccccggttgggtacgggtacggtaccggtaaaccgtacccgtaaacgtacccgaaccggtacggtaacgtccgaaggaacgttacgacgtaccacgtagtaccgacgaacggacgtaccgtaccgacgacgtactacgttagttacgttacggtaacgtaggtaacggtaggtaacggtgtaacgttacgtaccgtacgaaccgaccggttaaccgtaacgtttacgttttacgttacggttacggttacggcggggttaacgggggttacgggggggttcgggtacggtcggtaaccggtcccggtaaccggttccggtacggttacggtacggttaccgggtaccgggtacccgtaccgggtacccgttccgg

SEQ ID NO: 210197 - DNA, 727 bp, Homo sapiens
  misc_feature: GYAE6OF02FYT0Z.41.64.F09.1.454.CMB.1.raw
tcagtctatactatcacgaccggtgctcgatttagcgcgtatacaagggggcatcatccaacaaccacatcccttctctacagaagccgtctgagaggaaagttcttcaccatggactggacctggagggtcttctgcttgctggctgtagctccaggtgctcactcccaggtgcagttggtgcagtctggggctggaggtgaagagccgtggggcctcagtagtaaaactttccgtgaccaggctatctggatactaccttcatcgacctactaactatccacgtgggtgaccgacgacggccctggacgaggtacttggagtggagtgggaaccaacgtctaacccgtgggtcgggtcggctaggaccaaccgtacgacacggaagttccgaacggagagagtcaactagtcgaccgaagggacctacggtccggcggtacgtaaacggtggttaccttaagttttggtaaacgtttaggacggtagggttaacgtgggaacgtacgtaccggtacggaacggaccggtaccgggtaccttaaacttttaagttaacgtttggtagggtacccgggtaggggggttaacgggggggggtcggggggttacgtaccgggtaccgggttaacccgtacccggggtcccccggttttaggtacggttaaccggttacgggttaccggggggtacccggtaaacccggggttaaccccggttacccggg

SEQ ID NO: 210198 - DNA, 491 bp, Homo sapiens
  misc_feature: GYAE6OF01BN7WO.21.85.H08.1.454.CMB.1.raw
  modified_base (481)..(491): a, c, t, g, unknown or other
  misc_feature (481)..(491): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatggttgggtgccctttcgttcttcgatctctgggccgcggcaccctggtcactgtctcctcagcctccaccaagggcccatcggtctccccctggccgccctgctccaggacgcacctccgagagcacagcggccctgggctgcctggcaacggactacttccctcgtctctactgagcgggctggcaaggcgcgatagnnnnnnnnnnn

SEQ ID NO: 210199 - DNA, 491 bp, Homo sapiens
  misc_feature: GYAE6OF01D5Q8E.21.85.H08.1.454.CMB.1.raw
  modified_base (395)..(395): a, c, t, g, unknown or other
  misc_feature (395)..(395): n is a, c, g, or t
  modified_base (481)..(491): a, c, t, g, unknown or other
  misc_feature (481)..(491): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgccctttcgttcttcgatctctggggccgcggcaccctggtcactgtctcctcagcctccaccaagggcccatcggtcttccccctggcgccctgctccaggancacctccgagagcacagcggccctgggcctgcctggtcaaggctacttcccgagcgacgactgagcgggctggcaaggcgcatagnnnnnnnnnnn

SEQ ID NO: 210200 - DNA, 486 bp, Homo sapiens
  misc_feature: GYAE6OF01EZXCQ.21.85.H08.1.454.CMB.1.raw
  modified_base (394)..(394): a, c, t, g, unknown or other
  misc_feature (394)..(394): n is a, c, g, or t
  modified_base (478)..(486): a, c, t, g, unknown or other
  misc_feature (478)..(486): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgccctttcgttcttcgatctctggggccgcggcaccctggtcactgtctcctcagccctccaccaagggcccatcgtctccccctggcgccctgctccaggancacctccgagagcacagcggccctgggctgcctggtcaaggctactccctcgtctctactgagcgggctggcaaggcgcatagnnnnnnnnn

SEQ ID NO: 210201 - DNA, 504 bp, Homo sapiens
  misc_feature: GYAE6OF01A7L58.21.85.H08.1.454.CMB.1.raw
  modified_base (494)..(504): a, c, t, g, unknown or other
  misc_feature (494)..(504): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgccctttcgttcttcgatctcgtgggccgcggcaccctggtcactgtctcctcagcctccaccaagggcccatccggtccttccccctggccgcccctgcctccaggacgccaccctccgagacgcacacgccggccctgggcctgcctggtcaaggctacttccctcgtcctctactgagcgggctggcaacggcgcatagnnnnnnnnnnn

SEQ ID NO: 210202 - DNA, 478 bp, Homo sapiens
  misc_feature: GYAE6OF01CHJA7.21.85.H08.1.454.CMB.1.raw
  modified_base (274)..(274): a, c, t, g, unknown or other
  misc_feature (274)..(274): n is a, c, g, or t
  modified_base (387)..(387): a, c, t, g, unknown or other
  misc_feature (387)..(387): n is a, c, g, or t
  modified_base (466)..(466): a, c, t, g, unknown or other
  misc_feature (466)..(466): n is a, c, g, or t
  modified_base (472)..(478): a, c, t, g, unknown or other
  misc_feature (472)..(478): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtncgcgtgatgggtggtgccttcgttcttcgatctctgggccgcggcaccctggtcactgtcctcctcagcctccacaaggcccatcggtctccccctggcgccctgctccaggngcacctccgagacgcacagcggccctgggctgcctggtcaaggctactccctcgtctctactgagcggctggcaaggcncatagnnnnnnn

SEQ ID NO: 210203 - DNA, 485 bp, Homo sapiens
  misc_feature: GYAE6OF01DLAVH.21.85.H08.1.454.CMB.1.raw
  modified_base (478)..(485): a, c, t, g, unknown or other
  misc_feature (478)..(485): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgccctttcgttcttcgatctctggggccgcggcaccctggtcactgtctcctcagcctccaccaagggcccatcggtcttcccctggcgccctgctccaggagcacctccgagagcacagcggccctgggctgcctggtcaaggctacttccctcgtctctactgagcgggctggcaggcgcatagnnnnnnnn

SEQ ID NO: 210204 - DNA, 487 bp, Homo sapiens
  misc_feature: GYAE6OF01ECPEV.21.85.H08.1.454.CMB.1.raw
  modified_base (393)..(393): a, c, t, g, unknown or other
  misc_feature (393)..(393): n is a, c, g, or t
  modified_base (479)..(487): a, c, t, g, unknown or other
  misc_feature (479)..(487): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgccctttcgttcttcgatctctggggccgcggcaccctggtcactgtctcctcagcctccaccaagggcccatcggtcttcccctggcgccctgctccaggngcacctccgagagcacagcggccctgggctgcctggtcaaggctacttcccgagccgacgactgagcgggctggcaggcgcatagnnnnnnnnn

SEQ ID NO: 210205 - DNA, 493 bp, Homo sapiens
  misc_feature: GYAE6OF01CEPSL.21.85.H08.1.454.CMB.1.raw
  modified_base (483)..(493): a, c, t, g, unknown or other
  misc_feature (483)..(493): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgccctttcgttcttcgatctctggggccgcggcaccctggtcactgtctcctcagcctccaccaagggcccatcggtcttccccctggccgccctgctcccaggagccacctccgagagcacacgcggccctgggcctgcctggcaaggctacttccctcgtctctactgagcggctggcaaggcgcatagnnnnnnnnnnn

SEQ ID NO: 210206 - DNA, 498 bp, Homo sapiens
  misc_feature: GYAE6OF01EAJF7.21.85.H08.1.454.CMB.1.raw
  modified_base (490)..(498): a, c, t, g, unknown or other
  misc_feature (490)..(498): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgccctttcgttcttcgatctctggggccgcggcacctggtcactgtctcctcagcctccaccaagggccccatcgtccttccccctggccgccctcgcctcccaggacgccacctccgagacgcacacgcggccctgggcctgcctggtcaaggctacttcccgagcgacgactgacgcgggctggcaaggcgcagtgnnnnnnnnn

SEQ ID NO: 210207 - DNA, 567 bp, Homo sapiens
  misc_feature: GYAE6OF01AY2R9.21.85.H08.1.454.CMB.1.raw
  modified_base (556)..(567): a, c, t, g, unknown or other
  misc_feature (556)..(567): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaaagaacctccctgtatctgacaaatgaacagtctgagagccgaggacacggccttatattactgtgcgcgtgagtggggttgggtcgtccctttcgttcttcgatctcgtggggccgcggcacccgtggtcactgtcctcctcacgccctccaccgaacgggcccagtccggtccttcccccgtggcccgccctgcctccgaggacgccaccgtccgagacgccacgacggcccggcccgtgggcctcggcccgtggtaccgaaacgggtaccttacccgttccccggagcccggaaccgtacgtggacggccgggcgtcgggacgaacgggcgacgagtacggnnnnnnnnnnnn

SEQ ID NO: 210208 - DNA, 556 bp, Homo sapiens
  misc_feature: GYAE6OF01C48FZ.21.85.H08.1.454.CMB.1.raw
  modified_base (249)..(249): a, c, t, g, unknown or other
  misc_feature (249)..(249): n is a, c, g, or t
  modified_base (320)..(320): a, c, t, g, unknown or other
  misc_feature (320)..(320): n is a, c, g, or t
  modified_base (438)..(438): a, c, t, g, unknown or other
  misc_feature (438)..(438): n is a, c, g, or t
  modified_base (523)..(523): a, c, t, g, unknown or other
  misc_feature (523)..(523): n is a, c, g, or t
  modified_base (547)..(556): a, c, t, g, unknown or other
  misc_feature (547)..(556): n is a, c, g, or t
tcagtcgtcgctcgcacgaccggtgctcgatttagtatcactcagtcgcggggtagaagcctttgaccaggcaggtcaggctgacctggttcttggtcatctcctccgagggagggctggagtgggtctctggtataaattacaagtggaggtcacacagcttatagagactctgtggaggggccattcaccatcctccagagacagccgaccaaagaacctccctagtatctgacaaatgaacagtcngagcgccgaggacacggtccttatattactgtgcgcgtgtagtggggttggtcgtcccttttgttcttcgntcgtcggtgggccgcgccaccgtggtcctactcgtcctcctacgcgtcccctaccgaccgaacgggcccctagttcccggtccctttccccgtggcccgtccctcgcctccgaggccnccaccgtccgagacgcaacgcgcccggcccgtgggcctcgccgtggtaccgaacggtccttacccgttccctcgttctcctacgngcggcggctggacgagcgacatgnnnnnnnnnn

SEQ ID NO: 210209 - DNA, 491 bp, Homo sapiens
  misc_feature: GYAE6OF01EK1CI.21.85.H08.1.454.CMB.1.raw
  modified_base (379)..(379): a, c, t, g, unknown or other
  misc_feature (379)..(379): n is a, c, g, or t
  modified_base (481)..(491): a, c, t, g, unknown or other
  misc_feature (481)..(491): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgccctttcgttcttcgatctcgtggggccgcggcaccctggtcactgtctcctcagcctccaccaaggcccatcggtctcccctgccnccctgctccaggacgcacctccgagcgcacacgcggccctgggctgcctggtcaaggctacttccctcgtctctactgacgcgggctggcaggcgcgatagnnnnnnnnnnn

SEQ ID NO: 210210 - DNA, 615 bp, Homo sapiens
  misc_feature: GYAE6OF01DPJWE.21.85.H08.1.454.CMB.1.raw
  modified_base (421)..(421): a, c, t, g, unknown or other
  misc_feature (421)..(421): n is a, c, g, or t
  modified_base (597)..(597): a, c, t, g, unknown or other
  misc_feature (597)..(597): n is a, c, g, or t
  modified_base (607)..(608): a, c, t, g, unknown or other
  misc_feature (607)..(608): n is a, c, g, or t
  modified_base (610)..(611): a, c, t, g, unknown or other
  misc_feature (610)..(611): n is a, c, g, or t
  modified_base (613)..(613): a, c, t, g, unknown or other
  misc_feature (613)..(613): n is a, c, g, or t
  modified_base (615)..(615): a, c, t, g, unknown or other
  misc_feature (615)..(615): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctatgaggggccgattcgccatctccagagacagcgccaaagaactccctgtatctgacaaaatgaaacagtctgagagccgaggacacggccttatattactgtgcgcgtgagtggggtttgggtcgtccctttcgtttcttcgatctcgtcgggccgcggcaccctggtcactgtcctcctcacgccctccaccgaaacgggcccagtccggtccttcccccgtggccgccctgcctccgacggacnccacccgtcgagacgacaccgaggcccggcccgttggggcctcggcccgtgggtaccgaaacgggtaccctttaaccgtttcccccgttccgttcccgttaccttaaccgtcggaacgggtccggggaccgttcggggaccgtaaacggggcccggtaccgtaaacgttacggacncgagcgcgcnngnngngn

SEQ ID NO: 210211 - DNA, 592 bp, Homo sapiens
  misc_feature: GYAE6OF01B3ZKX.21.85.H08.1.454.CMB.1.raw
  modified_base (585)..(590): a, c, t, g, unknown or other
  misc_feature (585)..(590): n is a, c, g, or t
  modified_base (592)..(592): a, c, t, g, unknown or other
  misc_feature (592)..(592): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgacaaatgaacagtctgagagccgaggacacggccttatattactgtgcgcgtgagttggggttggtcgtcccgttttcgtttcttcgtatcctcgtcggggccgcggcacccgttcggtctacgtcgtcctcctcgacgccctaccaccgaacgggcccacgttccggtcccttcccccgtggcccgtcccgtacgccctaccgacgggaccgccgacccgtaccgacgacgcaccgacggcccggcccgtgggcctcgtcccgtcggtacgaacggtcttaccgttacccgacgccgtaacgacgtcggacggccgggtcgcgggacgaacgggccgacgacgtagctgacgcagnnnnnngn

SEQ ID NO: 210212 - DNA, 614 bp, Homo sapiens
  misc_feature: GYAE6OF01BEKLD.21.85.H08.1.454.CMB.1.raw
  modified_base (601)..(601): a, c, t, g, unknown or other
  misc_feature (601)..(601): n is a, c, g, or t
  modified_base (604)..(604): a, c, t, g, unknown or other
  misc_feature (604)..(604): n is a, c, g, or t
  modified_base (607)..(611): a, c, t, g, unknown or other
  misc_feature (607)..(611): n is a, c, g, or t
  modified_base (613)..(614): a, c, t, g, unknown or other
  misc_feature (613)..(614): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgagtgggttgggtcgtcccttttcgttcttcgatctcgtggggcccgcggcctacccgtggtccacgtcgtcctcctcacgccctaccaccgaacgggcccctaacgtccggttcccttccccccggtggcccgccccttacggcctccgacggcgaccaccctccggacgacgccacgacggcccggcccgtcgggcctcggccgttaggtaccaacgggtccttacccgttccccgtccggttccttacccgttacgttcggaccgggtccggggtccgttcggggacccgtaaacggggccgaccgtaacgtaggccgngcngcnnnnngnn

SEQ ID NO: 210213 - DNA, 559 bp, Homo sapiens
  misc_feature: GYAE6OF01DB0R9.21.85.H08.1.454.CMB.1.raw
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (551)..(552): a, c, t, g, unknown or other
  misc_feature (551)..(552): n is a, c, g, or t
  modified_base (554)..(559): a, c, t, g, unknown or other
  misc_feature (554)..(559): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgagtggggtttgggtcgcccttttcgttcttcgatcgtcgtggggccgcggcaccctggtcacgtgtctcctcacgccctccaccgaacgggcccagtccggtccttcccccgtggccgcccctgcctccgaggacgccacccgtccgagacgcacgacgccgggccctggggcctcggcccgtgggtaccaagggtacctacctttccccgtcgtccttactacgtggacggccgggtctgggaccgaacgggccgaccgagtagncngcnncnnnnnn

SEQ ID NO: 210214 - DNA, 605 bp, Homo sapiens
  misc_feature: GYAE6OF01DGI11.21.85.H08.1.454.CMB.1.raw
  modified_base (589)..(589): a, c, t, g, unknown or other
  misc_feature (589)..(589): n is a, c, g, or t
  modified_base (593)..(593): a, c, t, g, unknown or other
  misc_feature (593)..(593): n is a, c, g, or t
  modified_base (597)..(603): a, c, t, g, unknown or other
  misc_feature (597)..(603): n is a, c, g, or t
  modified_base (605)..(605): a, c, t, g, unknown or other
  misc_feature (605)..(605): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgacaaatgaacagtctgagagccgaggacacggccttatattactgtgcgcgtgagtggggttgggtcgtcccgtttcgttcttcgtattctcggtcgggccgccggcctacccgtcggtcacgtcgtcctccctcacgtccctcccgaaccgtaaacgggccccacgttcccggtcctttccccccgtcggcccgtcccgtcgccgtacccgacgggaccgccgaccgtccggagaccgaccgaccgacggcccggccgtcggccgtcgcccgtggtacaacggtaccttacccttcccgtccggttccttccgtacgtcggcggccgggtccgtcggaccgacggtccgacgtacgtagngtcncgannnnnnngn

SEQ ID NO: 210215 - DNA, 522 bp, Homo sapiens
  misc_feature: GYAE6OF01B0LD7.21.85.H08.1.454.CMB.1.raw
  modified_base (395)..(395): a, c, t, g, unknown or other
  misc_feature (395)..(395): n is a, c, g, or t
  modified_base (511)..(522): a, c, t, g, unknown or other
  misc_feature (511)..(522): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgcctttcgttcttcgatctcgtgggccgcggcaccctggtcactgtctcctcagcctccaccaacgggcccatcggtccttccccctggccgccctcgctccgnggacgcaccctccgagacgcaccaggccggccctgggcctcggccgttggtacgaacggactaccgttcccgacgccgacgactcggacgcgggctgggcgaacgggcgcgatagnnnnnnnnnnnn

SEQ ID NO: 210216 - DNA, 672 bp, Homo sapiens
  misc_feature: GYAE6OF01DVUE8.21.85.H08.1.454.CMB.1.raw
  modified_base (659)..(659): a, c, t, g, unknown or other
  misc_feature (659)..(659): n is a, c, g, or t
  modified_base (663)..(672): a, c, t, g, unknown or other
  misc_feature (663)..(672): n is a, c, g, or t
tcagtcgtcgctcgcacgaccggtgctcgatttagtatcactcagtcgcggggtagaagcctttgaccaggcaggtcaggctgacctggttcttggtcatctcctccgaggggaaggggctggagtgggtctctggtataaattacaatggaggtcacacagcttatagagactctgtggaggggccattcaccatctccagagacagccgaccaaagaacctccctgtatctgacaaatgaacagtctgagacgccgaggaccacggtccttatattactgtgcgcgtgtagttggggttgggtcgtcccttttcggttcttcgattcgtcggtcggggccgcggccacccgtggtccacgttcgtcctcctcgacgtccctacccaaccgaacgggccctacgttcccgggttcccctttccccccgtcgggcccgtccccgtacggtccccttacccggaacgggtaccgaccccgtaccccgttacccgggaaggaccggacccaaccggaccgggccccgggtccccggttcggggcccttcgggcccgttcgggtaacccgaacgggttacccttaccctttccccgtcggttcccttcgtaccgttggacgggcccgggtcgtcgggaccgaacgggccgacgaagttaggntcgnnnnnnnnnn

SEQ ID NO: 210217 - DNA, 523 bp, Homo sapiens
  misc_feature: GYAE6OF01B5RP7.21.85.H08.1.454.CMB.1.raw
  modified_base (511)..(511): a, c, t, g, unknown or other
  misc_feature (511)..(511): n is a, c, g, or t
  modified_base (513)..(519): a, c, t, g, unknown or other
  misc_feature (513)..(519): n is a, c, g, or t
  modified_base (521)..(523): a, c, t, g, unknown or other
  misc_feature (521)..(523): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccattcaccatctccagagacagcgccaagaactccctgtatctgcaaatgaacagtctgagagccgaggacacggccttatattactgtgcgcgtgatgggttgggtgccctttcgttcttcgatctcgtggggccgcggcaccctggtcactgtctcctcagcctccaccaacgggcccatcggtcttccccctggccgccctgcctccgaggacgccacctccggagacgcaccacggccggcccgtggggcctcgcccgtggtcaacggacttaccttccctcgtcctctacgtgacggtccgggctgggcaaggcgcgagtagntnnnnnnncnnn

SEQ ID NO: 210218 - DNA, 564 bp, Homo sapiens
  misc_feature: GYAE6OF01BCSM9.21.85.H08.1.454.CMB.1.raw
  modified_base (455)..(455): a, c, t, g, unknown or other
  misc_feature (455)..(455): n is a, c, g, or t
  modified_base (554)..(564): a, c, t, g, unknown or other
  misc_feature (554)..(564): n is a, c, g, or t
tcagtcgtcgctcgcacgaccggtgctcgatttagtatcactcagtcgcggggtagaagcctttgaccaggcaggtcaggctgacctggttcttggtcatctcctccaggggaaggggctggagtgggtctctggtataaattacaatggaggtcacacagcttatagagactctgtgaggggccattcaccatctccagagacagcgaccaagaacctccctgtatctgacaaatgaacagtctgagacgccgagacacggcttatattactgtgcgcgtgtagtggggttcgggtacgtcccgtttacgttcgttcggattctcggtcggggtcccgcggacctacccgtggtccacttcgtcctccctcacgtccctcccaacgaaccgggcccacgttccggttcccttacccccgtggcccgtccctgcctccgagcgccaccctcgganacgcaacgacgccgcccgtggcctgcctaggacaacggtactaccttcccgcttcgtacctacgtgacggcgggtctcgggacaaggccatacgtagcnnnnnnnnnnn

SEQ ID NO: 210219 - DNA, 519 bp, Homo sapiens
  misc_feature: GYAE6OF01AY0JU.21.85.H08.1.454.CMB.1.raw
  modified_base (385)..(385): a, c, t, g, unknown or other
  misc_feature (385)..(385): n is a, c, g, or t
  modified_base (407)..(407): a, c, t, g, unknown or other
  misc_feature (407)..(407): n is a, c, g, or t
  modified_base (427)..(427): a, c, t, g, unknown or other
  misc_feature (427)..(427): n is a, c, g, or t
  modified_base (508)..(519): a, c, t, g, unknown or other
  misc_feature (508)..(519): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtcgtcctttcgttcttcgatctcgtggggccgcggcacccgtggtcactgtctcctcacgcctccaccaacgggcccatccggtccttcccccgnggccgccctgcctccgaggacnccgacctccgagacgcacgnggccggcccgtgggcctcggccctggtcaacggtacctaccgttccctcgtctctactgacggcggctggcaggcgcatgnnnnnnnnnnnn

SEQ ID NO: 210220 - DNA, 503 bp, Homo sapiens
  misc_feature: GYAE6OF01DXHZH.21.85.H08.1.454.CMB.1.raw
  modified_base (321)..(321): a, c, t, g, unknown or other
  misc_feature (321)..(321): n is a, c, g, or t
  modified_base (383)..(383): a, c, t, g, unknown or other
  misc_feature (383)..(383): n is a, c, g, or t
  modified_base (492)..(503): a, c, t, g, unknown or other
  misc_feature (492)..(503): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaacctccctgtatctgcaaaatgaacagtctgagagccgaggacacggccttatattactgtgcgcgtgatgggttgggtgccctttgttcttcgatctctggggccncggcaccctggtcactgtctcctcagcctcaccaacgggcccatcggtccttcccctggccnccctgcctccacggcgccacctccgagacgcacacgcggcccgtgggctcgcctggtcaaggactacttccgagcgacgactgagcgggctggcaacggcgacagtagnnnnnnnnnnnn

SEQ ID NO: 210221 - DNA, 594 bp, Homo sapiens
  misc_feature: GYAE6OF01B0Y49.21.85.H08.1.454.CMB.1.raw
  modified_base (166)..(166): a, c, t, g, unknown or other
  misc_feature (166)..(166): n is a, c, g, or t
  modified_base (406)..(406): a, c, t, g, unknown or other
  misc_feature (406)..(406): n is a, c, g, or t
  modified_base (431)..(431): a, c, t, g, unknown or other
  misc_feature (431)..(431): n is a, c, g, or t
  modified_base (581)..(581): a, c, t, g, unknown or other
  misc_feature (581)..(581): n is a, c, g, or t
  modified_base (585)..(587): a, c, t, g, unknown or other
  misc_feature (585)..(587): n is a, c, g, or t
  modified_base (589)..(594): a, c, t, g, unknown or other
  misc_feature (589)..(594): n is a, c, g, or t
tcagtcgtcgctcgcacgaccggtgctcgatttagtatcactcagtcgcggggtagaagcctttgaccaggcaggtcaggctgacctggttcttggtcatctcctccaggggaaggggctggagtgggtctctggtataaattacaatggaggtcacacagcttanagagactctgtgaggggccattcaccatctccagagacagcgaccaagacctccctgtatctgactaaaatgaaactagtcagaagacgaccgaggacacggccttataattactgtgcgcgtgagtgggttgggtcgtccctttcgttcttcgatctcgtcgggccgcgcctaccccgtggtccactcgtcctcctcacgccctccaccgaacggcccagttcccggtccttcccccgnggcccgcccgtcgcctcgacggacncctacccgtcgagacgcaccacgccggcccgtgggccttcgccgtacgggacaacggtacccttacccgtttccctcccgttccgttaccgtaccgttcggaacgggtccgggtactccgggaccggtaacggcccggtacgaacgtagngcgnnncnnnnnn

SEQ ID NO: 210222 - DNA, 607 bp, Homo sapiens
  misc_feature: GYAE6OF01DB4EC.21.85.H08.1.454.CMB.1.raw
  modified_base (430)..(430): a, c, t, g, unknown or other
  misc_feature (430)..(430): n is a, c, g, or t
  modified_base (589)..(589): a, c, t, g, unknown or other
  misc_feature (589)..(589): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (601)..(603): a, c, t, g, unknown or other
  misc_feature (601)..(603): n is a, c, g, or t
  modified_base (605)..(607): a, c, t, g, unknown or other
  misc_feature (605)..(607): n is a, c, g, or t
tcagtcgtcgctcgcacgaccggtgctcgatttagtatcactcagtcgcggggtagaagcctttgaccaggcaggtcaggctgacctggttcttggtcatctcctccagggaagggctggagtgggtctctggtataaattacaatggaggtcacacagcttatagagactctgtgagggccattcaccatctcagagacagcgaccaagacctcctgtatctgacaaatgaacagtctagagacgccgaggacacggccttatacttactgtgcgcgtgagtgggttggtcgtcctttcgttcttcgtatcgtcgtcgggccgtcggcctacccgtggtctacgtcgtcctcctcacgtccctaccaccgaacgggcccacgttccgttcccttcccccgtggtcccgccctacgccctccgaggaccnccgacccgtccgacggacgccaccgacggcccgggccgtcgggccgtcggtccgtacgggtacgaaccggtaccttacccttccccgttccgtcccttaccgtaccgtacgggaccggtccgggtacgtacgggaccgtacgggccgtacgtagtaggntcgacgcncncnnncnnn

SEQ ID NO: 210223 - DNA, 592 bp, Homo sapiens
  misc_feature: GYAE6OF01DCJGF.21.85.H08.1.454.CMB.1.raw
  modified_base (580)..(580): a, c, t, g, unknown or other
  misc_feature (580)..(580): n is a, c, g, or t
  modified_base (583)..(592): a, c, t, g, unknown or other
  misc_feature (583)..(592): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccattcaccatctccagagacagcgccaagaactccctgtatctgcaaatgaacagtctgagagccgagacacggccttatattactgtgtgcgtgagtgggttgggtgtcccttttcgttcgttcgactctcgtggggtccgcgccacccgtgtccactgtctcctcacgcctccgaccgaacgggcccacgtccggtcctttcccccgtggcccgtcccgtcgcctcccgaagggacgacccgaccctaccgacggacgaccaacgacggcccgggcccgtcgggccttcggcccgttcgggtaccgaaaccgggtaccttaacccgtttccccgtacgttccttccttaacgttcggacggtccgggcgtagggccgaacgggccgacgtatagncgnnnnnnnnnn

SEQ ID NO: 210224 - DNA, 540 bp, Homo sapiens
  misc_feature: GYAE6OF01EXEA5.21.85.H08.1.454.CMB.1.raw
  modified_base (507)..(507): a, c, t, g, unknown or other
  misc_feature (507)..(507): n is a, c, g, or t
  modified_base (528)..(531): a, c, t, g, unknown or other
  misc_feature (528)..(531): n is a, c, g, or t
  modified_base (534)..(534): a, c, t, g, unknown or other
  misc_feature (534)..(534): n is a, c, g, or t
  modified_base (537)..(540): a, c, t, g, unknown or other
  misc_feature (537)..(540): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgagacacggccttatattactgtgcgcgtgagttggggttgggtgtcccttttcggttcttcgattcgtcgtcggggccgcggccaccctggtccactgtcctcctcacgccctccacacggcccagtccgtccttcccctggccgccctgcctccgaggtacgccaccgtccgagacgccacgacgccggcccgtgggcctcgccgtcggtaccaagggccctaccgttcccgagccggaccacgtgacgcgggtcngggaccagggccacgatagcnnnngcngannnn

SEQ ID NO: 210225 - DNA, 604 bp, Homo sapiens
  misc_feature: GYAE6OF01E1IMO.21.85.H08.1.454.CMB.1.raw
  modified_base (366)..(366): a, c, t, g, unknown or other
  misc_feature (366)..(366): n is a, c, g, or t
  modified_base (444)..(444): a, c, t, g, unknown or other
  misc_feature (444)..(444): n is a, c, g, or t
  modified_base (592)..(596): a, c, t, g, unknown or other
  misc_feature (592)..(596): n is a, c, g, or t
  modified_base (599)..(604): a, c, t, g, unknown or other
  misc_feature (599)..(604): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccattcaccatctccagagacagcgaccaaagaacctccctgtatctgacaaatgaacagtctgagacgccgaggacacggccttatacttactgtgcgcgtgagtgggttgggtcgtcccgttttcgttcttcgattcgtcgtcggggccgcgggctacccgtggtccactcgtcctccctcncgtcccctccacccgaagggcccctagtcccgttcccttcccccgtcggcccgtccccgtcgcccttccgaacggacnccgacccgtccggagacgccgaccgcggccggtcccgtcgggctccggccgtggtacccgaaggtaccctaccgttccccggaaggtcccggtaacgtccgtgggacggccggggtacctgggaccgacgggccgacgtaagtacggnnnnngcnnnnnn

SEQ ID NO: 210226 - DNA, 560 bp, Homo sapiens
  misc_feature: GYAE6OF01BIK9R.21.85.H08.1.454.CMB.1.raw
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
  modified_base (549)..(560): a, c, t, g, unknown or other
  misc_feature (549)..(560): n is a, c, g, or t
tcagtcgtcgctcgcacgaccggtgctcgatttagtatcactcagtcgcggggtagaagcctttgaccaggcaggtcaggctgacctggttcttggtcatctcctccaggggaaggggctggagtgggtctctggtataaattacaatggaggtcacacagcttatagagactctgtgaggggccgattccaccatctccagagacagcgaccaaagaacctccctgtatctgacaaatgaacagtctgagagccgaggacacggtcttatattactgtgcgtcgtgtaggttggggttgggtcgtccccgttttcgttccttcgattccgtcggtcggggcccgcggcctacccgtggtccacgtcgtcctcctcacgccctccacgacggccctagtccgtcctccccgngccgcctgctcgagcnccncctcgagacgcacgacgccggcccgtgggcctcgccgtcggtaccgaacggtctcccgtaccgacggccgtaccgtacgtcggcgggccggtcgtcggaccgacggccgacgagtagnnnnnnnnnnnn

SEQ ID NO: 210227 - DNA, 686 bp, Homo sapiens
  misc_feature: GYAE6OF01EDGOW.21.85.H08.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (363)..(363): a, c, t, g, unknown or other
  misc_feature (363)..(363): n is a, c, g, or t
  modified_base (442)..(442): a, c, t, g, unknown or other
  misc_feature (442)..(442): n is a, c, g, or t
  modified_base (667)..(667): a, c, t, g, unknown or other
  misc_feature (667)..(667): n is a, c, g, or t
  modified_base (680)..(680): a, c, t, g, unknown or other
  misc_feature (680)..(680): n is a, c, g, or t
  modified_base (684)..(684): a, c, t, g, unknown or other
  misc_feature (684)..(684): n is a, c, g, or t
tcagtcgtcgctcgcacgaccggtgctcgattttagtatcactcagtcggcggggtagaagcctttgaccaggcaggtcaggctgacctggttcttggtcatctcctccagggaagggctggagtgggtctctggtataaattacaatggagtcacacagcttatagagactctgtgaggggccattcaccatcncaganacagcgacaagactcctgtactctagacaaatgaaactagtcgtaggacgtacgaccggaaggaccacggtacctttaagactttacgtcgtcgacggtcgtagagttgggggtttggtcgtccgttttacgttcttcggacgttccgtccggtcgggacccncgtaccctaccgtggtaccacgttcggtcctccgtcgacgccctccgaaccgtagggccctgtcccgttccttccccgnggtcctaccgtcgacctcgagaccgtccacgtaccggagacgaccgacgaccggccggtccccgttagggccctacggccccgttagggtaccgtaaacgggtaccctttaacccgttccccgttcgttaccgtttaccgttaaccggttacgggaccgggtccggggttaccgtaagggaccggtaaacggggtaccgaccgtaaagtccgggatcgcggtacncgagacgcgtacngtcncg

SEQ ID NO: 210228 - DNA, 590 bp, Homo sapiens
  misc_feature: GYAE6OF01D8ZJC.21.85.H08.1.454.CMB.1.raw
  modified_base (244)..(244): a, c, t, g, unknown or other
  misc_feature (244)..(244): n is a, c, g, or t
  modified_base (450)..(450): a, c, t, g, unknown or other
  misc_feature (450)..(450): n is a, c, g, or t
  modified_base (467)..(467): a, c, t, g, unknown or other
  misc_feature (467)..(467): n is a, c, g, or t
  modified_base (576)..(576): a, c, t, g, unknown or other
  misc_feature (576)..(576): n is a, c, g, or t
  modified_base (580)..(580): a, c, t, g, unknown or other
  misc_feature (580)..(580): n is a, c, g, or t
  modified_base (584)..(585): a, c, t, g, unknown or other
  misc_feature (584)..(585): n is a, c, g, or t
  modified_base (587)..(588): a, c, t, g, unknown or other
  misc_feature (587)..(588): n is a, c, g, or t
  modified_base (590)..(590): a, c, t, g, unknown or other
  misc_feature (590)..(590): n is a, c, g, or t
tcagtcgtcgctcgcacgaccggtgctcgatttagtatcactcagtcgcggggtagaagcctttgaccaggcaggtcaggctgacctggttcttggtcatctcctccagggaagggctggagtgggtctctggtataaattacaatggaggtcacacagcttatagagactctatgaggggccattccaccatctccagacgacgagccgacaaagacctccctgtactctgacaaatcgaacngtctagagacgccgaggaccaccggtacttatacttactgtcgcgcgtgacgtggggttggtcctcccgtttcgttcgttcgacttccgtcggtcggggtccgcgtcctacccgttggtccacttcgtcctccgtcgacgtccctacccgaacgacgggccctagttccggtcccttccccgtggccctccctgcctcgacggtcnccgacccgtacgagacncgacgaccggccggtccgtgggcctcggtcctggtacacgtacttcccgttaccctgtaccttcgacgtggacggcgggtctacgggacgacggccgtactaggtgctncgtncatnncnngn

SEQ ID NO: 210229 - DNA, 553 bp, Homo sapiens
  misc_feature: GYAE6OF01AN7QD.21.85.H08.1.454.CMB.1.raw
  modified_base (242)..(242): a, c, t, g, unknown or other
  misc_feature (242)..(242): n is a, c, g, or t
  modified_base (416)..(416): a, c, t, g, unknown or other
  misc_feature (416)..(416): n is a, c, g, or t
  modified_base (434)..(434): a, c, t, g, unknown or other
  misc_feature (434)..(434): n is a, c, g, or t
  modified_base (509)..(509): a, c, t, g, unknown or other
  misc_feature (509)..(509): n is a, c, g, or t
  modified_base (519)..(519): a, c, t, g, unknown or other
  misc_feature (519)..(519): n is a, c, g, or t
  modified_base (538)..(540): a, c, t, g, unknown or other
  misc_feature (538)..(540): n is a, c, g, or t
  modified_base (544)..(544): a, c, t, g, unknown or other
  misc_feature (544)..(544): n is a, c, g, or t
  modified_base (546)..(549): a, c, t, g, unknown or other
  misc_feature (546)..(549): n is a, c, g, or t
  modified_base (551)..(553): a, c, t, g, unknown or other
  misc_feature (551)..(553): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtcngagagccgaggacacggccttatacttactgtgcgtcgtgagttgggttgggtcgtccccgttttcgttccgttcgtacttcgttcgtcggggtccgacgggccaccccgtggtctacgtgtcctcctcgcgccctccaccgaacggcccatccggtccttcccccgtggcccncccgtgcctcgacggacnccgaccctccgagacgcaccgtacgcccgccgtcgggctcggccgtggacaacgtctacctcccgtctctctacngcggccggtncggtcacggcgacgtagtnnnacgncnnnncnnn

SEQ ID NO: 210230 - DNA, 670 bp, Homo sapiens
  misc_feature: GYAE6OF01CLGZH.21.85.H08.1.454.CMB.1.raw
  modified_base (408)..(408): a, c, t, g, unknown or other
  misc_feature (408)..(408): n is a, c, g, or t
  modified_base (660)..(660): a, c, t, g, unknown or other
  misc_feature (660)..(660): n is a, c, g, or t
  modified_base (662)..(662): a, c, t, g, unknown or other
  misc_feature (662)..(662): n is a, c, g, or t
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtggtctctggtataaattacaatggaggtcacacagcttatagagactctgtgaggggccattcaccatctccagagacagcgaccaagaacctcctgtatctgacaaatgaacagtctgagagccgaggacacggccttatattactgtgcgcgtggatgggttgggtctccgttttcgttcttcgatctcgtcggggccgcggcctacccgtggtacacgttgtcctcctcgacgtcctcccaaccgaacgggccctaacgtcccgggttccctttcccccgnggcccgtccccgttgcccgtccgacggaccgcctaacccgtccggaagacggccaaccgtacggccgggaccccgttcggggcccttcggcccgttagggtaccgtaaacgggtacccgtttaaccccgtttacccggaaccggacccggtaaccggtaccgtacggggacgggtacccgggggtacggttccgggggaacccggtaaaccgggccggtaccgtaacggttaacgggctacggctgtacgcngngcngngtg

SEQ ID NO: 210231 - DNA, 648 bp, Homo sapiens
  misc_feature: GYAE6OF01DFK9N.21.85.H08.1.454.CMB.1.raw
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (319)..(319): a, c, t, g, unknown or other
  misc_feature (319)..(319): n is a, c, g, or t
  modified_base (420)..(420): a, c, t, g, unknown or other
  misc_feature (420)..(420): n is a, c, g, or t
  modified_base (631)..(631): a, c, t, g, unknown or other
  misc_feature (631)..(631): n is a, c, g, or t
  modified_base (638)..(638): a, c, t, g, unknown or other
  misc_feature (638)..(638): n is a, c, g, or t
  modified_base (640)..(642): a, c, t, g, unknown or other
  misc_feature (640)..(642): n is a, c, g, or t
  modified_base (644)..(644): a, c, t, g, unknown or other
  misc_feature (644)..(644): n is a, c, g, or t
  modified_base (646)..(646): a, c, t, g, unknown or other
  misc_feature (646)..(646): n is a, c, g, or t
  modified_base (648)..(648): a, c, t, g, unknown or other
  misc_feature (648)..(648): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtggaggggccattcaccatctccagagacagccgccaaagaacctccctgtatcctgacaaatgaacngtcngagagaccgagacacggtccttatattactgtgcgcgtgtagtgggttggtcgttccctttgttcttacggnttcgtcggtggggccgcggtccacccgtggtcctacgttcgtacctccgtcaccgtccctaccgaaccgacggccctacgttcccggtccctttcccccgnggtccctcccttcggcctaccgacgggaccgacccaccgtaccggacgtacgaccgtaaccgaccggcccgggtcccggtacggggtctccggtccggttacggaccgtaaccgggttaccctttacccgttccccgttaccgtttccgtccttacggttcggccgggtacgggtcgtaccgggacgtaacggggcctacgaacttaggcngcgagcncnnncngngn

SEQ ID NO: 210232 - DNA, 687 bp, Homo sapiens
  misc_feature: GYAE6OF01AIKCK.21.85.H08.1.454.CMB.1.raw
  modified_base (665)..(665): a, c, t, g, unknown or other
  misc_feature (665)..(665): n is a, c, g, or t
  modified_base (668)..(668): a, c, t, g, unknown or other
  misc_feature (668)..(668): n is a, c, g, or t
  modified_base (681)..(683): a, c, t, g, unknown or other
  misc_feature (681)..(683): n is a, c, g, or t
  modified_base (685)..(685): a, c, t, g, unknown or other
  misc_feature (685)..(685): n is a, c, g, or t
  modified_base (687)..(687): a, c, t, g, unknown or other
  misc_feature (687)..(687): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctcgtggtataaattacaatggaggtcacacagcttatagagactctgtgaggggccattcaccatctccagagacagcgaccaaagaaccttccctgtatctagcaaatgaacctagtctagagcgaccgaggtaacgaccggtaccttagtacttactgtacggccgtcgtggtaggttggggtttcgggtcggtcccgttttcgttccgttcgtagtccttcggtcggggccggcggtccgtacccgttggtacctacgttcgtccgtccttacaccggtccctacccaaccgaacgggtccccacggttcccgggttccccttacccccggtcggtacccgccccgttacggtccctacccgacgggtacgcccgtaaccgttccgacgacgacctaccgggacggtccccgggtcccggtacgggtccgtccggacccgttggtacccgtaaacggtcccgttacccgtttccccgttcctccgttacctacgtcggtaccggcggtccgtggtaccgacggcgtaactgancgngtcagtcagtcgnnngngn

SEQ ID NO: 210233 - DNA, 592 bp, Homo sapiens
  misc_feature: GYAE6OF01BXWDH.21.85.H08.1.454.CMB.1.raw
  modified_base (196)..(196): a, c, t, g, unknown or other
  misc_feature (196)..(196): n is a, c, g, or t
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
  modified_base (267)..(267): a, c, t, g, unknown or other
  misc_feature (267)..(267): n is a, c, g, or t
  modified_base (315)..(315): a, c, t, g, unknown or other
  misc_feature (315)..(315): n is a, c, g, or t
  modified_base (578)..(578): a, c, t, g, unknown or other
  misc_feature (578)..(578): n is a, c, g, or t
  modified_base (581)..(581): a, c, t, g, unknown or other
  misc_feature (581)..(581): n is a, c, g, or t
  modified_base (583)..(585): a, c, t, g, unknown or other
  misc_feature (583)..(585): n is a, c, g, or t
  modified_base (587)..(592): a, c, t, g, unknown or other
  misc_feature (587)..(592): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgacggggccattcaccatcncagagacagcgacaagacctcctgtanctgacaaatgaacngtcngagacgcgagacacgctatatactgngcgcgtgagtgggttggtcgtcctttgttctcgatcgtcggcgggccncggcctaccgtggtcactcgtcctcctcacgtccctaccgaaccgacgggccctaacgtcgggttccccttccccgtggaccctcccgtacgcctcgacggtacgcccgaccgtccggacgacgcctaaccgacggtccgggcccgtgggccgtcgtccggtacggtacgaaacgggtacccttccgttaccccttccgtaccttaccgtacggtacggtacggccgggtacgtacgggacaaaccgggtcaacgtacggtancgncnnncnnnnnn

SEQ ID NO: 210234 - DNA, 655 bp, Homo sapiens
  misc_feature: GYAE6OF01EFCFG.21.85.H08.1.454.CMB.1.raw
  modified_base (128)..(128): a, c, t, g, unknown or other
  misc_feature (128)..(128): n is a, c, g, or t
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
  modified_base (510)..(510): a, c, t, g, unknown or other
  misc_feature (510)..(510): n is a, c, g, or t
  modified_base (618)..(618): a, c, t, g, unknown or other
  misc_feature (618)..(618): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
  modified_base (654)..(655): a, c, t, g, unknown or other
  misc_feature (654)..(655): n is a, c, g, or t
tcagtcgtcgctcgcacgaccggtgctcgatttagtatcactcagtcgcggggtagaagcctttgaccaggcaggtcaggctgacctggttcttggtcatctcctcagggagggctggagtgggtctnaggtataaattacaagtggagtcacacagcttatacgagactctgtggagggccattcacatctccagagacagcgaccaaacgtaactccctgtactcncgaacaaatcgtaacagttcgnggaacggacgcgtaacggaccaacggtccttaatacttacgtgtgcgtcgtagtacggtgggtttcgggtccgtccgttttcggttaccgtttacacggttcccgtcggttaccggggccgtccggtacctcccgtcggtcctacgtcgtctcctcgacgccttacccgacgaacgggtccctacgtcccgttaccccgtcccgtcggcccgtcctcgaccgtaccgaacggtaccgccgtacccgtacggaacggtacnccggtaacgacccggtccgccggtacgtcgtacgtccgtagtacccgagtccctacgttccctcgtaccttcgtaacgtcgacggccggttcgacggtaccgtacggngtaccgtagtacgcgtgaacctgccgtagcgncngnn

SEQ ID NO: 210235 - DNA, 728 bp, Homo sapiens
  misc_feature: GYAE6OF01BOB5P.21.85.H08.1.454.CMB.1.raw
  modified_base (164)..(164): a, c, t, g, unknown or other
  misc_feature (164)..(164): n is a, c, g, or t
  modified_base (279)..(279): a, c, t, g, unknown or other
  misc_feature (279)..(279): n is a, c, g, or t
  modified_base (706)..(706): a, c, t, g, unknown or other
  misc_feature (706)..(706): n is a, c, g, or t
  modified_base (710)..(710): a, c, t, g, unknown or other
  misc_feature (710)..(710): n is a, c, g, or t
  modified_base (720)..(720): a, c, t, g, unknown or other
  misc_feature (720)..(720): n is a, c, g, or t
  modified_base (723)..(723): a, c, t, g, unknown or other
  misc_feature (723)..(723): n is a, c, g, or t
  modified_base (725)..(725): a, c, t, g, unknown or other
  misc_feature (725)..(725): n is a, c, g, or t
  modified_base (727)..(727): a, c, t, g, unknown or other
  misc_feature (727)..(727): n is a, c, g, or t
tcagtcgtcgctcgcacgaccggtgctcgatttagtatcactcagtcgcggggtagaagcctttgaccaggcaggtcaggctgacctggttcttggtcatctcctccgagggaagggctggagtgggtctctggtataaattacaatggagtcacacagcttanagagactctgtgagggccattcacatctcagagactagcgaccaaagacctcctagtactctgacaaatcgaacacgttcaggagacgccgaggacaccggtcttatacttacgngtcgcgtacgtggtaggttggggttcggtcgtcccgttttcgtttcgttcgtactccgttcggtacggggcccgtacgcccgtacccgttggtcctacgttccgttcctacccgtcgaaccgcccttacccgaaccgaaccgggtaccctacggttcccggtttcccttcccccggtaggccccttcccgtcggtacccgtaccggacggtaccgccgtacccgtacggacggaaccgaccgaaccggacccggtccgggtcccggtggtcccgtaaccggtcccggttacgggtaacggtaaaccggtaccccgttacccggttacccggaacggtacccgtaaaccgggtaccggtcgggtaacccgggccggttaccgggtacggaaccgggtaacgggacccgttacggtaaacggtgacggngcgngcgtacgacngcngngng

SEQ ID NO: 210236 - DNA, 652 bp, Homo sapiens
  misc_feature: GYAE6OF01AW444.21.85.H08.1.454.CMB.1.raw
  modified_base (155)..(155): a, c, t, g, unknown or other
  misc_feature (155)..(155): n is a, c, g, or t
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (446)..(446): a, c, t, g, unknown or other
  misc_feature (446)..(446): n is a, c, g, or t
  modified_base (531)..(531): a, c, t, g, unknown or other
  misc_feature (531)..(531): n is a, c, g, or t
  modified_base (637)..(637): a, c, t, g, unknown or other
  misc_feature (637)..(637): n is a, c, g, or t
  modified_base (643)..(645): a, c, t, g, unknown or other
  misc_feature (643)..(645): n is a, c, g, or t
  modified_base (647)..(647): a, c, t, g, unknown or other
  misc_feature (647)..(647): n is a, c, g, or t
  modified_base (649)..(649): a, c, t, g, unknown or other
  misc_feature (649)..(649): n is a, c, g, or t
  modified_base (651)..(652): a, c, t, g, unknown or other
  misc_feature (651)..(652): n is a, c, g, or t
tcagtcgtcgctcgcacgaccggtgctcgatttagtatcactcagtcgcggggtagaagcctttgaccaggcaggtcaggctgacctggttcttggtcatctcctccagggaagggctggagtggtctctggtataaattacaagtggaggtcanacagcttatagagactctgtgaggggccattcaccatcnccaganacagcgccaaagaacctccctagtactctgacaaagtacgaacgtagttcgaggagacgcgaggaccacggtccttaatattactggtcgtcgacgtggagttggggttcggttcgtacccgttttcgtttcttcggtattccgtcgttcggggccgtcggacctacccgttaggttcacgttcgtcctacctcacggccctaccgaaccggaccggtaccctagttcccggtccctttcccccgnggtccccgacccttgcccgtacccgaaggtaccgacccgaccccgttaccgaacggaccaccgacggaaccggcccggtacccgnggtcccgtacgcggttacggtacaaccggttccgttaacccttcccgtaccgttccgttactacgttagacggccggtgtacggaccgtacgacgccgaagtcgangtagcnnnancngnn

SEQ ID NO: 210237 - DNA, 810 bp, Homo sapiens
  misc_feature: GYAE6OF01E5PLN.21.85.H08.1.454.CMB.1.raw
  modified_base (789)..(789): a, c, t, g, unknown or other
  misc_feature (789)..(789): n is a, c, g, or t
  modified_base (795)..(795): a, c, t, g, unknown or other
  misc_feature (795)..(795): n is a, c, g, or t
  modified_base (802)..(802): a, c, t, g, unknown or other
  misc_feature (802)..(802): n is a, c, g, or t
  modified_base (804)..(805): a, c, t, g, unknown or other
  misc_feature (804)..(805): n is a, c, g, or t
  modified_base (808)..(808): a, c, t, g, unknown or other
  misc_feature (808)..(808): n is a, c, g, or t
  modified_base (810)..(810): a, c, t, g, unknown or other
  misc_feature (810)..(810): n is a, c, g, or t
tcagtcgtcgctcgcacgaccggtgctcgatttagtatcactcagtcgcgggtagaagcctttgaccaggcaggtcaggctgacctgttcttggtcatctcctccagggaagggctggagtgggtctctggtataaattacatggaggtcacacagcttatagagactctgtggagggccattccaccatcctccgagacgacgacggcgaccaaacggaacctcccgtaggtactcgtacgactaaacgtcgaacgtacggtcttacggaaggaccggaccgggtaacggaaccgtaccggttaaccctttaagttaacgttaccgtggtcggtaccggtcggtaggtacgggttcggggtttccgggttcccggtttccccgtttttccggttaccgttaccggtaccggttcccggttccgggtccgggggtcccggtccggtaccccggtacccggttcggtaccgtaccgttaccgttccgtacccgtccgtacccgtacccgtacccggtaaaccggtacccggtacccgtaccgttccccggtttccccgttccccggtccggtccccgtccggttccggacccggtaccggacggtacccgtaccccgtacccgtaccggaacggaccgtacccggaccggaccggcccgggtaccgtccgggtcccgtaccggtccggtacggtaaccgtaaccgttaccctttcccgttacccgttccgttcgtaccggttacgacggaccgggtccgtacggacgacggtaccggcgtaacgtcgtgngcgagngatcgcncnncgngn

SEQ ID NO: 210238 - DNA, 797 bp, Homo sapiens
  misc_feature: GYAE6OF01AJHIV.21.85.H08.1.454.CMB.1.raw
  modified_base (785)..(785): a, c, t, g, unknown or other
  misc_feature (785)..(785): n is a, c, g, or t
  modified_base (788)..(788): a, c, t, g, unknown or other
  misc_feature (788)..(788): n is a, c, g, or t
  modified_base (790)..(790): a, c, t, g, unknown or other
  misc_feature (790)..(790): n is a, c, g, or t
  modified_base (793)..(793): a, c, t, g, unknown or other
  misc_feature (793)..(793): n is a, c, g, or t
  modified_base (795)..(795): a, c, t, g, unknown or other
  misc_feature (795)..(795): n is a, c, g, or t
  modified_base (797)..(797): a, c, t, g, unknown or other
  misc_feature (797)..(797): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacacgcgaccaagaacctccctgtatctgacaaatgaacagtctagagacgccgagacgacggtccttatattactgtcgcgcgtgagttgggttgggtcgttcccgtttcgttcttcgtacgtcgttcgtcggggcccgtcggccgtacccgtggtccaccgttcgttccttccctccgaccgtcccctacccgaacccgaaccgggtccccctaaggttccccgggtttccccctttcccccccggtcgggtccccgtcccccgttcggtaccccgttacccggaacgggaccgtaccccgtaaccccggtacccgggaacggtaaccggcccaaacccgtacccggggtccccgggtacccccgggttcggggtccccgttcccgggtacccggtttaaccggggtaacccgtaaacccggggttttaacccccttttaccccccggttttaccccccggttcccggttttaccccgtttaacccgtttacccggttacggggacccgggggtcccggggtcccggttaacggggcccggtaaaccgggcccgttacggtaaacgttcggcgagctacgntcncngcngngn

SEQ ID NO: 210239 - DNA, 642 bp, Homo sapiens
  misc_feature: GYAE6OF01BTCLG.21.85.H08.1.454.CMB.1.raw
  modified_base (493)..(493): a, c, t, g, unknown or other
  misc_feature (493)..(493): n is a, c, g, or t
  modified_base (619)..(619): a, c, t, g, unknown or other
  misc_feature (619)..(619): n is a, c, g, or t
  modified_base (625)..(625): a, c, t, g, unknown or other
  misc_feature (625)..(625): n is a, c, g, or t
  modified_base (630)..(630): a, c, t, g, unknown or other
  misc_feature (630)..(630): n is a, c, g, or t
  modified_base (633)..(633): a, c, t, g, unknown or other
  misc_feature (633)..(633): n is a, c, g, or t
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
  modified_base (640)..(641): a, c, t, g, unknown or other
  misc_feature (640)..(641): n is a, c, g, or t
tcagtcgtcgctcgcacgaccggtgctcgatttagtatcactcagtcgcggggtagaagcctttgaccaggcaggtcaggctgacctggttcttggtcatctcctccgagggaaggggctggagtgggtctcgtggtataaattacaatggagtcacacagcttatagagactcgtgtaggaggggccattccaaccattcctccgagaagacagcgaccaaagtacctccgtagtctctagaacaaagtagaactagtcgtagagacgcggaggacgacgtacttagtattcgtgtcgcgcggttgagttggggtcggtcgttcccgttttcgttccgttcgtacttcggtccggttcgggcccggtcggtcccgtaccgtcgtacctcgtcgttcctcgtcaccgtccctaccgaaccggacggtccctacgtccggttaccctcccgtcggcccaccgtcgccgtacggagcctccgaccgtcgacgacncacgcggccgtccggcggctcggcgtacggtaccgtaacgtccgttaccttccggtacgttcctaccgttacggcggtaaccggggtccgtacggacgttacgggaacctccgggtaagcggtacnccggtnacgtngcncancngnng

SEQ ID NO: 210240 - DNA, 689 bp, Homo sapiens
  misc_feature: GYAE6OF01C15D4.21.85.H08.1.454.CMB.1.raw
  modified_base (677)..(683): a, c, t, g, unknown or other
  misc_feature (677)..(683): n is a, c, g, or t
  modified_base (685)..(689): a, c, t, g, unknown or other
  misc_feature (685)..(689): n is a, c, g, or t
tcagtcgtcgctcgcacgaccggtgctcgatttagtatcactcagtcgcggggtagaagcctttgaccaggcaggtcaggctgacctggttcttggtcatctcctccgagggaaggggctggagtgggtctctggtataaattacaagtggaggtcacacagcttaatagagactctgtgaggggccattcaccatctccagagacagccgaaccaagtaactccctgtactctagacaaatcgaacagtcagagacgacgaggacctacggccttaataacttactagtcgcgcgtagagttcgggtggtcgtccctttgtcgttcgactctcggtcgggccgcggcctacccgtggtcacttcgtcctaccgttccacgtaccctaccgaaccgtaaacggtcccaacgttcccgggtttaccccttcccccggtggtccccgtaccccgttccggacccgttacccggaagggaccgtaccgaaccccgtacccggacggtaaccgacccgtaacggaaccgggcccgggtaccccgtcgggggtaccctccgggttacccgttacgggtaacccgtaaacgggtaccctttaacccgtttccccgttaccgtttaccgttacgtacgttcgggaacggtcgggacctagggaaccagggtccgactaaggtannnnnnnannnnn

SEQ ID NO: 210241 - DNA, 772 bp, Homo sapiens
  misc_feature: GYAE6OF01EOR5A.21.85.H08.1.454.CMB.1.raw
  modified_base (617)..(617): a, c, t, g, unknown or other
  misc_feature (617)..(617): n is a, c, g, or t
  modified_base (709)..(709): a, c, t, g, unknown or other
  misc_feature (709)..(709): n is a, c, g, or t
  modified_base (739)..(739): a, c, t, g, unknown or other
  misc_feature (739)..(739): n is a, c, g, or t
  modified_base (752)..(752): a, c, t, g, unknown or other
  misc_feature (752)..(752): n is a, c, g, or t
  modified_base (757)..(757): a, c, t, g, unknown or other
  misc_feature (757)..(757): n is a, c, g, or t
tcagtcgtcgctcgcacgaccggtgctcgatttagtatcactcagtcgcgggtagaagcctttgaccaggcaggtcaggctgacctggttcttggtcatctcctcagggagggtctggagtggtctcgtgtataaattcaagtggacgtcacacgagtcttagacgagtactcgtgtaggaggggcctattcgacctatccgccgagacgtacgagaccgtaccgaaagtacccttccgttaggtaacttcgtacgtaaccgtaaaagttcgaacctacggttccgtagaacggacggtaccggagtaccgtaccggtcttaagtacttacgtcggtacgtcgtacggttagacggtttggggtttacgtcgtttacccgtttgttaccgttggacgttcgtacgggtcgggtcccgtcggtacccctaccggttggtacctaacgttccgttacctacccgttacgaccggtcccctaccggaacggtaccggtcccctaggttcccggttaccccgttccgacggtcccttacccgcgttccgaaccgtacgtccgtaacctacccgtcgaaccacggtcccaacggtacccggaccggtcgtacggccgtttcnccgggttaaccggaaccttacggtttaccccgtaccggtttcccgtagttcccgttaacgccggttaacggtcccggtaccggttacccggnggttaaccccgaggtaccctagtacgttancggtctagccgtntacgnttaccgacttgcgga

SEQ ID NO: 210242 - DNA, 579 bp, Homo sapiens
  misc_feature: GYAE6OF01APCYK.21.85.H08.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (563)..(563): a, c, t, g, unknown or other
  misc_feature (563)..(563): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (574)..(577): a, c, t, g, unknown or other
  misc_feature (574)..(577): n is a, c, g, or t
  modified_base (579)..(579): a, c, t, g, unknown or other
  misc_feature (579)..(579): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtggaggggccattcaccatctccaganacagcgaccaagacctcctgtatctgacaaatgaacngtcngagagccgaggacacggccttatattacgtgtgcgcgtgagtgggttgggtcgtccctttcgttcttcgtatcgtcgtcgggccgcgccaccgtggtcacgtcgtcctcctcacgcctcccacgacggccctagtccgttcccttccccgtcggcccgtcccgtcgccgttccgacggacgtccacccgtccgacgacgcacgcggacccgcccggtcgggtcctcgtccgtcggtaccgaacggtccttacccgttcccgtcgttccttcgtacgtggtacggccgggtcgtacggaccgtacggccgacgtacgagtncgacngntngnnnngn

SEQ ID NO: 210243 - DNA, 668 bp, Homo sapiens
  misc_feature: GYAE6OF01EYCXF.21.85.H08.1.454.CMB.1.raw
  modified_base (246)..(246): a, c, t, g, unknown or other
  misc_feature (246)..(246): n is a, c, g, or t
  modified_base (290)..(290): a, c, t, g, unknown or other
  misc_feature (290)..(290): n is a, c, g, or t
  modified_base (653)..(653): a, c, t, g, unknown or other
  misc_feature (653)..(653): n is a, c, g, or t
  modified_base (658)..(658): a, c, t, g, unknown or other
  misc_feature (658)..(658): n is a, c, g, or t
  modified_base (660)..(660): a, c, t, g, unknown or other
  misc_feature (660)..(660): n is a, c, g, or t
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
  modified_base (668)..(668): a, c, t, g, unknown or other
  misc_feature (668)..(668): n is a, c, g, or t
tcagtcgtcgctcgcacgaccggtgctcgatttagtatcactcagtcgcggggtagaagcctttgaccaggcaggtcaggctgacctggttcttggtcatctccctccaggggaaggggctggagtgggtctctggtataaattacaatgggaggtcacacagcttatagagactctgtggacggggccattcaccatctaccagagacagcgacaacgaacctcctagtatctgacaaatgaacntctgagacgcgagacacggtcttatattacgtgtgcgcggtagnggttggggttggtccgtccccgttttcgtttacgttcgtacgttcgtcgggtcggggcccgcgtcccgtacctgggtacctacgttcgtccttcccgccgtaccgtccccaccctaaccggaccgggtacccctacggttcccccggtttccccgttcccccgggtccggcccgtccccgtcggacccgttccgaacgggacctaccgtacccggtaccggacgtacgaccacggacccggccggtcccggcggtcgtcgtcccgtacggtaccgtaaccgggtaccttcccgaccggaccggacgacgtcgacggcggcgggtcgacggaaccggaggaccgtacgtaacgtaggcgtagcncgacncngncngngn

SEQ ID NO: 210244 - DNA, 735 bp, Homo sapiens
  misc_feature: GYAE6OF01CVVQH.21.85.H08.1.454.CMB.1.raw
  modified_base (286)..(286): a, c, t, g, unknown or other
  misc_feature (286)..(286): n is a, c, g, or t
  modified_base (335)..(335): a, c, t, g, unknown or other
  misc_feature (335)..(335): n is a, c, g, or t
  modified_base (382)..(382): a, c, t, g, unknown or other
  misc_feature (382)..(382): n is a, c, g, or t
  modified_base (718)..(718): a, c, t, g, unknown or other
  misc_feature (718)..(718): n is a, c, g, or t
  modified_base (723)..(723): a, c, t, g, unknown or other
  misc_feature (723)..(723): n is a, c, g, or t
  modified_base (727)..(727): a, c, t, g, unknown or other
  misc_feature (727)..(727): n is a, c, g, or t
  modified_base (729)..(731): a, c, t, g, unknown or other
  misc_feature (729)..(731): n is a, c, g, or t
  modified_base (733)..(733): a, c, t, g, unknown or other
  misc_feature (733)..(733): n is a, c, g, or t
  modified_base (735)..(735): a, c, t, g, unknown or other
  misc_feature (735)..(735): n is a, c, g, or t
tcagtcgtcgctcgcacgaccggtgctcgatttagtatcactcagtcgcggggtagaagcctttgaccaggcaggtcaggctgacctggttcttggtcatctcctccgaggggaagggctggagtgggtctcgtaggtaattaaattacgaaagtgggacggtcaacgaacaggtccttaagtaaggacaccttcgtggtacggacggggcctaattccaacctattccacgaagacgacgacgccgaccaaagacctccgtagtactcgtagaactaaagcgaanagtcgagagacggaccgtaaggacacggtcttaagtattacgtgtacgngtcgtaggtggtggggtttcggtccgtttcctttcgttcgtaccgtntccggtcgggacggtcccgcgtccgtacccgttgacctccgtcgtcctcgtaccgccgttaccccaccgaaccggaaacccggtccgtaccttcccccggggtttccctcccccggtcggtacccctccggttacgccccgtaacggcgaccgtaccccgtaccgacgaacgccgacggtaccgaccgggtcccggtccggtcggtacccgcgtacccgtggttaaccgaacgtttccctaaccgggtaccgacgtaacccgggtacgacggtacccgggacggtcccgggaacggtcggaaacccgtaccggggacttaccgggtacgaggtacncgagncgcncnnngngn

SEQ ID NO: 210245 - DNA, 656 bp, Homo sapiens
  misc_feature: GYAE6OF01BSCID.21.85.H08.1.454.CMB.1.raw
  modified_base (643)..(643): a, c, t, g, unknown or other
  misc_feature (643)..(643): n is a, c, g, or t
  modified_base (645)..(645): a, c, t, g, unknown or other
  misc_feature (645)..(645): n is a, c, g, or t
  modified_base (647)..(648): a, c, t, g, unknown or other
  misc_feature (647)..(648): n is a, c, g, or t
  modified_base (650)..(651): a, c, t, g, unknown or other
  misc_feature (650)..(651): n is a, c, g, or t
  modified_base (653)..(656): a, c, t, g, unknown or other
  misc_feature (653)..(656): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctatggaggggccattcaccatctccagagacagcgaccaagaacctccctagtactctgacaaatcgaacagtctagagacgaccgaggacacggccttatattactgtgcgcgtgagttgggttgggtcgtcccgttttcgttcttcgatcgtcgtcggggccgcggccacccgtggtccacgtcgttcctcctcgacgtccctcccgaaccgaaccgggtccctacgttcccggttaccccttcccccgtcggcccgtcccccgtgtcccgtacccgacgggaccgacccgtaccccgtaccgggacgaccggacccgacgaccgggccccgggaccccgtcggggtcctcccggtcccgttacgggtacgtaaccgggtacccttaccccgtttccccgttccggttaccttaccgttaacgttcgggacggtccggggtactcgggacgacggcgacgtacgtagncncnncnnannnn

SEQ ID NO: 210246 - DNA, 621 bp, Homo sapiens
  misc_feature: GYAE6OF01D7YLD.21.85.H08.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (577)..(577): a, c, t, g, unknown or other
  misc_feature (577)..(577): n is a, c, g, or t
  modified_base (596)..(596): a, c, t, g, unknown or other
  misc_feature (596)..(596): n is a, c, g, or t
  modified_base (606)..(606): a, c, t, g, unknown or other
  misc_feature (606)..(606): n is a, c, g, or t
  modified_base (611)..(611): a, c, t, g, unknown or other
  misc_feature (611)..(611): n is a, c, g, or t
  modified_base (615)..(615): a, c, t, g, unknown or other
  misc_feature (615)..(615): n is a, c, g, or t
  modified_base (617)..(621): a, c, t, g, unknown or other
  misc_feature (617)..(621): n is a, c, g, or t
tcagtcgtcgctcgcacgaccggtgctcgatttagtatcactcagtcgcggggtagaagcctttgaccaggcaggtcaggctgacctggttcttggtcatctcctccagggaagggctggagtgggtctctggtataaattacaatggagtcacacagcttatagagactctggtggaggggccatcaccatcctccagagacaggccnccaaagaaccttccctgtactctgacaaatgaacgtcngangcgagacacggccttatattactgtgcgcgtgatggggtttgggtcgtccgtttcgtttcttcgattcgtcgtggggcccgcgccacccgtggtccactcgtcctctcgactcctacccaccgaagggcccctacgttcccggtacccttccccctggcccgtccccgtcgtcctacccgagggaccaccgaccccgtccggaacggtcgaccaacgccggcccgggtacccggtgggacccgttggcccgtttacggaccggtaaaccgggttccttaacccgttcccgtcggtttccctacctttacgtcggacgtcccgggaancggggacaaaggggtcccncgtataggcngacgncgtnannnnn

SEQ ID NO: 210247 - DNA, 483 bp, Homo sapiens
  misc_feature: GYAE6OF02IAXO7.21.85.H08.1.454.CMB.1.raw
  modified_base (375)..(375): a, c, t, g, unknown or other
  misc_feature (375)..(375): n is a, c, g, or t
  modified_base (455)..(455): a, c, t, g, unknown or other
  misc_feature (455)..(455): n is a, c, g, or t
  modified_base (478)..(483): a, c, t, g, unknown or other
  misc_feature (478)..(483): n is a, c, g, or t
tcagtcgtcgctcgcacgaccggtgctcgatttagtatcactcagtcgcggggtagaagcctttgaccaggcaggtcaggctgacctggttcttggtcatctcctccagggaagggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgccctttctttcttcgatctctggggccgcggcaccctggtcactgtctcctcagcctccaccaagggcccatcggtcttccccnggccgccctgctccaggagcacctccgagagcacagcggccctgggctgcctggtcaaggctacttccctcgtctctacngagcgggctggcaggcgcatagnnnnnn

SEQ ID NO: 210248 - DNA, 484 bp, Homo sapiens
  misc_feature: GYAE6OF02JCNKQ.21.85.H08.1.454.CMB.1.raw
  modified_base (321)..(321): a, c, t, g, unknown or other
  misc_feature (321)..(321): n is a, c, g, or t
  modified_base (375)..(375): a, c, t, g, unknown or other
  misc_feature (375)..(375): n is a, c, g, or t
  modified_base (393)..(393): a, c, t, g, unknown or other
  misc_feature (393)..(393): n is a, c, g, or t
  modified_base (473)..(484): a, c, t, g, unknown or other
  misc_feature (473)..(484): n is a, c, g, or t
tcagtcgtcgctcgcacgaccggtgctcgatttagtatcactcagtcggcggggtagaagccctttgaccaggcaggtcaggctgacctggttcttggtcatctcctccagggaaggggctggagtgggtctctggtataaattacaatggaggtcacacagcttatagagactctgtgaggggccattcaccatctccagagacagcgccaagaactcctgtatctgcaaatgaacagtctgagagccgaggacacggccttatattactgtgcgcgtgatgggttgggtgcccctttcgttcttcgatctctggggccncggcaccctggtcactgtctcctcagcctcaccaagggcccatcgtcttccccnggctccctgcctcaggcncacctccgagagcacagcgcctgggctgcctgtcaggctacttcctcgtctctactgacgcggctggcaggcgcgagtgnnnnnnnnnnnn

SEQ ID NO: 210249 - DNA, 481 bp, Homo sapiens
  misc_feature: GYAE6OF02HJQ21.21.85.H08.1.454.CMB.1.raw
  modified_base (474)..(481): a, c, t, g, unknown or other
  misc_feature (474)..(481): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttggtgccctttcgttcttcgatctctggggccgcggcaccctggtcactgtctcctcagcctccaccaaggcccatcgtctcccctggcgccctgctccaggagcacctccgagagcacagcggccctgggctgcctggtcaagggctacttcccgagcgacgactgagcggctggcaggcgcatagnnnnnnnn

SEQ ID NO: 210250 - DNA, 543 bp, Homo sapiens
  misc_feature: GYAE6OF02F5K37.21.85.H08.1.454.CMB.1.raw
  modified_base (523)..(523): a, c, t, g, unknown or other
  misc_feature (523)..(523): n is a, c, g, or t
  modified_base (527)..(527): a, c, t, g, unknown or other
  misc_feature (527)..(527): n is a, c, g, or t
  modified_base (529)..(530): a, c, t, g, unknown or other
  misc_feature (529)..(530): n is a, c, g, or t
  modified_base (534)..(534): a, c, t, g, unknown or other
  misc_feature (534)..(534): n is a, c, g, or t
  modified_base (538)..(539): a, c, t, g, unknown or other
  misc_feature (538)..(539): n is a, c, g, or t
tcagtcgtcgctcgcacgaccggtgctcgatttagtatcactcagtcggacgggggtagaagcctttgacccaggcaggtcaggctgaccctggttcttggtcactctcctccagggaaggggcctggagtgggtctctggtataaattacaatggaggttcacacagcttatagagactctgtcgaggggccgattcaccatctccgagagacagcggccaagaactccctgtatcctggcaaatgaacagtctgagagccgaggacacggccttatattactgtcgcgcgtgatggttgggtgcccgtttcgttcttccgatctcgtgggccgcggcaccctggtcactgtctcctcagcctccaccaacgggcccactcgtcttccccctggcgccctgctccgaggacggcaccctccgagacgccgaccacgccggcccttagggcctcgccttggtcaacggacttaacgttcccgtcgtctcgtactgacgcgggctcgggccaggcgctagtagntagngnnacgntgtnntgtc

SEQ ID NO: 210251 - DNA, 494 bp, Homo sapiens
  misc_feature: GYAE6OF02FLTF2.21.85.H08.1.454.CMB.1.raw
  modified_base (483)..(494): a, c, t, g, unknown or other
  misc_feature (483)..(494): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgccctttcgttcttcgatctctggggccgcggcaccctggtcactgtctcctcagcctccaccaagggcccatcggtcttccccctggccgccctgcctccaggacgcacctccgagagcacagcggccctgggctgcctggtcaaggctacttccctcgtctctactgacgcgggctggcaggcgcatagnnnnnnnnnnnn

SEQ ID NO: 210252 - DNA, 497 bp, Homo sapiens
  misc_feature: GYAE6OF02IKI9U.21.85.H08.1.454.CMB.1.raw
  modified_base (320)..(320): a, c, t, g, unknown or other
  misc_feature (320)..(320): n is a, c, g, or t
  modified_base (487)..(487): a, c, t, g, unknown or other
  misc_feature (487)..(487): n is a, c, g, or t
  modified_base (489)..(497): a, c, t, g, unknown or other
  misc_feature (489)..(497): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgccctttcgttcttcgatctctggggccncggcaccctggtcactgtctcctcagcctccaccaagggcccatcggtccttccccctggccgccctgcctcccagggacgccaccctccgagacgcacagccggccctgggctgcctggtcaaggctactccctcgtctctactgacgcggctggcaggcgcatgngnnnnnnnnn

SEQ ID NO: 210253 - DNA, 529 bp, Homo sapiens
  misc_feature: GYAE6OF02GNXXN.21.85.H08.1.454.CMB.1.raw
  modified_base (519)..(519): a, c, t, g, unknown or other
  misc_feature (519)..(519): n is a, c, g, or t
  modified_base (521)..(529): a, c, t, g, unknown or other
  misc_feature (521)..(529): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatggttgggtgccctttcgttcttcgatctctggggccgcggcaccctggtcactgtctcctcacgcctccaccaacgggcccagtccggtcttccccctggccgccctgcctcccaggacgccaccctccgagacgcacacggccggcccgtgggcctcgcccgtcgggtccaacgggtaccttaccgttcccctcgtcctctacgttgacggcgggctgggcacgggcgcgatacgncnnnnnnnnn

SEQ ID NO: 210254 - DNA, 503 bp, Homo sapiens
  misc_feature: GYAE6OF02HDDVV.21.85.H08.1.454.CMB.1.raw
  modified_base (412)..(412): a, c, t, g, unknown or other
  misc_feature (412)..(412): n is a, c, g, or t
  modified_base (489)..(489): a, c, t, g, unknown or other
  misc_feature (489)..(489): n is a, c, g, or t
  modified_base (493)..(503): a, c, t, g, unknown or other
  misc_feature (493)..(503): n is a, c, g, or t
tcagtcgtcgctcgcacgaccggtgctcgatttagtatcactcagtcgcggggtagaagcctttgaccaggcaggtcaggctgacctggttcttggtcatctcctccagggaagggctggagtgggtctctggtataaattacaatggaggtcacacagcttatagagactctgtgaggggccattcaccatctccagagacagcgccaagaactccctgtatctgcaaatgaacagtctgagagccgaggacacggccttatattactgtgcgcgtgatgggttgggtgccctttcgttcttcgatctcgtggggccgcggcaccctggtcacgtgtctcctcacgcctccaccaagggcccatcgtccttccccctggccgccctgcctccaggacgccaccgtccgagngcacgagccggccctgggcctcgccgtggtacaacggctaccttccctcgtctctactgacgcgggctgcaggcacntagnnnnnnnnnnn

SEQ ID NO: 210255 - DNA, 494 bp, Homo sapiens
  misc_feature: GYAE6OF02GFB1L.21.85.H08.1.454.CMB.1.raw
  modified_base (485)..(494): a, c, t, g, unknown or other
  misc_feature (485)..(494): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgccctttcgttcttcgatctctggggccgcggcaccctggtcactgtctcctcagcctccaccaagggcccatcggtccttccccctggccgccctgcctccaggagcaccctccgagagcacagccggccctgggctgcctggtcaaggactacttcccgagcgacgactgagcggctggcaggcgcgatagnnnnnnnnnn

SEQ ID NO: 210256 - DNA, 490 bp, Homo sapiens
  misc_feature: GYAE6OF02FFTPW.21.85.H08.1.454.CMB.1.raw
  modified_base (398)..(398): a, c, t, g, unknown or other
  misc_feature (398)..(398): n is a, c, g, or t
  modified_base (474)..(474): a, c, t, g, unknown or other
  misc_feature (474)..(474): n is a, c, g, or t
  modified_base (480)..(490): a, c, t, g, unknown or other
  misc_feature (480)..(490): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgccctttcgtcttcgatctctggggccgcggcaccctggtcactgtctcctcagcctccaccaagggcccatccggtcttccccctggccgccctgcctccaggacncacctccgagagcacagcggccctgggctgcctggtcaaggctactcctcgtctctactgagcgggctggcaggcncatagnnnnnnnnnnn

SEQ ID NO: 210257 - DNA, 655 bp, Homo sapiens
  misc_feature: GYAE6OF02JZEM0.21.85.H08.1.454.CMB.1.raw
  modified_base (645)..(645): a, c, t, g, unknown or other
  misc_feature (645)..(645): n is a, c, g, or t
  modified_base (650)..(655): a, c, t, g, unknown or other
  misc_feature (650)..(655): n is a, c, g, or t
tcagtcgtcgctcgcacgaccggtgctcgatttagtatcactcagtcgcgggtagaagcctttgaccaggcaggtcaggctgacctggttcttggtcatctcctccagggaagggctggagtgggtctctggtataaattacaatggaggtcacacagcttatagagactctgtgaggggccgattcaccatctccagagacagcgccaagtaactccctgtatctgcaaatgaacagtctgagagccgaggacacggccttagtattactgtgcgacgtgagtggttgggtgcccttttcggttcttcgattctcgttggggccgtcgggcacccgttggtcacctgtcctccgtacacgtccctccacgaacgggccccaagttccgggtaccctttccccccggttgggccgtccccccgtttagcccgttccccgaacgggaccgtcccgaaccccgttccccggaaggaccgccgaacccgaacggccgggacccccggtggggtcccgtcggcccgttcgggttacccgaacggggtacctttaacccgtttcccccgtacggtttcccttaccgttaccgttcgtaacggccgggaccgttcgggaccgttacgggccgacggcttaaggcaagtcgngcgcnnnnnn

SEQ ID NO: 210258 - DNA, 551 bp, Homo sapiens
  misc_feature: GYAE6OF02F0J2P.21.85.H08.1.454.CMB.1.raw
  modified_base (537)..(537): a, c, t, g, unknown or other
  misc_feature (537)..(537): n is a, c, g, or t
  modified_base (541)..(542): a, c, t, g, unknown or other
  misc_feature (541)..(542): n is a, c, g, or t
  modified_base (544)..(544): a, c, t, g, unknown or other
  misc_feature (544)..(544): n is a, c, g, or t
  modified_base (546)..(551): a, c, t, g, unknown or other
  misc_feature (546)..(551): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgagtgggttgggtgtccctttcgttcttcgatctcgtggggccgcggcacccgtggtccactgtcctcctcacgcctccaccaacgggcccagtccggtccttcccccgtgggccgcccctgcctcccgaggcgccaccctcgagcgcacacggccggcccgtggggcctcggcccgtgggtacgaaacggtccttacctttccccgtcgtcctccttacctggacggccgggtctgggaccgaggccggacagtagnagcnncncnnnnnn

SEQ ID NO: 210259 - DNA, 503 bp, Homo sapiens
  misc_feature: GYAE6OF02FS86F.21.85.H08.1.454.CMB.1.raw
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
tcagtcgtcgctcgcacgaccggtgctcgatttagtatcactcagtcgcggggtagaagccctttagaccaggcaggtcaggctgacctggttcttggtcatctcctccagggaaggggctggagtgggtctctggttataaattacaatggaggtcacacagcttatagagactctgtgagggccattcaccatctccagagacagcgccaagaactccctgtatctgcaaatgaacagtctgagagccgaggacacggccttatattactgtgcgcgtgatgggttgggtgccctttgttcttcgatctcgtgggccgcggcacccgtggtcactgtctctcngcctcacaggccatcggtcctcccngcncctgctccagcncacctcgagcgcacagccggccctgggctgcctggtcaaggctaccttccctcgtcctctaccgtgcgcgggtctagggcgacggccgacgagtacgncgcngtncgngtgctgntcg

SEQ ID NO: 210260 - DNA, 490 bp, Homo sapiens
  misc_feature: GYAE6OF02ICTEK.21.85.H08.1.454.CMB.1.raw
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (387)..(387): a, c, t, g, unknown or other
  misc_feature (387)..(387): n is a, c, g, or t
  modified_base (418)..(418): a, c, t, g, unknown or other
  misc_feature (418)..(418): n is a, c, g, or t
  modified_base (440)..(440): a, c, t, g, unknown or other
  misc_feature (440)..(440): n is a, c, g, or t
  modified_base (479)..(479): a, c, t, g, unknown or other
  misc_feature (479)..(479): n is a, c, g, or t
  modified_base (482)..(490): a, c, t, g, unknown or other
  misc_feature (482)..(490): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaaattacaatggaggtcacacagcttatagagactctgtgaggggccattcaccatctccagagacagcgccaaagaactccctgtatctgcaaaatgaaacagtctgagagccgaggacacggccttatattactgtgcgcgtgatgggttggtgcccttttcgttcttcgatctctgggccgcgcacccttggtcactgtctcctcagcctccacaaggccatcgtctcccngcncctgctcgagcncacctccgagacgcacgagcgccctggtccngccctgcaaggactaccttccncgtctctactgacgcggctcggcaacggcgtcaatagcnacnnnnnnnnn

SEQ ID NO: 210261 - DNA, 495 bp, Homo sapiens
  misc_feature: GYAE6OF02I84TN.21.85.H08.1.454.CMB.1.raw
  modified_base (488)..(495): a, c, t, g, unknown or other
  misc_feature (488)..(495): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgccctttcgttcttcgatctctggggccgcggcaccctggtcactgtctcctcagcctccaccaagggcccatcggtccttccccctggccgccctgcctcccaggacgcaccctccgagagcacacgccggccctgggctgcctggtcaagggctacttccctcgtctctactgagcggctggcaggcgcgatagnnnnnnnn

SEQ ID NO: 210262 - DNA, 536 bp, Homo sapiens
  misc_feature: GYAE6OF02GU7PU.21.85.H08.1.454.CMB.1.raw
  modified_base (244)..(244): a, c, t, g, unknown or other
  misc_feature (244)..(244): n is a, c, g, or t
  modified_base (522)..(522): a, c, t, g, unknown or other
  misc_feature (522)..(522): n is a, c, g, or t
  modified_base (524)..(532): a, c, t, g, unknown or other
  misc_feature (524)..(532): n is a, c, g, or t
  modified_base (534)..(534): a, c, t, g, unknown or other
  misc_feature (534)..(534): n is a, c, g, or t
tcagtcgtcgctcgcacgaccggtgctcgattttagtatcactcagtcgcgggggtagaagcctttgaccaggcaggtcaggctgacctggttcttggtcatctcctccagggaagggctggagtgggtctctggtataaatttacgaatggaggtcacgtacagcttatagtagactctgtgagggccattcaccatctcagagacaggcgccaagaacctccctgtatctgacaaatgaacngtctgagagccgaggacacggccttatattactgtgcgcgtgatgggttggtgcccgtttcgttcttcgatctcgtgggccgcgcaccgtggtcacgtgtctcctcagcctccacagggccatcggtcctcccctggccgccctcgcctccaggacgccacctccggacgacgccacgacgccggacccgttcgggacctcggccctggtccgaacgggtacctaaccgttccctcgtcctactaccgtgacgcggctcggacgaggcgcgtaagtgnannnnnnnnnancg

SEQ ID NO: 210263 - DNA, 518 bp, Homo sapiens
  misc_feature: GYAE6OF02G2UU3.21.85.H08.1.454.CMB.1.raw
  modified_base (380)..(380): a, c, t, g, unknown or other
  misc_feature (380)..(380): n is a, c, g, or t
  modified_base (508)..(518): a, c, t, g, unknown or other
  misc_feature (508)..(518): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatgggaggtcacacagcttatagagactctatgaggggccgattcaccatctccagagacagcgccaagaactccctgtatctgcaaatgaacagtctgagagccgaggacacggccttatattactgtgcgcgtgatgggttgggtgccctttcgttcttcgatctcgtgggccgcggccaccctggtcactgtcctcctcagcctccaccaagggcccatcggtccttccccnggccgccctgcctccaggcgccacctccgagagcacgacgccggccctgggctcgccgtcggtacaaggtcctaccttccctcgtccttccgtacgttgacggcgggcgtggccgaggcgacagtagnnnnnnnnnnn

SEQ ID NO: 210264 - DNA, 526 bp, Homo sapiens
  misc_feature: GYAE6OF02GNVEH.21.85.H08.1.454.CMB.1.raw
  modified_base (516)..(526): a, c, t, g, unknown or other
  misc_feature (516)..(526): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgagtggggttgggtgcccttttcgttctttcggattctcgtggggccgcggcaccctggtcactgtctcctcacgcctccaccagggcccatccggtccttcccccgtggccgccctgcctccgaggacgccacctccgagcgcacacggccgcccgtgggctgccgtggtacaacggaccttaccgttcccgtcgtcctctacctgacgtcggcgtggccgaggcgacgagtagcnnnnnnnnnnn

SEQ ID NO: 210265 - DNA, 626 bp, Homo sapiens
  misc_feature: GYAE6OF02HZZEO.21.85.H08.1.454.CMB.1.raw
  modified_base (616)..(616): a, c, t, g, unknown or other
  misc_feature (616)..(616): n is a, c, g, or t
  modified_base (621)..(626): a, c, t, g, unknown or other
  misc_feature (621)..(626): n is a, c, g, or t
tcagtcgtcgctcgcacgaccggtgctcgatttagtatcactcagtcgcggggtagaagcctttgaccaggcaggtcaggctgacctggttcttggtcatctcctccagggaagggctggagtgggtctctggtataaattacaatggaggtcacacagcttatagagactctgtgaggggccattcaccatctccagagacagcgccaagaacctcctgtatctgcaaatgaacagtctgagagccgaggacacggccttatattactgtgcgcgtgagtgggttggtcgtcccgttttcgttcgttcgagttctcgtggggcccgcggccacccgttggtccacgttcgttcctccctctacgtcctacccaaccgaacgggccccagttccgggtcccctttacccccgtcgggccctcccgtcgcctacccgaacgggtaccgccctacccgtccggaagtacgccctaacgacggcccggaccctcggggcctacggcccgttgggtaccaaacgggtaccttaacccgttccccgtaccggttccttcctaaccgtttcggaccgggcgggacctgggaccgaacgggccggtacaaggttagctagcgngcgcnnnnnn

SEQ ID NO: 210266 - DNA, 692 bp, Homo sapiens
  misc_feature: GYAE6OF02H15I3.21.85.H08.1.454.CMB.1.raw
  modified_base (195)..(195): a, c, t, g, unknown or other
  misc_feature (195)..(195): n is a, c, g, or t
  modified_base (676)..(676): a, c, t, g, unknown or other
  misc_feature (676)..(676): n is a, c, g, or t
  modified_base (680)..(681): a, c, t, g, unknown or other
  misc_feature (680)..(681): n is a, c, g, or t
  modified_base (685)..(685): a, c, t, g, unknown or other
  misc_feature (685)..(685): n is a, c, g, or t
  modified_base (688)..(688): a, c, t, g, unknown or other
  misc_feature (688)..(688): n is a, c, g, or t
  modified_base (690)..(692): a, c, t, g, unknown or other
  misc_feature (690)..(692): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccattcaccatcncagagacagcgccaaagaactccctgtatctgacaaaatgaaacagtcagagagccgaggacacggccttatattactgtgcgcgtgagttgggttggtcgtcccttttcggttcttcgattcctcgtcggggccgcggccacccgtggtccacgtgtcctcctcacgtccctaccgaaccgaaacgggccccaagttcccgggttaccctttcccccccgtggggtcccggccccccgtttacggacccgttacccgaacgggtaccggacccctaaccccgtaccccgggaacggaacggacccaacccgacgggacccgggtccccgtacggggtccgtcggtaccccgttacgggtaccgaaaacgggtaaccctttacccgtttacccccgttcggtttcccgttaccgttaaccgttccggaacgggtccgggtacgttcgggaccgaaacgggtccgaaccgtaagttaacggnacgnngcancgnannn

SEQ ID NO: 210267 - DNA, 570 bp, Homo sapiens
  misc_feature: GYAE6OF02IMAC9.21.85.H08.1.454.CMB.1.raw
  modified_base (400)..(400): a, c, t, g, unknown or other
  misc_feature (400)..(400): n is a, c, g, or t
  modified_base (424)..(424): a, c, t, g, unknown or other
  misc_feature (424)..(424): n is a, c, g, or t
  modified_base (553)..(554): a, c, t, g, unknown or other
  misc_feature (553)..(554): n is a, c, g, or t
  modified_base (558)..(558): a, c, t, g, unknown or other
  misc_feature (558)..(558): n is a, c, g, or t
  modified_base (562)..(562): a, c, t, g, unknown or other
  misc_feature (562)..(562): n is a, c, g, or t
  modified_base (565)..(570): a, c, t, g, unknown or other
  misc_feature (565)..(570): n is a, c, g, or t
tcagtcgtcgctcgcacgaccggtgctcgatttagtatcactcagtcgcggggtagaagcctttgaccaggcaggtcaggctgacctggttcttggtcatctcctccaggggaagggctggagtgggtctctggtaataaattacaatggaggtcacacagcttatagagactctgtggaggggccattccaccatcctccagagacagccgaccaaagaacctccctgtatctgacaaatgaacagtctgagacgccgaggacacggccttatattactgtgcgcgtgagtggggttgggtcgtcccttttcgttcttcgatctcgtggggccgcggccacccgtggtcacgtcgtctcctcacgcctccaccgacggcccagtccggtccttccccgnggcccgccctcgcctccgaggacnccacccgtccgagacgccacgacggcccggcccgtgggcctcgcccgtgggtacaacggtaccttacccgttcccgagaccgaaccgacgtcggacgggccggcgtcggacgacgggccacgaagtcgnngacngacncgnnnnnn

SEQ ID NO: 210268 - DNA, 570 bp, Homo sapiens
  misc_feature: GYAE6OF02G4KAS.21.85.H08.1.454.CMB.1.raw
  modified_base (553)..(553): a, c, t, g, unknown or other
  misc_feature (553)..(553): n is a, c, g, or t
  modified_base (558)..(558): a, c, t, g, unknown or other
  misc_feature (558)..(558): n is a, c, g, or t
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
  modified_base (568)..(569): a, c, t, g, unknown or other
  misc_feature (568)..(569): n is a, c, g, or t
tcagtcgtcgctcgcacgaccggtgctcgatttagtatcactcagtcggcggggtagaagcctttgaccaggcaggtcaggctgacctggttcttggtcatctcctccagggaaggggctggagtgggtctctggtataaattacaatggaggtcacacagcttatagagactctgtgaggggccattcaccatctccagagacagcgccaagaacctccctgtatctgacaaatgaacagtctgagagccgaggaccacggccttatattactgtgcgcgtgagtgggttggtcgtccctttcgttcttcgatctcgtcgggccgtcggccaccgtggtcacgtgtcctcctcacgtcctccaccgaacgggcccagtccggtcccttccccgtggcccgccctcgcctcccgaggacgcctacccgtccgacgacgacaccgacggccggtcccgtgggcctcgccgtggtacaacggtaccttccttccctccgtcctcctacgtcgtacggcggtccgtcggaccgacggtccgaccgtacgtaacggncacgncgancgnctnnc

SEQ ID NO: 210269 - DNA, 538 bp, Homo sapiens
  misc_feature: GYAE6OF02HD3R4.21.85.H08.1.454.CMB.1.raw
  modified_base (527)..(529): a, c, t, g, unknown or other
  misc_feature (527)..(529): n is a, c, g, or t
  modified_base (531)..(538): a, c, t, g, unknown or other
  misc_feature (531)..(538): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgccctttcgttcttcgatctcgtggggccgcggcaccctggtcactgtctcctcacgcctccaccaacgggcccagtcggtccttcccccgtggcccgccctcgcctccgacggcgccaccctccggacgacgcacgacgccggcccgtgggcctcggcctgggtaccaaggtaccttaccgttccccgtcgtccttcgtactggacgcgggctcggacgacggccgcgagtagcnnngnnnnnnnn

SEQ ID NO: 210270 - DNA, 588 bp, Homo sapiens
  misc_feature: GYAE6OF02IEAVO.21.85.H08.1.454.CMB.1.raw
  modified_base (165)..(165): a, c, t, g, unknown or other
  misc_feature (165)..(165): n is a, c, g, or t
  modified_base (272)..(272): a, c, t, g, unknown or other
  misc_feature (272)..(272): n is a, c, g, or t
  modified_base (572)..(572): a, c, t, g, unknown or other
  misc_feature (572)..(572): n is a, c, g, or t
  modified_base (579)..(579): a, c, t, g, unknown or other
  misc_feature (579)..(579): n is a, c, g, or t
  modified_base (583)..(583): a, c, t, g, unknown or other
  misc_feature (583)..(583): n is a, c, g, or t
  modified_base (587)..(588): a, c, t, g, unknown or other
  misc_feature (587)..(588): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttanagagactctgtgaggggccgattcaccatctcagagacagcgccaagaacctccctgtatctgcaaaatgaacagtctgagagccgaggacacggccttatattacngtgcgcgtgatggggttggtgcccttttcgttcttcgatctctgggccgcggcaccctggtcactcgtctcctcacgcctcaccgaagggcccagtccgtcccttcccccgtggcccgtccctcgcctccgaggacgccacccgtcccgagacgccgaacgcgccggtcccgtcgggctcggtccccttgggaccaaacgggtccttaacccgttccccgtacggtcccttccgttaaccgtcgaacgggtccggccgttacgggaccaacgggcccggtacaaggttacgcgtacgtcncgtagcncgancgcnn

SEQ ID NO: 210271 - DNA, 546 bp, Homo sapiens
  misc_feature: GYAE6OF02ISRVI.21.85.H08.1.454.CMB.1.raw
  modified_base (383)..(383): a, c, t, g, unknown or other
  misc_feature (383)..(383): n is a, c, g, or t
  modified_base (404)..(404): a, c, t, g, unknown or other
  misc_feature (404)..(404): n is a, c, g, or t
  modified_base (533)..(533): a, c, t, g, unknown or other
  misc_feature (533)..(533): n is a, c, g, or t
  modified_base (537)..(537): a, c, t, g, unknown or other
  misc_feature (537)..(537): n is a, c, g, or t
  modified_base (540)..(540): a, c, t, g, unknown or other
  misc_feature (540)..(540): n is a, c, g, or t
  modified_base (544)..(545): a, c, t, g, unknown or other
  misc_feature (544)..(545): n is a, c, g, or t
tcagtcgtcgctcgcacgaccggtgctcgatttagtatcactcagtcgcggggtagaagcctttgaccaggcaggtcaggctgacctggttcttggtcatctcctccagggaagggctggagtgggtctctggtataaattacaatggaggtcacacagcttatagagactctgtgaggggccattcaccatctccagagacagcgccaagaacctcctgtatctgacaaatgaacagtctgagagccgaggacacggccttatattactgtgcgcgtgatgggttggtgtcccgtttcgttcttcgtatctcgtggggccgcggcacccgtggtcactgtctcctcagcctacaccaagggcccagtccgtccttcccccgnggccgtccctgctccaggacncaccctcgagacgcacgagccggcccgtgggctcgcctggtacaaggacctaccgttcccgacggccgaccggtacgtcggaacggccgggcgtcgggaccgtaacgggccgacgaagtacgcgtagcngtcngcngcgnnc

SEQ ID NO: 210272 - DNA, 640 bp, Homo sapiens
  misc_feature: GYAE6OF02I6Z3Z.21.85.H08.1.454.CMB.1.raw
  modified_base (271)..(271): a, c, t, g, unknown or other
  misc_feature (271)..(271): n is a, c, g, or t
  modified_base (619)..(619): a, c, t, g, unknown or other
  misc_feature (619)..(619): n is a, c, g, or t
  modified_base (633)..(633): a, c, t, g, unknown or other
  misc_feature (633)..(633): n is a, c, g, or t
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
tcagtcgtcgctcgcacgaccggtgctcgatttagtatcactcagtcgcggggtagaagcctttgaccaggcaggtcaggctgacctggttcttggtcatctcctccagggaagggctggagtgggtctctggtataaattacaatggaggtcacacagcttatagagactctgtgaggggccgattcaccatctccagagacagcgccaagaactccctgtatctgacaaatgaacagtctgagagccgaggacacggccttatattacngtgcgcgtgagtggggttggtcgtccctttcgttcttcgacttctcgtcggggcccgtacggccgtacccgttgggtaccacgttcggtcctcccgtcacgtcccctccaaccgaacgggtcccagttcccggtcctttcccccgtggcccgtacccttcggccttcccgagggacgccctaacccgtccggtaacggacgccgaaccgacggcccggcccgttcgggccttcggccgtcgggttaccaaacgggtaccctttacccttccccgttacgtccgttccttaaccgtgggaccggtccggggcttacgggaccgacgggtctacgtaaacggtcggctcncgagtctacgcgtncgngncg

SEQ ID NO: 210273 - DNA, 842 bp, Homo sapiens
  misc_feature: GYAE6OF02HVB2V.21.85.H08.1.454.CMB.1.raw
  modified_base (290)..(290): a, c, t, g, unknown or other
  misc_feature (290)..(290): n is a, c, g, or t
tcagtcgtcgctcgcacgaccggtgctcgatttagtatcactcagtcgcggggtagaagcctttgaccaggcaggtcaggctgacctggttcttggtcatctcctccagggaagggctggagtgggtctctggtaataaattacaatggaggtcacacagtcttatagagactctgtgacggggccattcaccatcctcagacgacagcgaccaagacctccgtgtactcgtgacaaagtcgaactagttctagacgagaccggaggaccacggtccttaatacgttacnggtcgcgtacgtagaggtttcgggggttcggtccgttccctttttacggttcgttacggacgtttccgttcggggtccgggggtccccgaccggtacccgttaaccccgtttggggtaccccttaacggtcggttttaccccgttacccgtacggtaacccgtcccccgttaaaccccgaaccgggtaaaccccggggtccctttaaccgggtttccccggtttcccccgtttcccccggaggggtccccccttcccggttacgtaccccgttacggaaccggggtaccgaaccccgttaaaccccggtaccgggaacggtaaaccgtacccgtaccgggtaacccgggtcccggttacccgttaccggggtcttcccgggtacccggttagggtaaacccggaaaccggttaccccgtttacccgtttaccccgttaccggttacccgttacgttaacccgtagggacccgggtccgtaccggttaccgggacgtaaccgggtctaacggtacgtacggctcgaacgtgtacgtcacgtacgctacgtgac

SEQ ID NO: 210274 - DNA, 593 bp, Homo sapiens
  misc_feature: GYAE6OF02IYBKX.21.85.H08.1.454.CMB.1.raw
  modified_base (456)..(456): a, c, t, g, unknown or other
  misc_feature (456)..(456): n is a, c, g, or t
  modified_base (572)..(572): a, c, t, g, unknown or other
  misc_feature (572)..(572): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (585)..(585): a, c, t, g, unknown or other
  misc_feature (585)..(585): n is a, c, g, or t
  modified_base (587)..(593): a, c, t, g, unknown or other
  misc_feature (587)..(593): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccattcaccatctccagagacagcgaccaaagaacctccctgtactctgacaaatgaacagtcagagacgccgaggacacggccttatattactgtgcgcgtgagttggggttgggtcgtcccttttcgttcttcgacttcctcggtcggggcccgccggccaccccgttggtccacgttcgtcctccttccacgtcccctaccgaaccgtaccgggccctaacgttcccggttcccttccccccgtcggcccgtcccctcgcctccgacggcnccaccccgtcgacgtcgaccacgacgcccggcccgtgggcctcgtccgtcggacaacgggtaccttaccgtcccgacgtccgaccgtacgtggacggcggcgtcggacgacggcgngaacgtgntngcngnnnnnnn

SEQ ID NO: 210275 - DNA, 717 bp, Homo sapiens
  misc_feature: GYAE6OF02H8SPM.21.85.H08.1.454.CMB.1.raw
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (701)..(701): a, c, t, g, unknown or other
  misc_feature (701)..(701): n is a, c, g, or t
  modified_base (705)..(705): a, c, t, g, unknown or other
  misc_feature (705)..(705): n is a, c, g, or t
  modified_base (708)..(708): a, c, t, g, unknown or other
  misc_feature (708)..(708): n is a, c, g, or t
  modified_base (714)..(716): a, c, t, g, unknown or other
  misc_feature (714)..(716): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgagggccattcaccatctcagagacagcgccaagactcctgtatctgacaaatgaaacngtctgagngcgagacacggccttatattactgtgcgcgtgagttgggttggtcgtcccttttcgttcttcgattcgtcgtcggggcccgcggccacccgttggtaccacgttcgttccgtccctacgacgtcccttacccgaacccggaaacgggcccctaagttccccgggttccctttccccccgtcgggccccgtccccgtttcggcccttcccggaacggggtaccgcccccgtaaccccgtcccgggaaacgaaccgggacccaacccggacgggccccggggtacccccgggttcggggtacccgttccgggtaccccgttcggggtaaccgtaaaaccgggtcccgtttaacccccgtttttccccggtccgttttacccgttccgttaaccgttcgggaaccgggtccgggtaccgttacggggaccgaacgggtcccgaacggtactaacggcgacncgtncgngcgcgnnnc

SEQ ID NO: 210276 - DNA, 671 bp, Homo sapiens
  misc_feature: GYAE6OF02JTHDV.21.85.H08.1.454.CMB.1.raw
  modified_base (206)..(206): a, c, t, g, unknown or other
  misc_feature (206)..(206): n is a, c, g, or t
  modified_base (655)..(655): a, c, t, g, unknown or other
  misc_feature (655)..(655): n is a, c, g, or t
  modified_base (662)..(662): a, c, t, g, unknown or other
  misc_feature (662)..(662): n is a, c, g, or t
  modified_base (666)..(669): a, c, t, g, unknown or other
  misc_feature (666)..(669): n is a, c, g, or t
tcagtcgtcgctcgcacgaccggtgctcgatttagtatcactcagtcgcggggtagaagcctttgaccaggtcaggtcaggctgacctggttcttggtcatctcctccagggaaggggctggagtgggtctctggtataaattacaatggaggtcacacagcttatagagactctgtggaggggacattcaccatctccagagacngcgaccaaagaacctcctgtatctagacaaatcgaacagtctggagacgccgaggacacggcttatattactgtcgcgcgtgagttgggttggtcgtcccgttttgttcttcgagttctcggtcggggccgcggctacccgtggtctacgttcgtcctcctagacgtcctaccgaaccgaacgggtccctacgtccggttccccgtcccccgtgggccccgttcccgtcgtaccctaccgtaacgggtaccgacccgtaaaccccgttcccgggaacgtacgaccgaccgaccgggcccggtacccggttcggggccttccggccgggttacggtaacccgtaaacgggtaccctttacccgtttacccgttccgttacccgtacgttaacccgtcgggtaaccggtccgggtcgtacgggtacccgacggttccgacgtaagtcggcnctagctncgcnnnngc

SEQ ID NO: 210277 - DNA, 628 bp, Homo sapiens
  misc_feature: GYAE6OF02H2P4E.21.85.H08.1.454.CMB.1.raw
  modified_base (332)..(332): a, c, t, g, unknown or other
  misc_feature (332)..(332): n is a, c, g, or t
  modified_base (474)..(474): a, c, t, g, unknown or other
  misc_feature (474)..(474): n is a, c, g, or t
  modified_base (616)..(621): a, c, t, g, unknown or other
  misc_feature (616)..(621): n is a, c, g, or t
  modified_base (623)..(628): a, c, t, g, unknown or other
  misc_feature (623)..(628): n is a, c, g, or t
tcagtcgtcgctcgcacgaccggtgctcgatttagtatcactcagtcgcggggtagaagcctttgaccaggcaggtcaggctgacctggttcttggtcatctcctccaggggaagggctggagtgggtctctggtataaattacaatggaggtcacacagcttatagagactctgtggaggggccattcaccatcctccagagacagccgaccaaagaacctccctagtatcctgacaaaatcgaacagtctagagagccggaggaccacggtccttaatattactgtgcgtcgtgagttggggttggtcgtcccgttttcgttcttacggnttccgtcgtcgggggcccgccgggcctaccccgttgggtcctaccgtcgtcctccctcgtacgcccctcccaaccgaacgggcccctacgttccggttccctttcccccgtgggtcccgtccctcgtccctccgacggaccnccgtacccgtcgacgtacgacctacgacggcccggtcccgtgggtcctcggcccgttggtaccaagggttacccttaccgtttcccgttacgtttcctacgtggacggccgggtacgtcggacgacggccgtagtagtagcnnnnnncnnnnnn

SEQ ID NO: 210278 - DNA, 551 bp, Homo sapiens
  misc_feature: GYAE6OF02FTRHZ.21.85.H08.1.454.CMB.1.raw
  modified_base (540)..(540): a, c, t, g, unknown or other
  misc_feature (540)..(540): n is a, c, g, or t
  modified_base (542)..(544): a, c, t, g, unknown or other
  misc_feature (542)..(544): n is a, c, g, or t
  modified_base (546)..(551): a, c, t, g, unknown or other
  misc_feature (546)..(551): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatggggttgggtgtcccgttttcgttcttcgatctcgtgggccgcggcaccgtggtcactgtctcctcacgcctccaccgacgggcccagtccggtccttcccccgtggccgcccctgcctccgacggacgccacccgtccgagacgccaccgacggcccggcccgtcgggcctcgcccgtgggtaccaacggtaccttaccttccctccgttcctcctacgtgacggccgggctcgggacgacgggccgacgagtacgncnnncnnnnnn

SEQ ID NO: 210279 - DNA, 596 bp, Homo sapiens
  misc_feature: GYAE6OF02IQRKE.21.85.H08.1.454.CMB.1.raw
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (586)..(587): a, c, t, g, unknown or other
  misc_feature (586)..(587): n is a, c, g, or t
  modified_base (591)..(592): a, c, t, g, unknown or other
  misc_feature (591)..(592): n is a, c, g, or t
  modified_base (594)..(596): a, c, t, g, unknown or other
  misc_feature (594)..(596): n is a, c, g, or t
tcagtcgtcgctcgcacgaccggtgctcgatttagtatcactcagtcgcggggtagaagcctttgaccaggcaggtcaggctgacctggttcttggtcatctcctccaggggaaggggctggagtgggtctctggtataaattacaatggaggtcacacagcttatagagactctgtgaggggccgattcaccatctccagagacagcgaccaagaacctccctgtatctgacaaatgaacagtctagagagccgagacacggtccttatattactgtgcgcgtgagtggggttgggtcgtcccttttcgttcttcgattcgtcgtcgggccgcggccaccgtggtctacgttgtcctcctcacgtccctaccaccgaacggccctacgttccggtcccttacccccgtgggcccgtccccgtcgccgtaccgaggaccgccgtacccctccggacgacgtcgacgaccggtccggcccgtcgggtctcgccgttcggaccgaacggtaccttaccgttacccggacggtccgtacgtaccgtggacgggcggccgtcgggacgaccggcgtacgagtcgcngnannacgnncnnn

SEQ ID NO: 210280 - DNA, 604 bp, Homo sapiens
  misc_feature: GYAE6OF02HNO6T.21.85.H08.1.454.CMB.1.raw
  modified_base (582)..(582): a, c, t, g, unknown or other
  misc_feature (582)..(582): n is a, c, g, or t
  modified_base (590)..(590): a, c, t, g, unknown or other
  misc_feature (590)..(590): n is a, c, g, or t
  modified_base (603)..(603): a, c, t, g, unknown or other
  misc_feature (603)..(603): n is a, c, g, or t
tcagtcgtcgctcgcacgaccggtgctcgatttagtatcactcagtcgcggggtagaagcctttgaccaggcaggtcaggctgacctggttcttggtcatctcctccagggaagggctggagtgggtctctggtataaattacaatggaggtcacacagcttatagagactctgtgaggggccgattcaccatcctccagagacagccgaccaagaacctccctgtactctgacaaatgaacagtctgagacgccgaggacacggcttaatattactagtcgcgcgtgacgttgggttgggtcgtcccgtttcgtttcgttcgatcgtcgtcgggccgcgcctaccgtggtccactcgtctcctcgacgccctccaccgaacggcccacgttccgttcccttccccgtcgggtcccgacccgtcgtccctacccggaggaccgcctaccccgtccgtaacgacgaccaacgacgccggcccgttgggcctcgtccgtagtacgaaggtcccttaccgttcccgtcgttccgtcctacgtgaacggcggtcgtcgggtacgacggtcccgcgtaaacgttcgntcgcgacncgcacgcacgctnc

SEQ ID NO: 210281 - DNA, 675 bp, Homo sapiens
  misc_feature: GYAE6OF02IK65U.21.85.H08.1.454.CMB.1.raw
  modified_base (659)..(659): a, c, t, g, unknown or other
  misc_feature (659)..(659): n is a, c, g, or t
  modified_base (661)..(661): a, c, t, g, unknown or other
  misc_feature (661)..(661): n is a, c, g, or t
  modified_base (671)..(671): a, c, t, g, unknown or other
  misc_feature (671)..(671): n is a, c, g, or t
  modified_base (673)..(675): a, c, t, g, unknown or other
  misc_feature (673)..(675): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggagtcacacagcttatagagactctgtggaggggccattccaccatctccagagacagccgaccaaagaacctccctgtactctgacaaatcgaaacagtctaggagacggccggaaggacacggcctttataatttactgtagcgcgtgagttggggtttgggtcgtccccgtttttcgttcttcgattcgtcgttgggggcccgcggccacccgtggtccacttgtcctcctcgacgtccctacccacgaacgggccccagttccgggtccctttcccccgtgggccccgtaccccgtggtcccttacccgacgggtaccgcctaccccgtccggaaggtacgacccaccgaacgggtcccggacccgtcggggtaccctcggcccggttgggtacccaaacgggaccctttaacccgttacccgggacgaccggaccggtaacgtcggaccgggaccggggtccgttaggggaccgtaaggggtcccgaacgtaacgtacggcgaagngngcagctacgngnnn

SEQ ID NO: 210282 - DNA, 593 bp, Homo sapiens
  misc_feature: GYAE6OF02IAQAB.21.85.H08.1.454.CMB.1.raw
  modified_base (238)..(238): a, c, t, g, unknown or other
  misc_feature (238)..(238): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (587)..(589): a, c, t, g, unknown or other
  misc_feature (587)..(589): n is a, c, g, or t
  modified_base (591)..(593): a, c, t, g, unknown or other
  misc_feature (591)..(593): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccattcaccatctccagagacagcgccaaagacctcctgtatctgacaaatgaacngtctgagagccgaggacacggccttatattactgtgcgcgtgagtggggtttgggtcgtccccgtttttcgttctttcggattcttcgtcgggggccgcggtccacccgttggtccactcgtctcctcacgcctccaccgaacggcccagtccggtccttcccccgtcggccgccctgcctccgaggacgccaccgtcgagacgccaacgacggccggccccgtggggtctcggcccgttcgggtaccgaaacggtaccgttacccgttcccgtccgtaccttccgttacgttcgacgggtccgggctcgggaccgtacgggaccgacctaagtaacgcgnacntgacnnncnnn

SEQ ID NO: 210283 - DNA, 585 bp, Homo sapiens
  misc_feature: GYAE6OF02IV5GI.21.85.H08.1.454.CMB.1.raw
  modified_base (430)..(430): a, c, t, g, unknown or other
  misc_feature (430)..(430): n is a, c, g, or t
  modified_base (447)..(447): a, c, t, g, unknown or other
  misc_feature (447)..(447): n is a, c, g, or t
  modified_base (538)..(538): a, c, t, g, unknown or other
  misc_feature (538)..(538): n is a, c, g, or t
  modified_base (573)..(573): a, c, t, g, unknown or other
  misc_feature (573)..(573): n is a, c, g, or t
  modified_base (576)..(576): a, c, t, g, unknown or other
  misc_feature (576)..(576): n is a, c, g, or t
  modified_base (578)..(585): a, c, t, g, unknown or other
  misc_feature (578)..(585): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccgattccaccatctccagagacagcgccaaagaacctccctgtatctgacaaatgaacagttctagagaggccgaggacaccggccttatattactgtgcgcgtgagtgggttgggtcgtcccttttcgttcttcgatctcgtggggccgcggccacccgtggtcacgtgtcctcctcacgtccctccaccgacgggcccagttccggtccttcccccgtggcccgtccctcgcctaccgacggacnccaccctccgacggacnccacgacggccgcccgtcgggtctacgtcccgtggccgaacggtaccttaccgtttccctcgttccttccgtacgttcgacggcccgggtntacggggacctacggggaccagtaacgacgtcgancgngnnnnnnnn

SEQ ID NO: 210284 - DNA, 594 bp, Homo sapiens
  misc_feature: GYAE6OF02HY0NV.21.85.H08.1.454.CMB.1.raw
  modified_base (218)..(218): a, c, t, g, unknown or other
  misc_feature (218)..(218): n is a, c, g, or t
  modified_base (272)..(272): a, c, t, g, unknown or other
  misc_feature (272)..(272): n is a, c, g, or t
  modified_base (576)..(576): a, c, t, g, unknown or other
  misc_feature (576)..(576): n is a, c, g, or t
  modified_base (590)..(594): a, c, t, g, unknown or other
  misc_feature (590)..(594): n is a, c, g, or t
tcagtcgtcgctcgcacgaccggtgctcgatttagtatcactcagtcgcggggtagaagcctttgaccaggcaggtcaggctgacctggttcttggtcatctcctccagggaagggctggagtgggtctctggtataaattacaatggaggtcacacagcttatagagactctgtgagggccattcaccatctccagagacagcgacaagaactcccngtatctgacaaatgaaacagtctgagacgcgaggacacggccttaatatactgngcgcgtgagtgggttgggtcgtcccttttcgttcttcgattctcgtggggccgcggcaccctggtctcgtcgtcctctcacgcctccaccgacggcccactccggtcccttcccccgtggtcccgcccgtgtccctaccgaggaccgccgaccctccggacgacgaccaccgacggcccggcccgtcgggtctcgcccgttgggttccaacgggttacctacccgttcccgttaccgtccttaccgttaccgtcggacgggtccggacggttcggaccggacggtccggaccgtaggtaacggntcgcgtagcagcgnnnnn

SEQ ID NO: 210285 - DNA, 520 bp, Homo sapiens
  misc_feature: GYAE6OF02HHLKC.21.85.H08.1.454.CMB.1.raw
  modified_base (397)..(397): a, c, t, g, unknown or other
  misc_feature (397)..(397): n is a, c, g, or t
  modified_base (500)..(500): a, c, t, g, unknown or other
  misc_feature (500)..(500): n is a, c, g, or t
  modified_base (509)..(520): a, c, t, g, unknown or other
  misc_feature (509)..(520): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccattcaccatctccagagacagcgccaagaactccctgtatctgcaaaatgaacagtctgagagccgaggacacggccttatattactgtgcgcgtgatgggttgggtgcccgtttcgttccttcgatcctctggggccgcggcaccctggtcactgtctcctcagcctccaccaagggcccatcgtcttcccccgtgccgccctgctccaggncaccctccgagacgcaacagccggccctgggcctcgcccgttggtccaaagggaccttaccttacccctcgtacctcctactgaggcgggtctggcaggccgntaatacggnnnnnnnnnnnn

SEQ ID NO: 210286 - DNA, 633 bp, Homo sapiens
  misc_feature: GYAE6OF02F13U7.21.85.H08.1.454.CMB.1.raw
  modified_base (520)..(520): a, c, t, g, unknown or other
  misc_feature (520)..(520): n is a, c, g, or t
  modified_base (614)..(614): a, c, t, g, unknown or other
  misc_feature (614)..(614): n is a, c, g, or t
  modified_base (620)..(620): a, c, t, g, unknown or other
  misc_feature (620)..(620): n is a, c, g, or t
  modified_base (625)..(625): a, c, t, g, unknown or other
  misc_feature (625)..(625): n is a, c, g, or t
tcagtcgtcgctcgcacgaccggtgctcgattttagtatcactcagtacgcggggtagaaaggcctttgaccgaggcaggtccaggcctgacctggtttccttggtctactcttcctccagggaaggggctggagtgggtctctggtataaacttacaatggaggtctacgacaagtctttatagtacgtactcttttggtaggtaggggccgatttcgaccgagtcctccgaggacggacgacggggcctaccgaacgaacctcccgtgtacgtcgtgcaaatgaactacgtctggagagccgaggacgacggtcctattattaactgtagtctcgtgtagtcgggttggggtcgccgtttcggtctttaccggagtcggtcttggggccgtcggctacccgtgttcgactgtctcctacagtccgtcaaccgtaagggccctaagtcccggtccttccccgtggcgacccgtgcctccacggtacgtcaccgacgtagactcacgtacgccggtccgngtactcgacgtcgacgtaagccttaccgtaccgacgcgtaacgacgcggtagccggtacgttcggcgtacgggcgacgtacgtaggctcgtcgncgctancggtnactggtcg

SEQ ID NO: 210287 - DNA, 662 bp, Homo sapiens
  misc_feature: GYAE6OF02HC2HF.21.85.H08.1.454.CMB.1.raw
  modified_base (331)..(331): a, c, t, g, unknown or other
  misc_feature (331)..(331): n is a, c, g, or t
  modified_base (649)..(649): a, c, t, g, unknown or other
  misc_feature (649)..(649): n is a, c, g, or t
  modified_base (655)..(655): a, c, t, g, unknown or other
  misc_feature (655)..(655): n is a, c, g, or t
tcagtcgtcgctcgcacgaccggtgctcgatttagtatcactcagtcgcggggtagaagcctttgaccaggcaggtcaggctgacctggttcttggtcatctcctccagggaagggctggagtgggtctctggtataaattacaatggaggtcacacagcttatagagactctgtgagggccattcaccatcctccagagacagcgaccaagaacctccctgtactctgacaaatgaacagtctgagagccgaggacacggccttatattactgtgcgcgtgatggggttggcgtcccgttttcgttcttcggtatcgttcgtcggggccncggtccacccgttggtctactgttcctccctcgacgtccctacccgaccgaacgggccctacgtcccggttccctttccccccgtgggccccgtcccgttgcccgttaccgacgggtaccgacccgtaccccgttacccggaggtaccgcccgtaaccgacggcccgggtacccggtgggtccctacggtcccggttagggtacctaaaccggggtacccttacccgttttccccgtcgttacccgtcttaaccggtcgacgggaccggtccgtacgggaccggtacgccggtacgtaccggtagctacgctgacgtnacgtcngactgac

SEQ ID NO: 210288 - DNA, 716 bp, Homo sapiens
  misc_feature: GYAE6OF02JL43U.21.85.H08.1.454.CMB.1.raw
  modified_base (160)..(160): a, c, t, g, unknown or other
  misc_feature (160)..(160): n is a, c, g, or t
  modified_base (257)..(257): a, c, t, g, unknown or other
  misc_feature (257)..(257): n is a, c, g, or t
  modified_base (350)..(350): a, c, t, g, unknown or other
  misc_feature (350)..(350): n is a, c, g, or t
  modified_base (690)..(690): a, c, t, g, unknown or other
  misc_feature (690)..(690): n is a, c, g, or t
  modified_base (698)..(698): a, c, t, g, unknown or other
  misc_feature (698)..(698): n is a, c, g, or t
  modified_base (703)..(703): a, c, t, g, unknown or other
  misc_feature (703)..(703): n is a, c, g, or t
  modified_base (709)..(709): a, c, t, g, unknown or other
  misc_feature (709)..(709): n is a, c, g, or t
  modified_base (713)..(714): a, c, t, g, unknown or other
  misc_feature (713)..(714): n is a, c, g, or t
tcagtcgtcgctcgcacgaccggtgctcgatttagtatcactcagtcgcggggtagaagcctttgaccaggcaggtcaggctgacctggttcttggtcatctcctccaggggaaggggctggagtgggtctctggtataaattacaatgggaggtcacanagcttatagagactctgtgaggggccgattcaccatctccgagagacaggccgacctaaagaacctccctagtatctgacaaaatgaactacgtacngaagcggaccggagaccgacggtaccttataattctaggtcgcgtacgtgtacggttggggttcgggtccttcccgtttcgtttcttaccggnttccgtacggttcgggggaccccgtcgggtaccctaacccggttcggtacctacggttcttccctccgtacgaccgtcccttacccgaaaccggaacccggtcccgtacgttcccggttccccgtttccccggtccggtccccggtacccttaccggcctacccggaacgggacgtcccgaccccggtaccgtaacggcgaaccgagtacccgggcccggtacccggtgggcccttcgaccggtttacgtaccgaaacggtcccttacccgttcccgttcgtacctaccgttcgtagggacccggtcggtcagggccaagggtccagtaccggtaaggtnacgtacgngtacnctacgncgtnntc

SEQ ID NO: 210289 - DNA, 710 bp, Homo sapiens
  misc_feature: GYAE6OF02ID1PU.21.85.H08.1.454.CMB.1.raw
  modified_base (691)..(691): a, c, t, g, unknown or other
  misc_feature (691)..(691): n is a, c, g, or t
  modified_base (696)..(696): a, c, t, g, unknown or other
  misc_feature (696)..(696): n is a, c, g, or t
  modified_base (700)..(700): a, c, t, g, unknown or other
  misc_feature (700)..(700): n is a, c, g, or t
  modified_base (707)..(707): a, c, t, g, unknown or other
  misc_feature (707)..(707): n is a, c, g, or t
  modified_base (709)..(709): a, c, t, g, unknown or other
  misc_feature (709)..(709): n is a, c, g, or t
tcagtcgtcgctcgcacgaccggtgctcgatttagtatcactcagtcgcggggtagaagcctttgaccaggcaggtcaggctgacctggttcttggtcatctcctccagggaagggctggagtgggtctctggtataaattacaatggaggtcacacagcttatagagactctgtgaggggccattcacatctcagagacagcgaccaaagaacctcctgtatctgacaaagtcgaaacagttctgagaggaccgaggaacacggacttatagttactgtgcgcgtgtagtgggttggtcttcccttttacgttccgtttacgattcttcggtcggggacccgcgggccctaacccgttgggtacctacgttccgttcctacccgttccgaacgtccccgttaaccgaaccgaaaccgggacccctaacggttcccgggtttacccctttaccccccggtggccccgtcccgtcgtacccgtacccgaggtacccgacccctaacccgtccggtaagaccggaccgaacgtacgggcccggtaccgtcggggtacctcggtccggttaggaaccgtaaaccggtaacccttacccgttttcccgaccggtttacccgttacgtaaccgtttacgggacgggcccgggtcgttacgggaccggtaacgggtaccgacggtaactacggaccngacgnacgnacagcgngnc

SEQ ID NO: 210290 - DNA, 617 bp, Homo sapiens
  misc_feature: GYAE6OF02FHBL6.21.85.H08.1.454.CMB.1.raw
  modified_base (199)..(199): a, c, t, g, unknown or other
  misc_feature (199)..(199): n is a, c, g, or t
  modified_base (364)..(364): a, c, t, g, unknown or other
  misc_feature (364)..(364): n is a, c, g, or t
  modified_base (426)..(426): a, c, t, g, unknown or other
  misc_feature (426)..(426): n is a, c, g, or t
  modified_base (593)..(593): a, c, t, g, unknown or other
  misc_feature (593)..(593): n is a, c, g, or t
  modified_base (605)..(605): a, c, t, g, unknown or other
  misc_feature (605)..(605): n is a, c, g, or t
  modified_base (610)..(610): a, c, t, g, unknown or other
  misc_feature (610)..(610): n is a, c, g, or t
  modified_base (615)..(615): a, c, t, g, unknown or other
  misc_feature (615)..(615): n is a, c, g, or t
tcagtcgtcgctcgcacgaccggtgctcgatttagtatcactcagtcgcggggtagaagcctttgaccaggcaggtcaggctgacctggttcttggtcatctcctccagggaagggctggagtgggtctctggtataaattacaatggaggtcacacagcttatagagactctgtgagggccattcaccatctccaganacagcgaccaagacctccctgtactctgacaaatgaactagtctagagagaccgagacacggccttatattactgtcgcgcgtagtagtgggttggtcgtcccgttttcgttctttcgattcgtcgtcggggccgcggccacccgtgtccagtcgtactcctacncgtccctccaccgaacgggcctagtccgtccttcccccgtggccctcctgcctacgacggcnccaccctccggagacgccacgaccggacccggtccgtcgggcctcggtcccgtcgggttaacgaaccggtacctttaacccgttcccgtaccgtttaccttacccgttacgttccggacggtaccgggtccgttaccggaccgtacgggccgtacgaacgtaggtanccttagctacgnacgtnctagntc

SEQ ID NO: 210291 - DNA, 541 bp, Homo sapiens
  misc_feature: GYAE6OF02F3CHT.21.85.H08.1.454.CMB.1.raw
  modified_base (357)..(357): a, c, t, g, unknown or other
  misc_feature (357)..(357): n is a, c, g, or t
  modified_base (415)..(415): a, c, t, g, unknown or other
  misc_feature (415)..(415): n is a, c, g, or t
  modified_base (450)..(450): a, c, t, g, unknown or other
  misc_feature (450)..(450): n is a, c, g, or t
  modified_base (499)..(499): a, c, t, g, unknown or other
  misc_feature (499)..(499): n is a, c, g, or t
  modified_base (530)..(533): a, c, t, g, unknown or other
  misc_feature (530)..(533): n is a, c, g, or t
  modified_base (535)..(541): a, c, t, g, unknown or other
  misc_feature (535)..(541): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctgtgaggggccattcaccatctccagagacagcgaccaagaacctccctgtatctagcaaatgaacagtctaggagacgccgaggacacggccttatattactgtgcgcgtgagttggggttggtcgtcccttttcgttcttcgatcgtgtcgggccgtcgctccgtgtctactgtcctcctcncgtcctccacgacggcctacgtccgtccctccccgtggccctccctgcctccgagacncctaccgtcggacgtcgcaacgcggcccggtccgngggcctcggcctcgggactaacggcttacctccgtcgtcctactacggngtcgcggtacgcgaccgaggcactagtacgnnnncnnnnnnn

SEQ ID NO: 210292 - DNA, 757 bp, Homo sapiens
  misc_feature: GYAE6OF02HVB6J.21.85.H08.1.454.CMB.1.raw
  modified_base (162)..(162): a, c, t, g, unknown or other
  misc_feature (162)..(162): n is a, c, g, or t
  modified_base (175)..(175): a, c, t, g, unknown or other
  misc_feature (175)..(175): n is a, c, g, or t
  modified_base (738)..(738): a, c, t, g, unknown or other
  misc_feature (738)..(738): n is a, c, g, or t
  modified_base (745)..(745): a, c, t, g, unknown or other
  misc_feature (745)..(745): n is a, c, g, or t
  modified_base (749)..(749): a, c, t, g, unknown or other
  misc_feature (749)..(749): n is a, c, g, or t
  modified_base (755)..(755): a, c, t, g, unknown or other
  misc_feature (755)..(755): n is a, c, g, or t
tcagtcgtcgctcgcacgaccggtgctcgatttagtatcactcagtcggcggggtagaagcctttgaccaggcaggtcaggctgacctggttcttggtcatctcctccgagggaagggctggagtggtctctgtataaattcaatggagtcacacagcttanagagactctgtgngggcctattcaccatctccgagacgacagcgaccaagtacctcctgatctgactaaatcgaactggtctagacgcgccgaggaccctacggtactttaatcttaaccgtggtgacgtcggttggacgtttggggggtttacggtacgttcccccgtttttcgtttaccgttcggtctttccggtttcccggtacggggggaccctaccccggggacctttaaccccgggttgggtacccctaacgtttccggttccccgttaaccctcgtaacccgggtccccccttaacggaacccgtaacgggtaccccctggtttccccccggtttccccgtttcccccgcggggttaccccctccgtcccgtccgttaccggacggtaccacccccgttacccgtaccggacgaacccgccgtacgacccgggtccgtaaccggttgggtaccctcggaccggttacgggactaaccgggttccttacccgttcccgtttcgaccctttaccgtcgttacgacgggtcggaccgtgaaccgacgggttcctcgtaaggtcgacgcgtancgagccngtanctacgntc

SEQ ID NO: 210293 - DNA, 568 bp, Homo sapiens
  misc_feature: GYAE6OF02G59NE.21.85.H08.1.454.CMB.1.raw
  modified_base (355)..(355): a, c, t, g, unknown or other
  misc_feature (355)..(355): n is a, c, g, or t
  modified_base (388)..(388): a, c, t, g, unknown or other
  misc_feature (388)..(388): n is a, c, g, or t
  modified_base (425)..(425): a, c, t, g, unknown or other
  misc_feature (425)..(425): n is a, c, g, or t
  modified_base (447)..(447): a, c, t, g, unknown or other
  misc_feature (447)..(447): n is a, c, g, or t
  modified_base (554)..(556): a, c, t, g, unknown or other
  misc_feature (554)..(556): n is a, c, g, or t
  modified_base (558)..(558): a, c, t, g, unknown or other
  misc_feature (558)..(558): n is a, c, g, or t
  modified_base (562)..(563): a, c, t, g, unknown or other
  misc_feature (562)..(563): n is a, c, g, or t
  modified_base (565)..(567): a, c, t, g, unknown or other
  misc_feature (565)..(567): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtaataaattacaatgggaggtcacacagtcttaatagagactctgtggaggggccattcaccatctccagagacagccgaccaagtaacctccctgtactcgtagacaaatcgaacagttctaggacgacgaccggaggaccacggtccttaattattaactgtgcgtcgtgaggttgggttgggtctcccttttcgttcttcgattcgtcggtggggccncggcctaccgtggcctacgtcgtctcctcgccncccaccaccgacggccctagtccgtacccttccccgnggccctccgtgcctcgacgacncctaccgcgagacgcacgcggacccgtccgtggctcgcgtacgtacaacgtccttaccgtccttcgtctactcgtgacggtcgacgtcgacgtagctcgaagagtcnnncnacgnnannnc

SEQ ID NO: 210294 - DNA, 732 bp, Homo sapiens
  misc_feature: GYAE6OF02GN8ZA.21.85.H08.1.454.CMB.1.raw
  modified_base (280)..(280): a, c, t, g, unknown or other
  misc_feature (280)..(280): n is a, c, g, or t
  modified_base (702)..(702): a, c, t, g, unknown or other
  misc_feature (702)..(702): n is a, c, g, or t
  modified_base (726)..(726): a, c, t, g, unknown or other
  misc_feature (726)..(726): n is a, c, g, or t
  modified_base (730)..(730): a, c, t, g, unknown or other
  misc_feature (730)..(730): n is a, c, g, or t
tcagtcgtcgctcgcacgaccggtgctcgatttagtatcactcagtcgcggggtagaagcctttgaccaggcaggtcaggctgacctggttcttggtcatctccctaccagggaaggggctggagtgggtctctggtataaattacaagtggaggtcacacagcttatagagactcgtgtggacggggccattcaccagtctccgagagacagcgaccaagaacctcctgtactctagacaaatgaacgagtctagagagaccgagacacgctatatacngtgcgcgtgagtgggttgggtacgtccgtttacgtttccgttcgacttcctcggtcggggcccgcggccctacccgttggtccaccgtgtccttccgtcgaacgtccctacccgaaccgtaaccgggccctaacggttaccgggttcccctttccccccggtagggtccccgtacccccgtttacggaccccgtttacccgaagggtaacccgtaccccgtaaccccgttacccggaaacggtccgaaccgaacgtaccggacccgggtaccccgttggggccccttcgggacccgttacgggaaccgttaaacggaccctttaaaccgtttcccccgtaccggtttaccttaacccgttcgtaaccgggtaacggtcgggtcccgtaacgggacgtacgggaccgtaccgtaaacggtcgngaaacgcgtacgtgtacgactacnacgncg

SEQ ID NO: 210295 - DNA, 587 bp, Homo sapiens
  misc_feature: GYAE6OF02IVIFI.21.85.H08.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (374)..(374): a, c, t, g, unknown or other
  misc_feature (374)..(374): n is a, c, g, or t
  modified_base (425)..(425): a, c, t, g, unknown or other
  misc_feature (425)..(425): n is a, c, g, or t
  modified_base (449)..(449): a, c, t, g, unknown or other
  misc_feature (449)..(449): n is a, c, g, or t
  modified_base (572)..(572): a, c, t, g, unknown or other
  misc_feature (572)..(572): n is a, c, g, or t
  modified_base (577)..(577): a, c, t, g, unknown or other
  misc_feature (577)..(577): n is a, c, g, or t
  modified_base (582)..(587): a, c, t, g, unknown or other
  misc_feature (582)..(587): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcaacacagcttatagagactctgtgaggggccattcaccatctcagaganagcgccaagaacctccctgtatctnacaaatgaacagtctgagacgcgaggaccacggccttatattactgtagcgtcgtgatgggggttcgggcgttcccgtttggttccttcgacttccgtacggtcggggccgcggccacccgttcggtaccactcggtcctcctacncgtcccaccaaccgaacggcccagtccgttacccttcccccgtgggtcccncccgttcgcctaccgacgggaccncacccgtccgagcgccaacgacgccggccgtcgggcctcgccgtcgggacaacggtaccttacccgtccggtacgccgtacgtacgtggacgggcggccgtggacgacggtcgcgaagttgancgtantacgnnnnnn

SEQ ID NO: 210296 - DNA, 618 bp, Homo sapiens
  misc_feature: GYAE6OF02JIVIL.21.85.H08.1.454.CMB.1.raw
  modified_base (221)..(221): a, c, t, g, unknown or other
  misc_feature (221)..(221): n is a, c, g, or t
  modified_base (425)..(425): a, c, t, g, unknown or other
  misc_feature (425)..(425): n is a, c, g, or t
  modified_base (598)..(598): a, c, t, g, unknown or other
  misc_feature (598)..(598): n is a, c, g, or t
  modified_base (601)..(601): a, c, t, g, unknown or other
  misc_feature (601)..(601): n is a, c, g, or t
  modified_base (607)..(607): a, c, t, g, unknown or other
  misc_feature (607)..(607): n is a, c, g, or t
  modified_base (610)..(610): a, c, t, g, unknown or other
  misc_feature (610)..(610): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
tcagtcgtcgctcgcacgaccggtgctcgatttagtatcactcagtcgcggggtagaagcctttgaccaggcaggtcaggctgacctggttcttggtcatctcctccagggaaggggctggagtgggtctctggtataaattacaatggaggtcacacagcttatagagactctatgaggggccgattcaccatctccagagacagcgccaagaactcccngtatctgcaaatgaacagtctagagacggccgaggacaccggccttatacttactgtgcgcgtgagtgggttgggtcgtccctttcgttcttcgatctcgtggggccgcggcacccgtggtcactgtctcctcacgtcctccgaccaacgggcccagttccggtcccttcccccgtcgggccgtcccgtgcctccgacgggacnccgaccctccggacgacgaccgacgacgccggcccgttcgggccttcggcccgttacgggtaccgaaacgggtaccttacccgtttacccccgttcgtacccgttaccgttaccgtaggaaccgggtccgggtaccgtcgggaccggtacggggccgaccgagtaacgcgacncgngtacgntcngcgcngng

SEQ ID NO: 210297 - DNA, 633 bp, Homo sapiens
  misc_feature: GYAE6OF02G67ZN.21.85.H08.1.454.CMB.1.raw
  modified_base (192)..(192): a, c, t, g, unknown or other
  misc_feature (192)..(192): n is a, c, g, or t
  modified_base (615)..(615): a, c, t, g, unknown or other
  misc_feature (615)..(615): n is a, c, g, or t
  modified_base (620)..(622): a, c, t, g, unknown or other
  misc_feature (620)..(622): n is a, c, g, or t
  modified_base (624)..(624): a, c, t, g, unknown or other
  misc_feature (624)..(624): n is a, c, g, or t
  modified_base (626)..(629): a, c, t, g, unknown or other
  misc_feature (626)..(629): n is a, c, g, or t
  modified_base (631)..(633): a, c, t, g, unknown or other
  misc_feature (631)..(633): n is a, c, g, or t
tcagtcgtcgctcgcacgaccggtgctcgatttagtatcactcagtcgcgggggtagaagcctttgaccaggcaggtcaggctgacctggttcttggtcatctcctccagggaggggctggagtgggtctctggtataaattacaatgggaggtcacacagcttatagagactctgtggagggcattcaccntcctccagagacagcgccaaagacctcctgtactctagacaaaatcgaacagttcgtagagacggaccgaggaccgacggtccttaatacttactgtcgcgcggtggtagtggggttggtcgtcccgttttcgttcgttcgatcgtcgtcggggccgcggcctacccgtcggtccacgttcgtccttcctaccgacggccctacccgaaccgtaaccgggccctacgttccggttccccttcccccgtcggcccgtccctcgtccctcgacggaccgaccgtacccgtcggagaccaccgaacgccgggtcccggcccgtcgggacctacggccgttacgaccgtaaaccggtcccttacccgttcccctcggtttaccctcgttaccgtaggtccggcggtcgtacggaccgaggccgtacnggtannngngnnnncnnn

SEQ ID NO: 210298 - DNA, 548 bp, Homo sapiens
  misc_feature: GYAE6OF01BV2S6.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacgcttatctgcagaactaaccaaccttcaacctgacgacactgccgttttattttgtacgagagtcgtcgtctgtcaggtgaattgactcgtggggccagggtaaccctggtccaccgttctccgtcacgccctccaccgaagggcccc

SEQ ID NO: 210299 - DNA, 541 bp, Homo sapiens
  misc_feature: GYAE6OF01C3IZH.7.78.H01.1.454.CMB.1.raw
  modified_base (402)..(402): a, c, t, g, unknown or other
  misc_feature (402)..(402): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtcacaggccctggacaaggccttgactacatgggatggatcaacaccgacactgggaaccccactatgcccaggccttcacgagggtcgtttgcttctccatcggatacctctggtcggacgcttanctgcagactaaccaacttcaacctgacacactgtaccgttttattttgaacgtagagtcgttacgtctgtcagtgaattgactcgtgggcctaggaccctggtccaccgtctcctcacgtccaccgaccgaagggcccc

SEQ ID NO: 210300 - DNA, 580 bp, Homo sapiens
  misc_feature: GYAE6OF01CSZD2.7.78.H01.1.454.CMB.1.raw
  modified_base (527)..(527): a, c, t, g, unknown or other
  misc_feature (527)..(527): n is a, c, g, or t
  modified_base (546)..(546): a, c, t, g, unknown or other
  misc_feature (546)..(546): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggccctggacaaggccttgactacatggatggatcaacaccgacacgtcgggaaccccactatcgtccaacggtccttcgacgggggtcggttttcgtcctttccgtccagttcggacttacccgtcgttcggtcggggacggtcttaagtctgcaagtactaaacccaaccttccaacctgacgacactgtccgttttattttgacgagtacgcgttcgtctgtctagtggtattgactacgngggccagggaccctggtcnccgtctcctcacgccctaccaccgaggccctacg

SEQ ID NO: 210301 - DNA, 617 bp, Homo sapiens
  misc_feature: GYAE6OF01C3Y4R.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggcccctggacaaggccttgactacagtgggatggatcaacaccgacactcgggaaccccactactcgcccaggccttcgacgagggtcggtttgtcttctccatcggactacctctggtcgggacgtcttatctgcagactaaccaacttcaacctgaccgacacttcgtaccgttttattttcgacgtagtacgtccgttcgtctgtctagttggtaacttggtaacctacggttcgggggacccgtaacggggtaaccccgttgggttacccacccggttcttccccgtaccgaccggtcccctaccccgaacccgaacggggtccccc

SEQ ID NO: 210302 - DNA, 538 bp, Homo sapiens
  misc_feature: GYAE6OF01DZFKK.7.78.H01.1.454.CMB.1.raw
  modified_base (531)..(531): a, c, t, g, unknown or other
  misc_feature (531)..(531): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcggtttgtcttctccatggatacctctgtcgggacggcttatctgcagataaccaaccttcaacctgacgacactgcccgttttattttgtacgagagtcgtcgtctgtcagtggaattgactacgtgggccagggaaccctggtcaccgtctcctcacgcctccncaggccc

SEQ ID NO: 210303 - DNA, 594 bp, Homo sapiens
  misc_feature: GYAE6OF01COO84.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattggtccgacaggccctggacaaggccttgactacagtgggatggatcaacaccgacacgtacggaacccactactgcccaggccttcacgtagggtcgttttgtcttctcatggacttacctcgtggtccgggacggtcttatctgcagaactaaccaaccttcaacctgacgactactcgtccgttttattttacgacgagtacgtcggttcgttctcgttctaggttaggaactttcggaacttcgtcggggacctaaggggtaccccttcgggtcctacccgtctacccgtcacgtccctacccgacgaaccgggtcccc

SEQ ID NO: 210304 - DNA, 555 bp, Homo sapiens
  misc_feature: GYAE6OF01AGOGI.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccactatgcccaggccttcacagggcggtttgtcttctccatggatacctctgtcgggacggtcttatctgcagactaaccaaccttcaacctgacgacactgtccgttttattttgtacgtagagtcgtcgtctgtcagtggaattgactacgtggggcctagggtaaccctggtccaccgtctcctcacgtccctccaccgaacgggtcccc

SEQ ID NO: 210305 - DNA, 544 bp, Homo sapiens
  misc_feature: GYAE6OF01E2MJG.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttatctgtcaattgggtccgacaggcccctggacaaggccttgactacatgggatggatcaacaccgacactcgggaaccccactatcgcccaggccttcacagggcgtttgcttctcatggatacctctgtcgggacgcttatctgcagactaaccaacttcaacctgacacactgtccgttttatttgacgagtagcgtcgtctgtcaggtgtaattcgactacgtgggccagggtaccctggtcaccgtctccctcacgtccctccgaccgacgggtcccc

SEQ ID NO: 210306 - DNA, 566 bp, Homo sapiens
  misc_feature: GYAE6OF01C1OOH.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggcccctggacaaggccttgactacatggatggatcaacaccgacacgtcgggaaccccactactgcccaggtccttcacgacgggtcgtttgtcttctcatcggactacctcgtgtcgggacggtcttatctgcagtaataacccaaccttacaacctgacacactcgtcttttattttcgtacgtagtacgtcgtcgtctgtctagtgtaattgactacgtgggaccgtacgggaccctggtccaccgtctcccgtcacgcctccaccgacgggtaccc

SEQ ID NO: 210307 - DNA, 539 bp, Homo sapiens
  misc_feature: GYAE6OF01C0QBH.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacacggcccctggacaaggccttgactacatgggatggatcaacaccgacacgtacgggaaccccacctactcgcccaggccttcacgagggtcgtttgtcttctcatggactactctggtcgggacgtcttatctgcagactaaccactcaactgacacactgtctttattttgacgtgagtcgttcgtctgtcagtgattgactagtgggccagggtacctcggtcacgtctcctcacgtccctccacgacggtccc

SEQ ID NO: 210308 - DNA, 545 bp, Homo sapiens
  misc_feature: GYAE6OF01C1PUW.7.78.H01.1.454.CMB.1.raw
  modified_base (533)..(533): a, c, t, g, unknown or other
  misc_feature (533)..(533): n is a, c, g, or t
  modified_base (536)..(536): a, c, t, g, unknown or other
  misc_feature (536)..(536): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacacgtcgggaaccccacctatcgacccaggccttcacgagggtcgtttgtcttctccatggactacctctgtcgggacgtcttatctgcagactaaccaaccttcaacctgaccgacactgtcctttattttgtacgagagtcgtcgtctgtcagtgattcgactacgtgggccgaggacctggtcaccgtctcgtacacgccnccnccgaggccc

SEQ ID NO: 210309 - DNA, 548 bp, Homo sapiens
  misc_feature: GYAE6OF01B4TGE.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccgacaggcccctggacaaggccttgactacatgggatggatcaacaccgacactgggaaccccactatcgcccaggccttcgacagggtcgtttggtccttctccatggatacctctggtcgggacggcttatctgcagataaccaaccttcaacctgaacgactactcgtccgttttattttcgtacgagagtcgtcgtctgtcaagtgaattgactgtcgggcgagggaccctggtccaccgtctcctcacgcctccaccgacggtccc

SEQ ID NO: 210310 - DNA, 546 bp, Homo sapiens
  misc_feature: GYAE6OF01DAOKT.7.78.H01.1.454.CMB.1.raw
  modified_base (323)..(323): a, c, t, g, unknown or other
  misc_feature (323)..(323): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatggatggatcaanaccgacactgggaaccccactatgcccaggccttcacagggtcgtttgtcttctccatggatacctctgtcgggacgcttatctgcagactaaccaaccttcaacctgacgacactgtccgtttattttgtacgagtagtcgtcgtctgtcagtggaattgactacgtgggccagggaaccctggtccaccgtctccgtcagccctaccacgaacgggtcccc

SEQ ID NO: 210311 - DNA, 547 bp, Homo sapiens
  misc_feature: GYAE6OF01C0BU6.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaggccttgactacatgggatggatcaacaccgacactcgggaaccccacctatcgcccaggccttcacagggcggtttgtcttctccatggatacctctgtcgggacggtcttatctgcagataaccaaccttcaacctgacgacactgtccgtttattttgtacgtagagtcgtcgtctgtcagtgaattgactacgtggggccacgggtaaccctggtccaccgtctcctcacgcctccaccgacgggccc

SEQ ID NO: 210312 - DNA, 573 bp, Homo sapiens
  misc_feature: GYAE6OF01A7JS6.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcgtttgtcttctccatggatacctctgtcggggacggcttatctgcagataaccaaccttcaacctgacgacactgccgtttattttgtacgtagagcgtcgtctgtcagtggaattgacttacgtggggtaccgacggggtaaccccttgggtcccacccgtcctccccgttacacggtcccctcccgacccgaacggggtcccccg

SEQ ID NO: 210313 - DNA, 538 bp, Homo sapiens
  misc_feature: GYAE6OF01DPPS7.7.78.H01.1.454.CMB.1.raw
  modified_base (530)..(530): a, c, t, g, unknown or other
  misc_feature (530)..(530): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaaggccttgactacatgggatggatcaacaccgacactgggaaccccacctatgccaggccttcacaggcggtttgtcttctccatggatacctctgtcgggacggcttatctgcagataaccaaccttcaacctgatgactactgtccgtttattttgtacgagtagcgtcgtctgtcagtgaattgactacgtggggcctagggaaccctggtccaccgtctcctcacgcctccnccgaacgg

SEQ ID NO: 210314 - DNA, 564 bp, Homo sapiens
  misc_feature: GYAE6OF01CIATU.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcgtttgtctctcatggatacctctgtcgggacgtcttatctgcagactaaccaaccttcaacctgacgacactcgtaccgttttatttttcgtacgtagtagtccgttcgttcgttgtcgagttgaatttgactacgtgggaccgacgggtaccctggtctaccgtcctccgtcacgccctaccaccgaacgggtcccc

SEQ ID NO: 210315 - DNA, 653 bp, Homo sapiens
  misc_feature: GYAE6OF01D93IQ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactactttattctgtctaattgggtccgacacggcccctggacaaggccttgactacatgggatggatcaacaccgacacgtacgggaacccccactatcgcccacggccttcacgagggtcgtttgtcttctccatcggtactacccgtcgttggtccggggtacggtctttatctgacagaactaaaccctaaccttcaacctgaaccgactacgtgttaccgtttttattttcgaacgtagtacgtccgttcgttcttcgtctaggttaggtaagttcggaaccgttacggtcgggggtacccgtaacgggggtaaccccttcggggtaccctaacccgggttccctacccgttcccaacggtcccccttacccgaacccgaaccggggtccccc

SEQ ID NO: 210316 - DNA, 547 bp, Homo sapiens
  misc_feature: GYAE6OF01C1NAY.7.78.H01.1.454.CMB.1.raw
  modified_base (326)..(326): a, c, t, g, unknown or other
  misc_feature (326)..(326): n is a, c, g, or t
tcagcgtgtctctacacgaccggtgctcgatttagtgtgagtagtttggggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacnccgacactgggaaccccactatgcccaggccttcacagggtcgtttgtctctccatggatacctctgtcgggacgcttatctgcagataaccaaccttcaacctgacgacactcgtccgtttattttgacgagacgcgtcgtctgtcagtgaattgactcgtgggccgacgggaccctggtccaccgtctccgtacacgccctcccgaccgaacgggcccc

SEQ ID NO: 210317 - DNA, 535 bp, Homo sapiens
  misc_feature: GYAE6OF01DU1YX.7.78.H01.1.454.CMB.1.raw
  modified_base (527)..(527): a, c, t, g, unknown or other
  misc_feature (527)..(527): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcggtttgtcttctccatggatacctctgtcggacgcttatctgcagataaccaacttcaacctgacgacactgtccgtttattttgtacgagagcgtcgtcttgtcagtgaattgtactacgtgggccagggtaaccctggtcaccgtctcctcacgcctcnccaggccc

SEQ ID NO: 210318 - DNA, 571 bp, Homo sapiens
  misc_feature: GYAE6OF01BJ7UR.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggccctggacaaggccttgactacatgggatggatcaacaccgacactgggaaccccactatcgccaggccttcacgagggcgtttgtcttctccatggactacctctgtcgggacgcttatctgcagataaccaaccttcaacctgacgacaactgtaccgttttattttcgtacgtaagtacgtcgttccgtcttgttacaggttggtaattgacttacgtaggggcccgaagggtaaccccttggtccaccgtcctccgtcacgtccctccaccgaacgggtccc

SEQ ID NO: 210319 - DNA, 601 bp, Homo sapiens
  misc_feature: GYAE6OF01CGVTL.7.78.H01.1.454.CMB.1.raw
  modified_base (244)..(244): a, c, t, g, unknown or other
  misc_feature (244)..(244): n is a, c, g, or t
  modified_base (463)..(463): a, c, t, g, unknown or other
  misc_feature (463)..(463): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttcnggatacatcttcacttacttattctgtcaattcgggtccgacacggcccctggacaaggtccttgactacagtgggatggatcaacaccgacacgtacgggaacccctactactgacccaggccttacgacgagggtcggtttgtcttctcctagtcggacttacctcgtggtcgggacgtcttatctgacagtaactacaaccttcaacctgactacnctcgtacgtttagtttgacgtagagtcgtcgtcgtgttcgagttagattcggactacggtcggggaccgtacgggtaaccctggtaccctacccgttctacccgtcgaccgtccctacccgaccggtacgggtacccc

SEQ ID NO: 210320 - DNA, 554 bp, Homo sapiens
  misc_feature: GYAE6OF01BWW39.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatcgcccaggccttcacagggcgtttgtcttctccatggatacctctgtcgggacggcttatctgcagataaccacttccaacctgaccgacactgtccgttttattttgtacgagagtccgttcgtcttgtcaggttggaattcgactacgtggggccaggggtaccctggtccaccgtctccgtcacgcctccaccgaacgggtccc

SEQ ID NO: 210321 - DNA, 596 bp, Homo sapiens
  misc_feature: GYAE6OF01BJ5CU.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttctggatacatcttcactacttattctgtcaattgggtccgacaggcccctggacaaggccttgactacatgggatggatcaacaccgacactgggaaccccactatcgcccaggccttacacgagggtcggtttgtcttctccatggactacctctgtcgggacgtcttatctgcagactaaccaacttcaacctgacgacactgtcccttttattttcgtaacgtagtacgtcgtcgtcgtgttacgaggttaggtaattgaacgttacgtcggggacctacggggtaacccgtgggtacccaccggttcctacccgttccacggcccttacccgaacccgtaacgggtacccccg

SEQ ID NO: 210322 - DNA, 633 bp, Homo sapiens
  misc_feature: GYAE6OF01BXZOG.7.78.H01.1.454.CMB.1.raw
  modified_base (396)..(396): a, c, t, g, unknown or other
  misc_feature (396)..(396): n is a, c, g, or t
  modified_base (435)..(435): a, c, t, g, unknown or other
  misc_feature (435)..(435): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactccaggtgcagctggtacagtctgggtctgaattgaggaagcctggggcgtcagtgagcgttgcctgcaagccttctggatacatcttcacttacttattctgtcaagttgggtccgacacggcccctggacaaggcctttgactacatgggatggatcaacaccgacactcgggaaccccactatcgccagccttcacgaggtcgtttgtcttctcctatggattacctntggtcgggtacgcttatctgacagtactaaccaaccttnaacccgtgaaccgactactcgtaccgtttttattttacgaacgtaggtacgtccgtttcgtaccttggtactagggttacggtaactttggtaccgttaccggtacgggggccctaaacgggggtacccctggttaccctaacccggttccttacccgtccgaccgtaccccgtccctaacccgaaacggggtccccc

SEQ ID NO: 210323 - DNA, 543 bp, Homo sapiens
  misc_feature: GYAE6OF01DDDGA.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccactatcgccaggccttcacagggcggtttgtcttctcatggattacctctggtcgggacggtcttatctgcagataaccaaccttcaacctgacacactcgtccgtttattttgtacgagagtcgtcgtctgtcagtgaattgactacgtgggccagggaaccctggtccaccgtctcctcacgcctccaccgacgggccc

SEQ ID NO: 210324 - DNA, 550 bp, Homo sapiens
  misc_feature: GYAE6OF01DT474.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatggggatggatcaacaccgacactgggaaccccactatcgccaggccttcacagggcgtttgcttctcatggatacctctgtcgggacgtcttatctgcagataaccacttacaacctgacgactacgtgtccgttttattttcgtacgagtagcgtgtctgttcagtggaattgactacgtgggcctacgggaaccctggtccaccgtctcccgtcacgccctccaccgaagggtcccc

SEQ ID NO: 210325 - DNA, 653 bp, Homo sapiens
  misc_feature: GYAE6OF01CG8B1.7.78.H01.1.454.CMB.1.raw
  modified_base (384)..(384): a, c, t, g, unknown or other
  misc_feature (384)..(384): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtctaagttcggtccgacacggcccctaggacaaggccttgactacgatggatggatacaacaccgacacgtcgggaacccacctatcgccgagccttcgacgggtcgtttgtcttcnctagtgactacctcgtgtacgggacgtcttatcgtgcaagtactaaaccgtacctttacgaaccgtcgaacgtactaccttcgttaccgtttttacgttttacggaacgtagtacgtcgttcgttcgttcgtacgttacggttagtaacgttcgtaacgttaccggtacggggtaccgtaacggggtaccccgttggtacccgtaccccggttccttcccgttaccgtaccgtacccctacccgaacccgaacggggtcccctaaccgg

SEQ ID NO: 210326 - DNA, 549 bp, Homo sapiens
  misc_feature: GYAE6OF01DMJQ2.7.78.H01.1.454.CMB.1.raw
  modified_base (383)..(383): a, c, t, g, unknown or other
  misc_feature (383)..(383): n is a, c, g, or t
  modified_base (524)..(524): a, c, t, g, unknown or other
  misc_feature (524)..(524): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccgacaggcccctggacaaggccttgactacatgggatggatcaacaccgacactacgggaaccccacctatcgcccaggccttcgacggggcggtttgtctttcnccatggactacctctggtcgggacggcttatctgcagataaccaacttcaacctgacacactgtccgttttattttgtacgagtagcgtcgtctgtcagtggattgactcgtgggcagggtaaccctggtcaccgtctccncacgcctccaccacgggccctacgg

SEQ ID NO: 210327 - DNA, 543 bp, Homo sapiens
  misc_feature: GYAE6OF01BX1Y9.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaaggccttgactacatgggatggatcaacaccgacactgggaaccccacctatcgcccaggccttcacagggcgtttgtcttctccatggatacctctgtcgggacggcttatctgcagataaccaacttcaacctgacgacactgtccgtttattttcgtacgtagtagcgtcgtctgtcagtggaattgactacgtgggccacgggtaccctggtcaccgtctcctcacgccctccacgagggtccc

SEQ ID NO: 210328 - DNA, 545 bp, Homo sapiens
  misc_feature: GYAE6OF01BA7NI.7.78.H01.1.454.CMB.1.raw
  modified_base (522)..(522): a, c, t, g, unknown or other
  misc_feature (522)..(522): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatcgccagccttcacagggcgtttgtcttctccatggatacctctcgtcgggacgtcttatctgcagactaaccaaccttcaacctgacgacactgtccgtttattttgtacgagtagtcgtcgtctgttcagtggaattgactacgtaggggcctagggaccctggtccaccgtcncctcacgcctccaccgacggccc

SEQ ID NO: 210329 - DNA, 558 bp, Homo sapiens
  misc_feature: GYAE6OF01E1L92.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggccctggacaaggccttgactacatgggatggatcaacaccgacacgtcgggaaccccactatcgcccaggtccttcacgagggtcgttttgtccttctcctagtggactacctcgtcggtcgggtacggtcttatctgcagaactaaccaacttcaactgacacactgtcttttatttcgacgtagagcgtcgtctgtcagtggaattgactacgtgggccgagggtaccctggtccaccgtcctccgtacacgtccctccgaccgacggccc

SEQ ID NO: 210330 - DNA, 569 bp, Homo sapiens
  misc_feature: GYAE6OF01BZBHB.7.78.H01.1.454.CMB.1.raw
  modified_base (540)..(540): a, c, t, g, unknown or other
  misc_feature (540)..(540): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaaggccttgactacagtgggatggatcaacaccgacacgtcgggaacccactatcgcccaggccttcgacggggtcgtttgtcttctcagtgtactacctcgtcgtcgggacgtcttatctgctagactaaaccaccttacaaccgtcgacgtacactcgtaccgttttattttgacgtagtacgtcgtcgtctgtcagtgtattgacgtacgtgggtaccagggtaccctaggcctccgtctccncgtacgtcctaccaccgacggtccctacg

SEQ ID NO: 210331 - DNA, 633 bp, Homo sapiens
  misc_feature: GYAE6OF01D9KTU.7.78.H01.1.454.CMB.1.raw
  modified_base (284)..(284): a, c, t, g, unknown or other
  misc_feature (284)..(284): n is a, c, g, or t
tcagcgtgtctctacacgaccggtgctcgatttagtgtgagtagttgggtttgggggacccaacaaccacacccctcctaagaagtaagcccctagaccacaggctccacaccgatggacctggacctggaggattcctcttcttggtggcagttacgcaaccaggtgcccgactcccaggttggcagctggtacagtctgggtactgaattgaggagcctggggcgtcaggtgagccgttgcctgcctaagccttctggatacatcttcacgtaacttattcngtcaattggtccgataggccctggactaaggccttagacctacagtgggactggactcgaactaccgaacactcgggaaccctaccgtatcgccgtaagccttacactagggtcgttttcgacttctcctagtggtactacccgttctcggtacggacggtcttacgtcctacgacgtacgtaactaaccgtaaacttcctaaccgtcgaccgtactaccttagtccgtttattttcgacgtacgtacgcgttacgtaccgtgttctagttggaacttcgagttacgtgggaccaagggtacccgtggtacacccgtctccgtctacgccctccgtaccgcggtacccg

SEQ ID NO: 210332 - DNA, 568 bp, Homo sapiens
  misc_feature: GYAE6OF01BQT3N.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatcgcccaggccttcacagggcggtttgtcttctcatggactacctctgtcgggacgcttatctgcagataaccaacttcaacctgaacacactgtccgttttattttcgacgtagagtcgtcgtcgtgtctagtggtaattgacttacgtggggacccaggggtaacccttgggtccaacccggttctccctcgacgtccctcccgaacccgaaggggtcccc

SEQ ID NO: 210333 - DNA, 566 bp, Homo sapiens
  misc_feature: GYAE6OF01ESEU4.7.78.H01.1.454.CMB.1.raw
  modified_base (549)..(549): a, c, t, g, unknown or other
  misc_feature (549)..(549): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccgacaggcccctggacaaggccttgactacatgggatggatcaacaccgacactcgggaaccccacctatcgcccgaggcccttcacgaggggcgttttgtcttctccatggactaccgtctggtcgggacggtcttatctgcagaactaaccaccttaccaacctgaccgactactcgttccgttttagttttgtacgtagaggtccgtcgtctgtcagtaggtattgacttacgcgggccgacgggacctggtcaccgtctcctcgacnccctccacgacggcccg

SEQ ID NO: 210334 - DNA, 583 bp, Homo sapiens
  misc_feature: GYAE6OF01CP153.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacacgtcgggaaccccacctatcgcccaggccttcacgagggtcgtttgtccttctccatcggacttacctcgtggtcgggacgtcttatctgcagactaaccaactcaactgacacactcgtacgtttatttcgtacgtagtagtcgttcgtctgtcgtagtggtaattgacgtacgtggggaccgtacggggtaaccctgggtccctaccgtccttcccgtctaccgcccttcccaaccgtaacgggtccccg

SEQ ID NO: 210335 - DNA, 543 bp, Homo sapiens
  misc_feature: GYAE6OF01EH42M.7.78.H01.1.454.CMB.1.raw
  modified_base (530)..(530): a, c, t, g, unknown or other
  misc_feature (530)..(530): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcgtttgtcttctccatggatacctctgtcgggacgcttatctgcagataaccaaccttcaacctgacgacactcgtccgtttattttgacgagagtcgtcgtctgtcagtggattgactacgtgggccgagggaccctggtccaccgtctcccgtcacgccctccnccgaacgggcccc

SEQ ID NO: 210336 - DNA, 552 bp, Homo sapiens
  misc_feature: GYAE6OF01AZQNC.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgctgcctgcaagccttctggatacatcttcactacttattctgtcaattgggtccgacaggcccctggacaaggccttgactacatgggatggatcaacaccgacactgggaaccccacctatgcccaggcccttcacgagggtcggtttgtcttctccatggatacctctgtcgggacgtcttatctgcagactaacccaaccttcaacctgacgacactgtccgtttattttgtacgagtagcgtcgtctgtcagtggattgactacgtggggccagggaaccctggtaccaccgtctccctcacgccctccgaccgtaaccggg

SEQ ID NO: 210337 - DNA, 549 bp, Homo sapiens
  misc_feature: GYAE6OF01A4K5E.7.78.H01.1.454.CMB.1.raw
  modified_base (254)..(254): a, c, t, g, unknown or other
  misc_feature (254)..(254): n is a, c, g, or t
tcagcgtgtctctacacgaccggtgctcgatttagtgtgagtagtttgggtttggggacccgaacaaccacacccctcctaagaagaagccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttctggatacatcttnactacttattctgtcaattgggtcgacaggccctggacaaggccttgactacatgggatggatcaacaccgacactgggaaccccactatgcccaggccttcacggggcgtttgtcttctccgatggatacctctgtcggacggcttatctgcagataaccaacttcaacctgacgacactgtccgtttatttgtacgagagcgtcgtctgtcagtgaattgactacgtgggaccaggggaccctggtcaccggtctacccgtcgtacgcccttacacccgtaagggcccctagg

SEQ ID NO: 210338 - DNA, 571 bp, Homo sapiens
  misc_feature: GYAE6OF01A12TE.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtctaagttgggtccgacgacggcccctggacaaggtccttgactacagtgggatggatcaacaccgacacgtacgggaaccccacctatcgcccgaggcccttcacgtacgggtcggtttcgtccttctacctagtcggtacttacctcgtcggtcggggacgtcttagtctgcaagactaaccaaccttacaacctgacactactgtaccgtttattttgacgtagagtcgtcgtctgtcagtgtatgactcgtgggcgacggtacctggccaccgtctcctcacgcctccgcgacggccc

SEQ ID NO: 210339 - DNA, 542 bp, Homo sapiens
  misc_feature: GYAE6OF01C088H.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcgtttgtcttctccatggatacctctgtcgggacgtcttatctgcagactaaccaaccttcaactgacacactgtcctttattttgtacgtagtagcgttcgtctgtcagtgaattgactacgtgggccgagggaccctggtcaccgtctccgtcacgcctacccaccgacggtccc

SEQ ID NO: 210340 - DNA, 638 bp, Homo sapiens
  misc_feature: GYAE6OF01CH0RR.7.78.H01.1.454.CMB.1.raw
  modified_base (241)..(241): a, c, t, g, unknown or other
  misc_feature (241)..(241): n is a, c, g, or t
  modified_base (346)..(346): a, c, t, g, unknown or other
  misc_feature (346)..(346): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggctcagtgagcgttgcctgcaagccttcnggatacatctcacttattattctgtcaagttggtccgacacgccctggacaaggccttgactacagtggatggatacaacaccgacacgtacggaacccactacncgacccaggtcctacgacgtagggtcggttttagtccttctccgagttaggacttacccttcgtacgggttccggggtacggtactttacgttcgttcgactaagtaactaaccctaacctttacaaccgtacgaccgaactaccttcgttaccgttttagttttacgaacgtagtacgtcgttcgtcgttgttacgacggtagtaagttcgtacgtacggtgggtaccgacgggtacctcggtaccctaccgttctccgtaccgacaccctaccgacccgacggtaccccg

SEQ ID NO: 210341 - DNA, 584 bp, Homo sapiens
  misc_feature: GYAE6OF01D73VZ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggcccctggacaaggccttgactacagtgggatggatcaacaccgacactacgggaaccccactatcgcccaggccttcacgagggtcgtttgtcttctcatggactacctctcggtcgggacgtcttatctgcagtactaacctaaccttacaacctgaccgactacgtgttccgttttattttcgacgtagagtcgtcgttctgtctaggtagtattcgacgttacggtcgggtaccgacgggtaaccctcggtccaccgtctcccgtacgacgccctacccgacgaccggtacccg

SEQ ID NO: 210342 - DNA, 547 bp, Homo sapiens
  misc_feature: GYAE6OF01BHX1Q.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggccctggacaaggccttgactacatgggatggatcaacaccgacactcgggaaccccactatcgcccaggccttcacagggtcgtttgtcttctccatggactacctctgtcgggacggtcttagtctgcagactaaccaaccttcaacctgacgacactcgtacgtttattttacgacgagtagtcgtcgtctgtctagtgattgtactcgtgggccgacgggtacctggtccaccgtctcctcacgcctccaccgacggccc

SEQ ID NO: 210343 - DNA, 633 bp, Homo sapiens
  misc_feature: GYAE6OF01AXN95.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtcaattggtccgacaggcccctggacaaggccttgactacagtgggatggatcaaccaccgacaccgtcgggaaccccacctatcgacccacggccttacacgacgggtcgtttcgtcttctcctagtggtactacctcgtcggtcgggacgtcttactctgcagtaactaaccaaccttcaaccgtgaacgtacctacgtacgttaccgttttaattttcgtaacgtagtacggtccgttacgttcttggtacgtaggtaggtaacgttgtaccgttacggtacggggccgtaacggggtaaccctgggtccacccggttctacccgtcgaccgtccctacccgaaccgtaccgggtaccccg

SEQ ID NO: 210344 - DNA, 561 bp, Homo sapiens
  misc_feature: GYAE6OF01CZ2UE.7.78.H01.1.454.CMB.1.raw
  modified_base (322)..(322): a, c, t, g, unknown or other
  misc_feature (322)..(322): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggaagcctggggctcagtgagcgttgcctgcaagccttctggatacatcttcactattattctgtcaattgggtccgacaggcccctggacaaggccttgactacatgggatggatcaacnccgacactgggaaccccactatcgcccaggccttcacagggtcgtttgtcttctccatggatacctctgtcgggacgtcttatctgcagtactaaccaaccttcaacctgaccacactgtaccgtttattttgtacgtagtagtcgtcgtctggtcaggtggaattgactacgtggggccgtacgggaacccttggtccacccgtctccctcgacgccctccaaccgacgggtaccccg

SEQ ID NO: 210345 - DNA, 670 bp, Homo sapiens
  misc_feature: GYAE6OF01CY46M.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaagttgggacctacacggccctggacaaggccttgactacagtggatggatcaacaccgacacgtcgggaaccccactactcgacccaggccctttacgacgacggggtcgttttcgtccttctaccgtagttcgggacttaccgtcgttggtaccggggtacgtctttaagttccgtaggaccgtaagtaaccgtaaaccctaaccctttacaaacccgttggaaccgtaacctacgttcggtttaccgtttttaattttcggtaccgtaagtacgtccgttacgttccttaggtctaggttcgtaagttgtaaccgtacggtcgggaccgaacgggtaccctgggttcccaccgttccgtaccctacgtaccgtcccgtaccgacccgtacgggtcccc

SEQ ID NO: 210346 - DNA, 716 bp, Homo sapiens
  misc_feature: GYAE6OF01DP3HI.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccacctatcgcccacggccttcacgagggtcggtttcgtcttctcctatcgggtactaccgtcgtggtacccggggacggtcctttacgtccgtgactacggtaacttaaaaccctaaccctttaccaaacccttggaacccgtaacctacgttacggttaccgtttttaagttttttacggtaacggtaaggtaacggtccggtttacggtccttacggttctaagggttggtaaacgttcggtaccgttaccggtcgggggtacccgtaaaccgggggtaaccccttcggggttaccaacccccgggttccttacccgtaccggtaacccggtccccttacccccgaaacccggtaaccgggggtaccccccg

SEQ ID NO: 210347 - DNA, 548 bp, Homo sapiens
  misc_feature: GYAE6OF01EEC49.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatggggatggatcaacaccgacactgggaaccccacctatcgcccaggccttcacagggcggtttgtcttctccatggatacctctgtcgggacgcttatctgcagataaccaaccttcaacctgacgcactgccgttttattttgtacgtagagcgtcgtctgtcagtggaattgactacgtggggccagggaaccctggtccaccgtctccctcacgccctccaccgacgggtcccc

SEQ ID NO: 210348 - DNA, 677 bp, Homo sapiens
  misc_feature: GYAE6OF01DFS2I.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggctcagtgagcgttgcctgcaagccttcgtggatacattctacacttacttattctattcaagttcgggtccgacgacggcccctaggacaagggcctttgaactacagttcgggatcggatacaaacgacccgacgaccgtccgggaaacccctactaactcgaccccgaggtcccttacgacgtacggggtcgttttcggtccttcctaccgagtcgggtaacttacccttcgtcgggtaccgggacggtccttagtcctgacaaggtaaacctaacccacctttacaacccgtagaaccgtactaacgttcgttacgtttttattttcgaacgtagtaacggtccgttacgttcgtacgtagtaggtaggtaacttcgaacgtcggttcgggaacccgagggtaccctggtccctaccggtacctccgtacacccggtacctcccgaaaccgcgggtacccc

SEQ ID NO: 210349 - DNA, 539 bp, Homo sapiens
  misc_feature: GYAE6OF01AE9HA.7.78.H01.1.454.CMB.1.raw
  modified_base (493)..(493): a, c, t, g, unknown or other
  misc_feature (493)..(493): n is a, c, g, or t
  modified_base (512)..(512): a, c, t, g, unknown or other
  misc_feature (512)..(512): n is a, c, g, or t
  modified_base (526)..(526): a, c, t, g, unknown or other
  misc_feature (526)..(526): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcggtttgtcttctccatggatacctctgtcgggacgcttatctgcagataccaacttcaacctgacacactcgccgtttattttgtacgagacgtcgtcgtctgtcagtggattgactacgtgggccngggaccctggtcaccgtcncctcacgtcctccnccgaagggtcccc

SEQ ID NO: 210350 - DNA, 586 bp, Homo sapiens
  misc_feature: GYAE6OF01D8JVS.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacacggccctggacaacggccttgactacagtgggatggatcaacaccgacacgtcgggaaccccactatcgccacggccttcacgagggtcggtttgtccttctcctagtcggtacttaccgtcgtcgggtccgggacgtcttatctgcagtactaacctacttccaactgacactacgtgtcgttttatttgacgtagtagtcgtcgtcgtgtcagtagtattcgacttacgtcgggaccgtacgggtaccctggtccgtacccgtcctcccgtacacgtccctacccgaccggacggtccccg

SEQ ID NO: 210351 - DNA, 557 bp, Homo sapiens
  misc_feature: GYAE6OF01EU4QZ.7.78.H01.1.454.CMB.1.raw
  modified_base (461)..(461): a, c, t, g, unknown or other
  misc_feature (461)..(461): n is a, c, g, or t
  modified_base (472)..(472): a, c, t, g, unknown or other
  misc_feature (472)..(472): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatggggatggatcaacaccgacacgtgggaaccccactatgcccaggccttcacgagggtcggtttgtcttctcatggactacctcgtgtcgggacgtcttatctgcagactaaccaacttcaactgacgacactgtccttttatttgacgngagtcgtcgtntgtctagtgtattgactacgtggggcctacgggacccttggtccacccgtctacctcacgtccctacccgaccgaacgggtcccc

SEQ ID NO: 210352 - DNA, 728 bp, Homo sapiens
  misc_feature: GYAE6OF01BIJAM.7.78.H01.1.454.CMB.1.raw
  modified_base (244)..(244): a, c, t, g, unknown or other
  misc_feature (244)..(244): n is a, c, g, or t
  modified_base (700)..(700): a, c, t, g, unknown or other
  misc_feature (700)..(700): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtcgcccactcccaggtgcagctggtacagtctgggtctgaattgaggagccgtggggcgtcagtgagcgttgctgcaagtccttcnggatacatcttcacttacttattctgtctaagttggtccgacacggccctggacaaggcttgactacagtgggactggactacgaacgaccgacaccgtacgggaaccccactacgtacggcccgtacggtacccttacgaacggtacggggtccgttttcgtcgtttcctaccgagttcgggtaaccttaccgtcgttacgggttccgggggaaccgttcgtttaacgttccgtacgggacctaacggttaaacctaaccccgtaaaccgtttaccaaaccggttcgaacccggtaaacctaccgttaccggtttacccggttttttaagttttaccggtaacggtaagtcggttaccggttcgttaccgttcgtaccgtaggttacggtaattcggtaaccgtacggtcgggtacccgtacgggtaccctggtacccgcccgtactcccgtacnccgtccctaccgaacccgcgggtacccc

SEQ ID NO: 210353 - DNA, 558 bp, Homo sapiens
  misc_feature: GYAE6OF01ET8XX.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttatctgtcaattgggtccgacaggcccctggacaaggccttgactacatgggatggatcaacaccgacacgtgggaaccccacctatcgcccaggccttcacgagggtcgtttcgtcttctccatggatacctctgtcgggacgtcttatctgcagataaccaacttcaacctgacacactcgtccgttttatttgacgtagacgtcgtcgtctgtcaggtgaattgactacgtggggccgacgggaccctggtccacccgttcctcctcgacgtcccctccgaccgacgggtcccc

SEQ ID NO: 210354 - DNA, 640 bp, Homo sapiens
  misc_feature: GYAE6OF01D0DFC.7.78.H01.1.454.CMB.1.raw
  modified_base (622)..(622): a, c, t, g, unknown or other
  misc_feature (622)..(622): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacatcttcacttactttattctgtctaagttgggtccgacacggcccctaggacaacggtccttgacctacgagtgggatggatacaacaccgacacgtacgggaacccccactatcgacccaggccttacgacgtagggtcgtttcgtccttctccatcggtaacttcccgttcgtcgggtacggggtaccgtctttacgtcgtgactaagtaacctaaaccctaaccttacccaaccgtcgaacgacctacgttcgttaccgtttttagttttcgacgtagtacgtccgttacgtcttgtacgtagtggtaattcgtacgtacggtcgggaccgacgggtaccctggtccacccgtctccgtacacgtcccnccgaaccgtccggtaccc

SEQ ID NO: 210355 - DNA, 560 bp, Homo sapiens
  misc_feature: GYAE6OF01BXVK3.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacagtgggatggatcaacaccgacacgtcgggaaccccacctatcgcccaggcccttcactagggcgtttgtcttctccagtggatacctctggtcgggacggtcttactctgcagaactaaccaaccttcaacctgacgactactcgtcgttttattttgacgtagtagtcgtcgtccttgtctagtgaacttgacgtactggggccgagggtaccctggtccaccgtctcctcacgcctccacgacggtccc

SEQ ID NO: 210356 - DNA, 555 bp, Homo sapiens
  misc_feature: GYAE6OF01EMR4S.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacattcttcactacttattctgtcaattgggtccgacaggcccctggacaaggccttgactacatgggatggatcaacaccgacactgggaaccccactatcgcccaggcccttcacgtagggtcggttttcgtcttctcctagtcggattacccgtctggtcggggacggtcttatctgcagaactaaccacctttcaacctgacacactgtcgtttattttcgagagagtcgtgtctgtcagtggtaatgactcgtgggccagggtacctggtcaccgtctcctcacgccctccaccgaggtcccg

SEQ ID NO: 210357 - DNA, 585 bp, Homo sapiens
  misc_feature: GYAE6OF01BF1PZ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtctaattgggtccgacacggcccctggacaaggccttgactacatgggatggatcaacaccgacacgtcgggaaccccactatcgcccaggccttcacgagggtcgtttgtcttctccatggactacctctggtcggggacgtcttatctgcagactaaccaacttcaacctgacactactcgtcgttttatttgacgagacgtcgttcgtctgtctagtggtaattcgacttacgtggggccaggggtaccccttgggtcccacccggttcctcccgtacgaccgtccccttacccgaaccgtaacggggtccccc

SEQ ID NO: 210358 - DNA, 550 bp, Homo sapiens
  misc_feature: GYAE6OF01BSY6T.7.78.H01.1.454.CMB.1.raw
  modified_base (537)..(537): a, c, t, g, unknown or other
  misc_feature (537)..(537): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatcgcccaggccttcacgagggcgtttgtcttctccatggactacctctgtcgggacgcttatctgcagactaaccaaccttcaacctgaccgacactgtaccgttttattttgtacgagagcgtcgtctgtcagtgattgactacgtgggccgagggaaccctggtcacccgtctcctcacgccctaccnccgaaggtccccg

SEQ ID NO: 210359 - DNA, 612 bp, Homo sapiens
  misc_feature: GYAE6OF01DBF1J.7.78.H01.1.454.CMB.1.raw
  modified_base (403)..(403): a, c, t, g, unknown or other
  misc_feature (403)..(403): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaagttgggtccacacggccctggacaaggccttgactacagtgggatggatcaacaccgacacgtacgggaaccccacctatcgcccagtcccttcacgagggtcggttttgtcttctccatcggactccctntcggtcgggacgtcttagtctgacataactaaccaacctttacaactgacgacactcgttaccttttattttgacgagacgtccgttcgtcttgtacgtaggttaggtaattcgacgttaccggtagggcccggtaaacgggtaccccgttggtcccgacccgttcctacccgttcaaccgtcccttacccgaaccgaaccgggtcccc

SEQ ID NO: 210360 - DNA, 629 bp, Homo sapiens
  misc_feature: GYAE6OF01C3ZNQ.7.78.H01.1.454.CMB.1.raw
  modified_base (329)..(329): a, c, t, g, unknown or other
  misc_feature (329)..(329): n is a, c, g, or t
  modified_base (391)..(391): a, c, t, g, unknown or other
  misc_feature (391)..(391): n is a, c, g, or t
  modified_base (590)..(590): a, c, t, g, unknown or other
  misc_feature (590)..(590): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacatcttcactacttattctgtcaattgggtaccgacacggcccctaggacaaggccttgactacagtggatggatcaacnccgacacgtacgggaaccccactatcgacccaggccttacacgaggtcgtttgtccttctcngtggactacctcgtcggtcgggacgtcttagtcgtgacaagtaactaacctaaccttacaacctcgaaccgactaccttacgttacccgtttttattttcggtaacgtagtacggtccgttcgttcgtgtcgtaaggttcggtaagttcgaccgttacgtggggaccgtaacgggtacccgttggtacccgaccgttcncccgttaccgacgtacccctaccgaccgtacgggtcccc

SEQ ID NO: 210361 - DNA, 544 bp, Homo sapiens
  misc_feature: GYAE6OF01C060B.7.78.H01.1.454.CMB.1.raw
  modified_base (388)..(388): a, c, t, g, unknown or other
  misc_feature (388)..(388): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatggatggatcaacaccgacactgggaaccccactatgcccaggccttcacagggtcgtttgtctctccatggatacctntcgtcgggacgcttactctgcagataaccaaccttcaacctgacacactgtccgtttattttcgactagagtcgtcgtntgtacngtgattgactacgtggggaccagggaccctggtcaccgttctcctcacgccctccaccgtaacgggtcccc

SEQ ID NO: 210362 - DNA, 762 bp, Homo sapiens
  misc_feature: GYAE6OF01D0SSE.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacatcttcacttacttattctgtcaagttgggtccgacacggccctggacaggccttgactacatgggatggatcaacaccgacacgtcgggaaccccactactcgacccgacggtcccttacgacgtacggggtccggttttcgtcctttcctcctagtcgggtaacttacccgttcgtacgggttaccggggtacggttctttaacgtccgtaggtacctaacggtaaaccttaaacccgtaaaccctttacccgaaacccgttacggaacccgtaacccgtaacgttacggtttaccccgtttttttaagttttttacggaacggtaacggtacggtacccggtttccgttaccgttacggtttaccgtaagggttacgggttaaactttcgggtaaaccgttacgggtaccgggggtacccgtaaccggggtaaccccgttgggtccccgtaacccgttcccttaccgtccgacggttcccctaccccgtaacggaacccgggtaccccg

SEQ ID NO: 210363 - DNA, 578 bp, Homo sapiens
  misc_feature: GYAE6OF01EF9TB.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtcaattgggtccgacaggcccctggacaaggccttgactacatgggatggatcaacaccgacactcgggaaccccacctatcgcccaggccttcacgagggtcggtttgtcttctccatggactaccgtctggtcgggacgtcttatctgcagactaaccaccttcaacctgacgacactcgtccgttttattttgtacgagtagtcgttcgtcttgtcagtaggtaattgactacgtggggtcccgaacgggtaccctggtccgtacccgttcctacctcacgcccctacgacccgacgggtaccccg

SEQ ID NO: 210364 - DNA, 705 bp, Homo sapiens
  misc_feature: GYAE6OF01BO7KS.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacatcttcacttacttattctgtcaattgggtccacacggccctggacaacggtcttgactacagtgggatggatcaaacaccgacacgtcggaacccctactatcgacccaggtccttacgacgacgggtcgttttcgtcttctccgagtcggtactacccgtgtcgggtacgggacgtctttagtcgttcgactagaaacctaacccgtaaaccctttacgaacctacggaaccgacctaccgtttcggtacccgttttttagtttttacgggaacggtacgtaacgttccggttcgttccgttaggtaccgtaaggttacggtaagttcggtaacccgttacgggtccgggggtacccgtaaccgggggtaacccttcgggttcccgtaaccccggttcttaccccgtcgtaccccggtaccctttaccccggaaaccggtaccgggtaccccg

SEQ ID NO: 210365 - DNA, 555 bp, Homo sapiens
  misc_feature: GYAE6OF01EBY4E.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatcgcccaggccttcacagggcgtttgtcttctccatggactacctcgtcggtcgggacgtcttatctgcagactaaccaaccttcaacctgacacactcgtccgttttattttcgacgagtagtcgtcgtcttgtcagtgtaattgactacgtggggaccgagggtaccctggtccaccgtctccgtcacgccctccaccgacggcccg

SEQ ID NO: 210366 - DNA, 578 bp, Homo sapiens
  misc_feature: GYAE6OF01DIEDC.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttctggatacatcttcactacttattctgtcaatttgggtccacaggcccctggacaaggccttgactacatgggatggatcaacaccgacactgggaaccccactatcgcccaggccttcacagggcggttttgcttcgtccagttggacttacctcgtcgtcgggacgtcttatctgcagtactaaccaaccttcaacctgacgacactcgtcgtttattttgacgagtagcgtgtctgtcctaggtggtaattcgacgtaccggtggggaccgtaacggggtaaccctggtccaaccggtcctacctcgaacgtccctaccacccgtacgggtaccc

SEQ ID NO: 210367 - DNA, 600 bp, Homo sapiens
  misc_feature: GYAE6OF01AH5QU.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccacctatcgcccaggcccttcacagggtcggtttgtccttctccatcggactaccgtctcggtcgggacgtcttatctgcagtactaaccacttcaacctgacgacactgtcctttatttcgtacgagtacgtcgtcgtcgtgtcaggtggtaacttgaccttacggtcggggacccgtacggggtaaccccttgggtaccctacccggttcctcccgtacgaccgtaccctacccgaacccggtacgggtacccccg

SEQ ID NO: 210368 - DNA, 639 bp, Homo sapiens
  misc_feature: GYAE6OF01CI1CA.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggccctggacaaggccttgactacatgggatggatcaacaccgacactcgggaaccccacctatcgccccaggccttcgacgagggtcggtttgtccttctccagtcggacttacctcgtggttcggggacggttcttagtctcggacagaacttaacccaacctttaccaacctgacgaacctactcgttccgttttattttagacgtagacgtcgttccgttcgtcgtacgtaggtaggtaagttgtaccgtacggttcgggggaccctacgggggtaaccccttggggtacccctacccgggttctcccctacgtacccgacccgtacccaacccggtaaccgggtccccg

SEQ ID NO: 210369 - DNA, 553 bp, Homo sapiens
  misc_feature: GYAE6OF01E3WID.7.78.H01.1.454.CMB.1.raw
  modified_base (539)..(539): a, c, t, g, unknown or other
  misc_feature (539)..(539): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaaggccttgactacatgggatggatcaacaccgacacgtcgggaaccccacctatcgcccaggccttcacagggtcggtttgtcttctccatcggatacctcgtgtcgggacgtcttatctgcagtactaaccaacttcaacctgacgacactgtccttttattttgacgagagcgttcgtctgtctagtggtaattgactacgcgggccgacgggtaccctggtccaccgtctcctcacgcccnccaccgacggtccc

SEQ ID NO: 210370 - DNA, 591 bp, Homo sapiens
  misc_feature: GYAE6OF01A7OBQ.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtctaattgggtccacacggcccctggacaaggccttgactacatgggatggatccaacaccgacacgtacgggaaccccactatcgcccaggccttcgacggggtcgtttgtccttctccagtcggactaccgtcgtcggtcgggacgtcttatctgcagactaaccacttcaacctgacgacacgtcgtccgttttatttgacgtagtacgtcgttcgtctgtcagtggtaattgacttacggtcggggaccgacgggtaccctggtaccctaccggtcctccgtaccgtacgtccctacccgaccgtaacgggcccctacgg

SEQ ID NO: 210371 - DNA, 654 bp, Homo sapiens
  misc_feature: GYAE6OF01BNZ71.7.78.H01.1.454.CMB.1.raw
  modified_base (243)..(243): a, c, t, g, unknown or other
  misc_feature (243)..(243): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacattcttcacttacttattctgtcaagttgggtccacacggcccctggacaaggccttgactacagtgggatggatcaacaccgacacgtacgggaacccctactatcgcccaggccttcacggagggtcggtttgtccttctcctagtggtaactacctcgtcggtcgggtacggtctttacgtctcgactaacgtaactaaccctaacttacccaacgtcgaaccgtactaccgttgttaccgtttttagttttagtacgtaggtacgttcgttcgtacgttcgtactaggttaggtaagttcggtacgtacggttcgggggaccctacggggtaccccgtgggttcccacccgttcccgtacctccgaccgttacccgtacccgaaccggaaccggggtcccc

SEQ ID NO: 210372 - DNA, 629 bp, Homo sapiens
  misc_feature: GYAE6OF01B1TUD.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccactatcgcccacggccttcgacgacgggtcggtttcgtcttctccatggactacctctggtcgggtacggtcgttactctgcgacgactaacctaaccttacctaacctacgacgacactcgtccgttttacttttcgttacgtagtcgtaaaacgtcgtcgttcgtcgtaggtaggtaacgttagtacgtacgtacggggtaccggtacgggtaacccgttacggtccgtaccgttccgttcccgtccgtaccgtacccgtcccgacccgtaaccgggtaccccg

SEQ ID NO: 210373 - DNA, 592 bp, Homo sapiens
  misc_feature: GYAE6OF01D2FAL.7.78.H01.1.454.CMB.1.raw
  modified_base (565)..(565): a, c, t, g, unknown or other
  misc_feature (565)..(565): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggcccctggacaacggccttgactacagtgggatggatcaacaccgacacgtacgggaaccccacctatcgcccagccttcacgagggtcgtttgtcttctccagtcgactacctcgtggtcgggacgtcttatctgacagactaaccctaacctcaacctgaccactactcgtcttttagtttgacgagtacgtcgttcgtcgtgtctaggtgtattcgacgtacgtcggggccgtaacgggtaacccttgggtcccaccgttccgtccctccgtaacncccctaacccaccgaacgggtaccccg

SEQ ID NO: 210374 - DNA, 559 bp, Homo sapiens
  misc_feature: GYAE6OF01DTQIY.7.78.H01.1.454.CMB.1.raw
  modified_base (242)..(242): a, c, t, g, unknown or other
  misc_feature (242)..(242): n is a, c, g, or t
  modified_base (544)..(544): a, c, t, g, unknown or other
  misc_feature (544)..(544): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacatcttcactacttattctgtcaattggtccgacaggcccctggacaaggccttgactacatggatggatcaacaccgacactgggaaccccactatcgccaggccttcacagggcgtttgtcttctccatggatacctgtcgtcgggacgtcttatctgcagactaacctaacttccaacctgaccgactacgtgttccgttttattttcgtacgagtgtcgtcgtctgtcagtgattgactacgtgggccgacgggtaaccctggtccaccgttctaccctcgacgtccctaccncccgaagggtacccc

SEQ ID NO: 210375 - DNA, 654 bp, Homo sapiens
  misc_feature: GYAE6OF01CFVTH.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtctaattgggtccgacacggcccctggacaaggccttgactacatgggatggatcaacaccgacacgtcgggaaccccacctactcgcccaggccttcacgagggtcggttttgtcttcctccagttcgggacttacccgtcgtcggtccggggacggtcttatcgtgacagaactaaccaaccttcaaccgtgaaccgactacttcgtaccgttttattttcgtaacgtacgagtccgttacgttccttgttccgtaggttcggtaattcgtacgttaccggtgggggtacccgaacggggtaaccccttcgggtccctaacccgggttcctaccccgttaccgaccggtaccccttccccgaacccggtaaccggggtaccccc

SEQ ID NO: 210376 - DNA, 585 bp, Homo sapiens
  misc_feature: GYAE6OF01CBJWQ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacaccgtcgggaaccccacctatcgcccacggccttcacgagggtcggtttgtcttctccatcgatacctctcgtcgggacgtcttatctgcagactaaccaacttcaacctgacgactactgtccgtttttattttcgacgtagacgtcgtcgttctgtcaggttagacttgacgtcgtcggggacctagggtaccctgggtcctacccggtcttcccgtactacgaccccttaccgaacccgtaggggtaccccc

SEQ ID NO: 210377 - DNA, 767 bp, Homo sapiens
  misc_feature: GYAE6OF01DS0GT.7.78.H01.1.454.CMB.1.raw
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
tcagcgtgtctctacacgaccggtgctcgatttagtgtgagtagtttgggtttggggacccgaacaaccacacccctcctaagaagaagccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacntcttcactacttattctgtcaattcgggtccgacaggccctggacaaggtcctttgactacagtcgggatcggatacaaacgaccgaacacggtaccgggaaaccccctactatcggcccctaggtcccttacgaacgacggggttccggtttttcgtacctttcctaccagttggacttaccctcgttcgggtccggggtaccgttaccttttaagtccgttaggactaaacggtaaccttaaaacccgtaaccctttacccgaaccgttacggaaaccgtacccgtaaccgtttcggtttacccggttttttaagtttttacggtaacgaacgggtacgttccggtttccgtttacgtcggttacgtaagggttacggtaaagttttccggaaaccggtttaccgggttccgggggaacccgtaacggggtaaaccccgttgggtccccgaacccgtttccttacccgttaccgacgtcccccgtttaacccaaaccggtaaccggggtaccccc

SEQ ID NO: 210378 - DNA, 771 bp, Homo sapiens
  misc_feature: GYAE6OF01DKC7O.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggcccctggacaaggccttgactacatggatgatacaacaccgacacgtcggaaccccactatcgcccgaaggccttacgacgacggggtcgtttcgtccttcctcctagtcggtacttacctcgttaggtcggggaacggtctttagtcctaggtccaaagtaactaaaccctaacctttaccgaaccttcggaaccgtaccgaacgtttacgtttaccccggttttttaatttttcgggaaaccgtacggtaacgcccggttttcggtaccgttacggttaccgtaaagggtttagggtaaaacttttcggggtaaacccgtttaaccggttacgggggggtacccccgtaaaccgggggttaaaacccccgttccgggggtttaccctaaaccccggggtttcccctttacccccgggtttaacccacccggtaaccccccgtttacccgaaaacccccgtaaaaccccggggggttcccccc

SEQ ID NO: 210379 - DNA, 624 bp, Homo sapiens
  misc_feature: GYAE6OF01CKS8J.7.78.H01.1.454.CMB.1.raw
  modified_base (243)..(243): a, c, t, g, unknown or other
  misc_feature (243)..(243): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggaagccgtggggcgtcagtgagcgttgcctgcaagccttcnggatacatcttcacttacttattctgtctaattgggtccgacgacggcccctggacaaggccttgactacagtgggatggactcaacaccgacacgtacgggaaccccactactcgcccaaggtccttacacgaggggtcgtttagtcttctccaatcggtactaccgtcgtcggtcggggacgtcttatcgtgacgaagtaacttaacccgaacctttcaaaccgttgaacgtaccgtacttacggttaccgttttttattttaggaccgaagtacgtccgttcgtctacgtcaaggtggtaaattgacgttacgtcgggcctaagggaaccctggtaccaccggtctcctacgacgccctaccaccggtaacggtcccg

SEQ ID NO: 210380 - DNA, 561 bp, Homo sapiens
  misc_feature: GYAE6OF01AO556.7.78.H01.1.454.CMB.1.raw
  modified_base (242)..(242): a, c, t, g, unknown or other
  misc_feature (242)..(242): n is a, c, g, or t
  modified_base (325)..(325): a, c, t, g, unknown or other
  misc_feature (325)..(325): n is a, c, g, or t
  modified_base (441)..(441): a, c, t, g, unknown or other
  misc_feature (441)..(441): n is a, c, g, or t
  modified_base (463)..(463): a, c, t, g, unknown or other
  misc_feature (463)..(463): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttntggatacatcttcactacttattctgtcaattgggtccgacaggcccctggacaaggccttgactacatgggatggatcaacnccgacactgggaaccccactatcgcccaggccttacacagggcgtttgtcttctccatggactaccgtctggtcgggacgtcttatctgcagactaaccaccttcaacctgaaccncactcgtccttttatttgacgngagtcgtcgtctgtcagtgaattgacgtcgtgggccagggtaccctgggtcctacccggtcctcccgtcaccgccctacccgaccgtaacggggcccc

SEQ ID NO: 210381 - DNA, 542 bp, Homo sapiens
  misc_feature: GYAE6OF01BCQO3.7.78.H01.1.454.CMB.1.raw
  modified_base (390)..(390): a, c, t, g, unknown or other
  misc_feature (390)..(390): n is a, c, g, or t
  modified_base (458)..(458): a, c, t, g, unknown or other
  misc_feature (458)..(458): n is a, c, g, or t
  modified_base (516)..(516): a, c, t, g, unknown or other
  misc_feature (516)..(516): n is a, c, g, or t
  modified_base (530)..(530): a, c, t, g, unknown or other
  misc_feature (530)..(530): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacacgtgggaaccccactatcgccaggccttcacaggcgtttgtcttctccatggatacctntggtcgggacgcttatctgcagataaccaccttcaacctgacgacactgccgttttattttcgaacgngtagcgtcgtctgtcaagtgaattgactcgtgggccaggtaccctggtcaccggttcncctcacgcctaccnccgaagggcccc

SEQ ID NO: 210382 - DNA, 604 bp, Homo sapiens
  misc_feature: GYAE6OF01EFHLQ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaagggccttgactacatggggatggatcaacaccgacactgggaaccccacctatcgcccaggccctttacacgacggggtccggttttcgtcgtttcctccatcgggatacctctggtcggggacggtcttatctgcagactaacctaaccttcaaccttgacgaccactcgtaccgttttattttgacgtagagccgttcgtctggtctaggtaggtaattggaccttacgtcggggaccacggggtaacccctgggtcccaccgttcctacccgtcacgcccctaccgacccgaacgggtaccccg

SEQ ID NO: 210383 - DNA, 579 bp, Homo sapiens
  misc_feature: GYAE6OF01BFCV4.7.78.H01.1.454.CMB.1.raw
  modified_base (356)..(356): a, c, t, g, unknown or other
  misc_feature (356)..(356): n is a, c, g, or t
  modified_base (516)..(516): a, c, t, g, unknown or other
  misc_feature (516)..(516): n is a, c, g, or t
  modified_base (529)..(529): a, c, t, g, unknown or other
  misc_feature (529)..(529): n is a, c, g, or t
  modified_base (560)..(560): a, c, t, g, unknown or other
  misc_feature (560)..(560): n is a, c, g, or t
  modified_base (566)..(566): a, c, t, g, unknown or other
  misc_feature (566)..(566): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcagtgagcgttgcctgcaagccttctggatacatcttcacttacttattctgtcaattcgggtccgacacggcccctggacaaggccttgactacagtgggatggatacaacaccgacacgtacgggaaccccacctancgacccaggccttcacgagggtcgtttgtcttctccagtggacttacctcgtcggtcggggacggtcttactcgtgctagaactaaccctaaccttccaaccgtcgaaccgactacttcgttaccgttttattttcgacgtagtacgcgtcgtctgtacngtgtatgactcgnggaccgacgggtacctggtccacgtctctcncgaccnccacgcggtcccg

SEQ ID NO: 210384 - DNA, 604 bp, Homo sapiens
  misc_feature: GYAE6OF01DWIAF.7.78.H01.1.454.CMB.1.raw
  modified_base (410)..(410): a, c, t, g, unknown or other
  misc_feature (410)..(410): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggcccctggacaaggccttgactacagtgggatggatcaacaccgacacgtacgggaaccccacctatcgacccacggccttcgacgacggggtcggttttgtccttctccatcggactaccgtntggtcgggacggtcttatctgctaagactaaccctaaccttaccaacctgaacactactgtccgttttattttcgacgtagacgtcgtcgttcgtcgtcgtagtagtacttgacgttacgtggggaccgtacggtacccgttggcctacccggtcttcccgtctaccgaccctacccgacccgacgggtacccc

SEQ ID NO: 210385 - DNA, 566 bp, Homo sapiens
  misc_feature: GYAE6OF01CJ9TH.7.78.H01.1.454.CMB.1.raw
  modified_base (349)..(349): a, c, t, g, unknown or other
  misc_feature (349)..(349): n is a, c, g, or t
  modified_base (552)..(552): a, c, t, g, unknown or other
  misc_feature (552)..(552): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccacctangcccaggccttcacagggcgtttgtcttctccatggatacctctgtcgggacgtcttagtctgcagactaaccaaccttcaacctgaccacactgtcgtttattttgacgtagtagcggtcgtctgtcgtagtggtaattgactacgtggggtaccgacgggtaccctgggtccacccgttctcccgtcgactcccgtacccncggaacgggtcccc

SEQ ID NO: 210386 - DNA, 611 bp, Homo sapiens
  misc_feature: GYAE6OF01A03AO.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcacttacttattctgtcaattgggtccgacacggccctggacaaggccttgactacagtgggatggatacaacaccgacacgtacggaaccccactatcgccacggccttacacgtaggtcgtttcgtcttctcatcggactaccgtcgtcggtcgggtacgtcttatcgtgcaagtactaaccaaccttacaacctgaacctactacgttcgtaccgttttatttacggtacgtacgtacgtcgttcgtcgttgtacgtagtacgtattcgtacgtacggtcgggaccgtacgggtacccttggtccctaccgtcctccgtaccgaccgtcccgtaccctaccggtacgggtacccc

SEQ ID NO: 210387 - DNA, 685 bp, Homo sapiens
  misc_feature: GYAE6OF01A2U5S.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacattcttcacttacttattctgtcaattgggtccgacaggcccctggacaaggccttgactacatgggatggatcaacaccgacactcgggaaccccactatcgccaggccttcacgacgggtcggtttcgtcttctccagtggactaccctcgtcggtccggggacgtctttacgtcgttgactaagtaacttaaccctaacctttaccaacccttggaaccgtacctaccgttcgttaccgtttttaatttttacggtaacgaagtacggttccgttacggttccgttggttacctaagggttacggtaaacgtttcggtaacgttaccggtcggggggtaacccgtacgggggtaacccccgttgggttacccctaccggttcccttcccgttacgaccggtaccccttacccgaacccgaaccggggtcccccg

SEQ ID NO: 210388 - DNA, 616 bp, Homo sapiens
  misc_feature: GYAE6OF01A9YIL.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagtccttcgtggatacatcttcacttacttattctgtctaattcgggtccgacgacggcccctggacaacggccttgactacgagtgggatggatcaacaccgacacgtacgggaaccccactatcgccgaggtcctcgacggggtcgtttcgtcttctcagtcggactacctcgtggtcgggacgtcttatcgtgactaagtactaacctaccttacaacctcgaccgtactacgttcgtacgttttatttagacgagtcgtcgtcgtctgtctaggtgtaattcgacgttacggtcgggaccgtaacgggtacccgttggtacctaccgtcctccgtaccgtaccgtccctacccgaccgtaaccggtcccgtaccgg

SEQ ID NO: 210389 - DNA, 697 bp, Homo sapiens
  misc_feature: GYAE6OF01EBOMA.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcagtgagcgttgcctgacaagtccttctggatacatcttcacttacttattctgtactaagttcgggtccgacgacggccccgtaggacctaaggtccttagacctacgagtgggatggactaccaacgaccgacaccgtacgggaaccccctacgtacgtcgacccgacggtcccttacgaccggtacgggttccggttttcgtcctttcgtaccgtagtcggtaacttaccgtcgtacgggtccgggtacgtctttagtccgtgactagtaactaaccctaccttaccgaacctcgaacctacgtacgttcgttacgtttttatttcggacgtagtacgtccgttcgttacgtgtacgtaggttacggtaattacggacgttacggtaccggggaccgtaaaccggggtcccttcgggtaccctacccggttccttacccgtacgacccgtacccctacgaacccggcgggtacccccg

SEQ ID NO: 210390 - DNA, 593 bp, Homo sapiens
  misc_feature: GYAE6OF01EA3KI.7.78.H01.1.454.CMB.1.raw
  modified_base (506)..(506): a, c, t, g, unknown or other
  misc_feature (506)..(506): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacagcccctggacaaggccttgactacatggggatggatcaacaccgacactgggaaccccactatcgcccaggccttcacgacgggtcggtttgtccttctccatcggattaccgtctggtacgggacggtctttactctgctagactaacctaaccttcaacctgaacgactactcgtcgttttattttgacgtagtacgtcgtacgtcttgtctagtgaagttnacgttaacggtggggacccgtaaggggaacccttgggtcctacccgttctccctcgacgtccccgtacccaaccgtaacgggacccc

SEQ ID NO: 210391 - DNA, 577 bp, Homo sapiens
  misc_feature: GYAE6OF01BWTXA.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccacctatcgcccaggccttcacgagggtcgtttgtcttctccatggatacctctgtcgggacgtcttatctgcagactaaccaaccttccaacctgacgacactgtccgttttattttgacgagtagtcgtcgtctgtcaggtcgtaattcgacttacgtcggggaccacggggtacccctgggtccacccggtcctccctcgaccgacccttcccgaacccgtaacgggtcccc

SEQ ID NO: 210392 - DNA, 743 bp, Homo sapiens
  misc_feature: GYAE6OF01CX2LJ.7.78.H01.1.454.CMB.1.raw
tcagcgtgtctctacacgaccggtgctcgatttagtgtgagtagtttgggtttggggacccaacaaccacacccctcctaagaagaagccctagaccacagctccacaccatggactggacctggaggatcctcttcttggtggcagtagcaacaggtgcccactcccaggtgcagctggtacagtctgggtctgaattgaggagccgtggggcgtcagtgagcgttgcctgcaagccttctggatacatcttcactacttattctgtctaagttcgggtaccgacacggcccctaggaccaaggtccttacgactacagtgggatggatacaaccaccgacacgtcgggaaaccccactactcgcccaggtccttacgacgggggtcgtttcgtccttcgtcctaagtacggacttacccgtcgttcgggtaccgggtaaccggtcttactcgttacggactaacggtaacttaaaacccgtaaccctttaccaaaaccgttcgaacccggtaacaccgtttcgtttaccgtttttagtttttaggtaaccgtaggtaacgtccggttcgttccgttacggtacgttaaggttacggtaacttacgggtaacgttaccggtccggggggtaccctaaacggggggtaaaccccgttgggttaacccgtacccggttcccgttcccttacccgaaccgggtccctaaccccgaacccggtaaaccggggtcccctaacccggg

SEQ ID NO: 210393 - DNA, 594 bp, Homo sapiens
  misc_feature: GYAE6OF01C23CT.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactccaggtgcagctggtacagtctgggtctgaattgaggaagcctggggctcagtgagcgttgcctgcaagccttctggatacatcttcactacttattctgtcaattgggtccgacacggcccctggacaaggccttgactacatgggatggatcaacaccgacactcgggaaccccactatcgcccaggtccttcacgagggtcgtttgtcttctcctatcggacttaccctcgttggtccggggacggtcttaagtctgacaagtactaacccaacttcaacctgacgacactcgtaccgttttatttcgacgtgacgtcgttacgtctggtacagttggaaattcgacgtacgtcggggaccacgggtaaccctggtccaccgttcctacccttcgaacgccccttaacccacccggcgggtacccc

SEQ ID NO: 210394 - DNA, 619 bp, Homo sapiens
  misc_feature: GYAE6OF01D9U6D.7.78.H01.1.454.CMB.1.raw
  modified_base (538)..(538): a, c, t, g, unknown or other
  misc_feature (538)..(538): n is a, c, g, or t
tcagcgtgtctctacacgaccggtgctcgatttagtgtgagtagtttgggtttggggacccaacaaccacacccctcctaagaagaagcccctagaccacagctacacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtctaattgggtccgacacggcccctggacaaggccttgactacatgggatggatcaacaccgacacgtcgggaaccccactatcgcccaggccttcacgacgggtcgtttgtcttctcctagtggactacctctggtcgggacgtcttatcgtgctagactaaccctaacttaccaacctgaacgactacttcgttccgtttttattttcgaacgtagtacgtccgttacgttcgttcgtacaggttaggtaattacgacgttaccggnggggtacccgacggggtaaccctgggtcctacccggttcctcccgtcgacgtcccctacccgacccggtaaccggtccccg

SEQ ID NO: 210395 - DNA, 708 bp, Homo sapiens
  misc_feature: GYAE6OF01CK2UM.7.78.H01.1.454.CMB.1.raw
  modified_base (325)..(325): a, c, t, g, unknown or other
  misc_feature (325)..(325): n is a, c, g, or t
tcagcgtgtctctacacgaccggtgctcgatttagtgtgagtagtttgggtttggggaccaacaaccacaccctcctaagaagaagccctagaccacagctccacaccatggactggacctggaggatccttcttcttggtggcagtagcaacaggtgcccactcccaggtgcagctggtacagtctgggtctgaattggaggaagccgtggggcgtcgagtgagtcgttgcctgcaagccttcgtggacttacatcttacacttacttacttctgtactaagttcgggtccacgacggtccctaggacacggtctagactacgngtggactgactacaacaccgacgtacgtaccgggaaacccctacgtacgtcgacctacggtcccttacgacggtacgggtcggttttcgtaccgttctacccgtagtcggtaactaccgtacgtcgggtaccgggacgttctttaacgcgtacgtacgtaataaccgttaacctaaccgttactaacccgtgaaccgtacctacgttagtttacccgtttttagtttacgtaacggtagtaccgttcggttactacggttacgtaccgtaggtaagttaacgttacggaccggttacggtacgggaccgtaacggggtaccctgggttaccctacccgtcctaccgtacccgacgtacccctacgaacccggacggttccccg

SEQ ID NO: 210396 - DNA, 675 bp, Homo sapiens
  misc_feature: GYAE6OF01BER43.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacatcttcacttacttattctgtactaagttcgggtccgacacggcccctggaccgaaggtccttagactacagtgggatggataccaacgaccgacacgtacgggaaccccacctatcgacccgacggtccttcgacgtacgggtcgtttcgtcttctcctagtcggtactccgtcgtcggtacgggtacgtcttactcgtgactaagtaactaacccgtaaccttaccaaccgtagtaaccgtactacgttcgttaccgtttttagttttacgaacgtagtacgtccgttcgttcgttgttcgtaggttacggtaattcggtaaccgttacggtaccggggtaccgtaacggggtacccttcgggtccctaccggttcctacccgtaccgccgtacccctacccgtaaacccgacgggtacccccg

SEQ ID NO: 210397 - DNA, 699 bp, Homo sapiens
  misc_feature: GYAE6OF01C1LDC.7.78.H01.1.454.CMB.1.raw
  modified_base (245)..(245): a, c, t, g, unknown or other
  misc_feature (245)..(245): n is a, c, g, or t
  modified_base (377)..(377): a, c, t, g, unknown or other
  misc_feature (377)..(377): n is a, c, g, or t
tcagcgtgtctctacacgaccggtgctcgatttagtgtgagtagtttggggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattggaggagccgtggggcgtcagtgagcgttgcctgcaagccttcgnggatacatcttcacttacttattctgtactaagttcgggtaccgacgacggtccccgtaggaccgaacggtcctttagaactacgagtgggatggactacaacaccgacacgtaccggaaccccacgttacncgaccgacggtccttacgggaccggggttcggtttcgttccttctaccgtagtacggtacttaccgtcgtcggtcgggtaccgttcttacgtcgtagacgtaagtaaccgtaaaccctaaccgttaccaacgttacgaaccgtacctacggttcgtttaccgtttttaagtttacggtaacgtacggtacgtccgttacgttacgtgtaccgtaggttacggtaattcggacgttacggtccggggaccgtaacggggtacccttggaccctccgtcctaccgtacgaccgtacccaccgacccggaaccggtccctaccgg

SEQ ID NO: 210398 - DNA, 563 bp, Homo sapiens
  misc_feature: GYAE6OF01A1P70.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatcgcccaggccttcacagggcgtttgtcttctccatggatacctctggtcgggacgcttatctgcagactaaccaacttcaacctgacgactactcgtccgtttattttcgtacgagtagtcgtcgttcgtcgtctagtggaattgacgtacgtcggggccgtacgggaccctgggtccaccgtctcccgtacacgccctccaccgacgggtacccc

SEQ ID NO: 210399 - DNA, 774 bp, Homo sapiens
  misc_feature: GYAE6OF01E53IP.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcgagtgagcgttgcctgcaagtccttgtggatacattcttactacttacttatctagtctaagttcgggtaccgacgaccggcccctaggaaccaaggtccttagactacgagtggatggactaccaaccgaccgacgaccgtaccggaacccctacgtacgccgacccgtacggtccctacgacggtacgggttcgttttcgtccttacgtaccgtagtacgtacttaccgtcggtcgggtaccgggtacgttcttacgccgtacgacgtaaacgtaaaccctaacccgtacttaaccgaccgttacgaaccgttaccgttaccggttttaccgtttaccggtttttttaagttaccggaacggtaggttaccggttccgtttccggtttacgttacgggttacgttaaggttacggttaacgttccggtaaccgttaccggggacccggggtaacccgtaacccgggttaccccgtaccggttccccgtacccgttccctacccgtaccgtaccccgaaccccgttaccccgaacccgggtacccggttccccccg

SEQ ID NO: 210400 - DNA, 643 bp, Homo sapiens
  misc_feature: GYAE6OF01C634H.7.78.H01.1.454.CMB.1.raw
  modified_base (269)..(269): a, c, t, g, unknown or other
  misc_feature (269)..(269): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgctgcaagccttctggatacatcttcacttacttattctntctaagttcgggtccgtacacggcccgtaggacgacggtcttacgactacgagtgggataggactacaaccaaccgacaccgtacgggaacccccactacgtacgcccgacggtccttacgacgacgggtacggttttcgtcttctacctagtcggtactcctcgtcggtcggggacggtcttagtctgtcaagtactaaccctaaccttacgaacctgaaccgactacgttcgttacttttagttttacggaacgtagtacgtccgttcggttacttgtacgtaggtggtaattgaccgtacggtgggaccgtacgggaaccttgggtcctaccgtcttaccgccgacgccctaccgccggtaacggtccccg

SEQ ID NO: 210401 - DNA, 592 bp, Homo sapiens
  misc_feature: GYAE6OF01BNOKL.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacagtggggatggatcaacaccgacacgtcgggaaccccactatcgcccaggccttcacgagggtcggtttgtcttctccagtcggactacctcgtcggtcgggacgtcttatctgcagaactaaccctaaccttacaacctgaccacactcgttccgttttattttcgtacgagtacgtcgtcgtctgtctaggtgaattcgacttacggtcggggtaccgacgggtaacccgtgggtccacccgtcctaccgtcgacgtaccctcccaacccgacgggtacccc

SEQ ID NO: 210402 - DNA, 741 bp, Homo sapiens
  misc_feature: GYAE6OF01DG42E.7.78.H01.1.454.CMB.1.raw
  modified_base (256)..(256): a, c, t, g, unknown or other
  misc_feature (256)..(256): n is a, c, g, or t
tcagcgtgtctctacacgaccggtgctcgatttagtgtgagtagtttgggtttggggacccaacaacaacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacatcttnactacttatctgtcaagttcgggtccgtacgacggcccctaggtaccaacggtccttcggactaacgagttcgggatggactaccgaaacgaccgtaacgaccgtcggggaaacccccaacttaacgtcgacccctacgggtaccctttcgaaccgtacgggtccggttttagtcctttacctccgagttcgggaacttacccgttcgttcggtaccggggacggtaccgttaagttccgtacggtaccgtaaacgtaaccgttaaaccctaaaccgtttaccgaaccgttcgaaccggtacccaacttcggtttaccgttttaattttcggtaacgacggtacgtccgtcgttacgtgtacgtacggttaggaacttcggacgttaccggtacggggaccccgtaagggtaaccccgttggtaccgtacccgttacctacccgttcgaacggtcccctaaccggacccgtaacgggtacccccg

SEQ ID NO: 210403 - DNA, 819 bp, Homo sapiens
  misc_feature: GYAE6OF01ACURO.7.78.H01.1.454.CMB.1.raw
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
tcagcgtgtctctacacgaccggtgctcgatttagtgtgagtagtttgggtttggggacccaacaaccacacccctcctaagaagaagccctagaccacagctccacaccatggactggacctggaggatcctcttcttggtggcagtagcaacaggtgcccactcccaggtgcagctggtacagtctgggtctgaattgagaagcctggggctcagtgagcgttgcctgcaagccttnggatacnttcttnacttacttattctgtcaattgggtccgacacggcccctggacaaggccttgactacagtcggatggatcaactccgactacgtacgggaaccccactacgtcgccccgaggtcccttaccgacgtacgggtccgggttttacgtcctttccgtacctaacggtcggtaactaccgttaccgtcgggttaccgggggtaccggttacttaacggttccgtcggtaccgtaaccggtaacgttaaacccgtaaccccttaaccgaaaccccgtttacggaaccgtaaccccgtaacgttaccggtttaccccgttttttaagtttttaccgggaaccggttaccggtaacggttccggttaccggtttccgttacggttccgtaaacgggtttacgggtaaactttccgggtaacgtttaccgggtaacccgggggggttacctaaacccgggggtaaccccgtttagggtacccccgttaaaccccgggtttcccgttaacccccggtacgttaacccgggtaacccccctttcccggaaacccggtaacccccggggttaaccccgg

SEQ ID NO: 210404 - DNA, 580 bp, Homo sapiens
  misc_feature: GYAE6OF01CD7V3.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggcctgactacatgggatggatcaacaccgacactgggaaccccacctatcgcccaggccttcacagggcggtttgtcttctccatggatacctcgtgtcgggacggtcttatctgcagactaaccaaccttcaacctgaccgacactcgtccgttttatttttcgtacgtagtagtccgtcgtcgtgttcagtgtaattgacttcgtggggccgaacgggtaccctggtaccacccggttcctcccgttccacgaccctcccgaaccgaaccgggtaccccg

SEQ ID NO: 210405 - DNA, 642 bp, Homo sapiens
  misc_feature: GYAE6OF01BWUMO.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcagtgagcgttgcctgcaagtccttctggatacatcttcacttacttattctgtctaagttgggtccacgacggcccctaggacaaggtcctttgaactacagtgggatggataccaacaccgacacgtaccgggaaccccactactcgacccaggtccccgttacgacgggggtcgtttcgtccgttcctccgtagtcgacttaccgttcgtcggtcgggacgtcttatctgcaagactaacctacctacaacgtacgacactacgtcgttccgttttagtttcgacgtagtcgtccgttcgtcgtcgtacgtaggttagtaagttcgacgttacggtacggggtaccgtaacggggtacctcgggtacctacccgttcctcccgtacgaccgtccctaacccgaccggtaccggcccttaccgg

SEQ ID NO: 210406 - DNA, 715 bp, Homo sapiens
  misc_feature: GYAE6OF01BYPCR.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggagtatcctcttcttggtggcagtagcaacaggtgcccactcccaggtgcagctggtacagtctgggtctgaattgaggaagccgtggggcgtcagtgagcgttgcctgcaagccttctggatacatcttctactacttattctgtctaagttgggtccgacaacggccctaggacaaggtccttagactacagtggatggatacaacaccgacaccgtacgggaaccccaacctactcgcccgaggccttacaacgacgggtcggtttcggtccttctccagtggacttaccgtcgtcgtcggggaacgtcttatcgtcggcaagtaactaaacctaacctttacgaacccttggaaccgtaactaccgttacggttaccgttttttaagttttacggtaacgtaagtacgggttccgttacgggttcttacgggttctaacggttacgggtaatttacggaaaccgttaccgggtacgggggtacccgtaaaccggggttaacccgttacgggtaccccgtacccggttccttacccgtaccgtaacggtaccccctttacccgaaacccggtaaccggggtaccccc

SEQ ID NO: 210407 - DNA, 739 bp, Homo sapiens
  misc_feature: GYAE6OF01CTH84.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctagaattggaggaagccgtggggcgtcagtgagtcgttgcctgacaagtccttcgtggatacattcttcacttacttattctgtctaagttcgggtaccgacgaccggtccccgtaggaaccgaacggtccttacggaacctacgtagttagggtaagttcggaactaccgaaaccgaaccgaactaacccgtaccgggaaacccccaacgtacgtaccgccccgtaacggtacccttacgaaccggtacgggttccggttttcgtaccttccgtaccgtagtacgtaacctacccgttcgtacggtacggggtaccgtctttacgtcgtgactaagtaacctaaacctaccgttacaacctcgaaccgtacgtacgttcgttacccgttttatttacggagtaacgacgttccggtcgtcgttagtacgtaggtagtaacgttacgtacgtacgggtcgggtaaccgaaccgggtacccggttggtcccgttaacccgttcctaccgtcctaccgtaccccgtacccaaccggacggtacccccg

SEQ ID NO: 210408 - DNA, 733 bp, Homo sapiens
  misc_feature: GYAE6OF01C0GLY.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgagagccgtggggcgtcagtgagcgttgcctgcaagtccttcgtggatacatcttcacttacttattctgtacaagttcgggtaccgacgacggtccccgtaggaaccgaacggtccttagaacctacgacgtgggatgactacaacaccgacacgtacggaccccactactcgccgtacggtccttacgacggtacgggttcggttttacgtcctttcgtacccgtagttcggtaacctaccgttcggttaccgggtaccggggttaccggtctttaacgtccgtacgtacctaacggttaaaccttaaaccccgttaaccctttaccgaacccctaggaacccgtaacgtaccgtttaccggtttacgtttttaacgttttcggaaccggtagtaccgttcgttcgtcgtaggtacgtagttacgtatacgtaccggtcggtacgggaccgtacgggtacccgttcggtcccgttaccgtcccgttaccgacctacccggaccccttaccggaacccgtccgggttaccccg

SEQ ID NO: 210409 - DNA, 750 bp, Homo sapiens
  misc_feature: GYAE6OF01EMDTM.7.78.H01.1.454.CMB.1.raw
  modified_base (243)..(243): a, c, t, g, unknown or other
  misc_feature (243)..(243): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagtccttcnggatacatcttcacttacttattctgtctaagttggtccgacgacggccctaggacaacggtccttgactacagtgggatggatacaacaccgacacgtacgggaaaccccactacgtcgcccgaaggtccttacaacggtacgggtcggttttcgtccttacctccgtagtcggtaactaccgttcgtcggttacgggacgtactttagtcgtcgacgtaagtaacctaaacctaacctttaccgaacctggaaccgtaaccgtaccgttacggttacctttttaagtttacgacggtacggtaacggtcccggttccggttattacgggttaccgtaagggtttacggtaaacgtttacggtaacccgtttaccgggtacgggggtaccccgggtaaacggggttaacccccgtttcgggtaccccgttaacccgttccccgtacccggttacccgaccggttacccccttaacccggaaaccccgtaaccgggggtaacccccc

SEQ ID NO: 210410 - DNA, 549 bp, Homo sapiens
  misc_feature: GYAE6OF01D4YII.7.78.H01.1.454.CMB.1.raw
  modified_base (539)..(539): a, c, t, g, unknown or other
  misc_feature (539)..(539): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatggggatggatcaacaccgacactgggaaccccacctatcgcccaggccttcacagggcgtttgtcttctccatggactacctctgtcgggacggtcttatctgcagtactaaccaaccttcaacctgaccacacttcgccgttttattttgtacgagtagtcgtcgtctgtcagtgattgactacgtgggccgagggtaccctggtcctacgtctcctcagccctccnccgacggccc

SEQ ID NO: 210411 - DNA, 582 bp, Homo sapiens
  misc_feature: GYAE6OF01A1W4M.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtcaattgggtccgacaggcccctggacaaggccttgactacatgggatggatcaacaccgacactcgggaaccccactatcgcccaggccttcacagggcgtttgtcttctcatggatacctctgtcgggacgcttatctgcagactaacaaccttcaacctgactacactcgtaccgtttattttcgtacgtagacgcgttcgttctgtctagtaggtaacttgaccgttacgtcgggggaccgtaacgggtaaccccgtggtcccacccgttcctcctacgacgtccctacccaacccggaacgggtaccc

SEQ ID NO: 210412 - DNA, 714 bp, Homo sapiens
  misc_feature: GYAE6OF01C9D0O.7.78.H01.1.454.CMB.1.raw
tcagcgtgtctctacacgaccggtgctcgatttagtgtgagtagtttgggtttggggacccaacaaccacacccctcctaagaagaagccctagaccacagctccacaccatggactggacctggagatcctcttcttggtggcagtagcaacaggtgcccactcccaggtgcagctggtacagtctgggtctgaattgaggagcctggggcgtcaggtgagcgttgcctgcaagccttctggatacattcttacacttacttattctgtctaattgggtccacacggcccctaggacaacggcctttaggactacgagtgggatggatacgaacaccgacacgtacgggaacccctactacgtcgcccaaggccttcgacgtaggggtccgttttagtccttctaccgagttacgggacttaacccgttcgtacggttaccggggtacgtactttacgctacggacctaacgtaaactaacccgtaaccgtttccaaacccgttgaaacccgtactaccgtttacggttccgtttttaacttttcggaacggtaaggtacgtaccggtttcggtacttacggttacgaagtttgggaaactttggaccgttaccgacggggggtacccaacggggtaaccccttcggggttaccacccggttcgtaccccgtcgaaccgtaccccgttacccggaaacccgtggggtaccccc

SEQ ID NO: 210413 - DNA, 697 bp, Homo sapiens
  misc_feature: GYAE6OF01BL1PW.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggctcagtgagcgttgcctgcaagccttcgtggatacatcttcactacttagttctgtctaagttgggtccgacgacggccccgtaggacaacggtccttgactacagtgggatggactacaacaccgacacgtacgggaaccccactatcgaccgaggtccttcggacggggtcgtttcgtcttcctaccgtagtcggtacttacccgttcgtcgggtccgggtacggtctttacgtcgtcgaccgtaagtaacctaaacccgtaacctttaccgaaaccgtcgaaccgtacctacgtttacggttaccgtttttaagtttttacggaaccgtacggtacgtcgttaccgtcttacggtaccgtagggttacggtaattcggtaacgttacggtccggggaccgtaccgggtacccgttggtacccgtaccgttcccttaccgtcgtaccgtcccgtaaccgaccggtacccggcccgttaaccgg

SEQ ID NO: 210414 - DNA, 584 bp, Homo sapiens
  misc_feature: GYAE6OF01BQBYW.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggtccttgactacagtgggatggatcaacaccgacacgtcgggaaccccactatcgccaggccttcacgagggtcgtttgtccttctcctatcggactacctcgtggtccgggacgtcttatcgtagcagtactaacccaaccttcaacctgaccgactacgtcgtaccgttttatttcgtacgagtacgtcgtcgtctgtcgtagtggaattgacttacggtcggggaccagggtaccctggtccaccgttctcccgtcacggtaccctccgaaccgacggtcccc

SEQ ID NO: 210415 - DNA, 628 bp, Homo sapiens
  misc_feature: GYAE6OF01D1GI6.7.78.H01.1.454.CMB.1.raw
  modified_base (387)..(387): a, c, t, g, unknown or other
  misc_feature (387)..(387): n is a, c, g, or t
  modified_base (415)..(415): a, c, t, g, unknown or other
  misc_feature (415)..(415): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactacgggaaccccactatgcccaggcccttcacagggcgtttgtcttctccatggntacctctgtcgggacgtcttatctgcanataaccacttcaacctgactacacttgtccgttttattttcgacgtagacgtcggttcgttcgttacgttccgtaggttaggtaaagttttcggaaccgttaccgttaggggggtaccccgtaacgggggtaacccccttggggttaccctacccgggttccttcccgtacctacgtacccctaccccgtaacccgtaacggggtaccccccg

SEQ ID NO: 210416 - DNA, 891 bp, Homo sapiens
  misc_feature: GYAE6OF01CLGX9.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggaagccgtggggcgtcagtgagcgttgcctgcaagccttcgtggatacatcttcacttacttattctgtactaagttgggtccgaacacggcccctaggaacaacggccttagactacagtgggatggatacaacaccgacgaccgtacgggaacccctactactcgacccaggcccttcgacgtacgggtccggtttgtccttcctccgtagtacggtacttacccgttcgtcgggtcggggtaccggtactttaacgtccgttaggacctaacggtaaacctttaaaccccctaaacccgtttacccgtaaaccccgtttacggaaacccgtaacccgttaaccgttttaccgggttttaacccccggttttttttaaggtttttttacccgggtaaccggttaaacggggttaccgggtttaccccggttttacccgggtttccgtttcgggtttaaccgttaaacggggtttcggggtaaaacttttcggggtaaaccccgtttacgggtttacccgggggggaaccccgttaaaccggggggggttaaaaccccccttggggggttaaccccccgtaacccccgggtttacccgtttaccccccgttaacccgggtaaccccggttaccccccgtttaaaccccccggaaacccccgggttaaaccccgggggttacccccccg

SEQ ID NO: 210417 - DNA, 571 bp, Homo sapiens
  misc_feature: GYAE6OF01A3UKG.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacaccgacactcgggaaccccactatcgccaggccttcacagggcgtttgtcttctccatggtactacctcgtggtcgggacgcttatctgcagtactaaccaaccttcaacctgacgacactcgtacctttattttcgtacgagtagtcgtcgtctgtcagtgtattcgacgtacgtcggggacctacgggtaccctggtcctacccggtcctacccgtcgacgtccctcccgaaccgaccgggtacccc

SEQ ID NO: 210418 - DNA, 646 bp, Homo sapiens
  misc_feature: GYAE6OF01BEBRL.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtctaattgggtccgacacggcccctggacaaggccttgactacagtggatggatacaacaccgacacgtacgggaaccccactactcgcccgaggtccttcgacgacgggtcgtttcgtcttctcctagtcggtactaccgtcgtcggtccgggtacgtcttactcgtagcgtagtaactaacctaaccttacaacctcgacgactaccgtcgttaccgttttagttttacgtacgtacgtacgtcgtccgttcgtcgttaccgtaggttacgtaacgtttggaccgttacggtacgggaccgtacgggtacccgtcggtccgtacccgttccgttacccgtccgaccgtacccgtcccgaaccgtaccgggtaccccg

SEQ ID NO: 210419 - DNA, 802 bp, Homo sapiens
  misc_feature: GYAE6OF01DVG25.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttctggatacatcttcacttacttattctgtactaagttcgggtcccgaacgacggtcccctagggaacgtaacgggtccctttaggaaccttaactagttacggggagttggaactaccaaaccgacccgtaacaccgtaacgggaaacccccctacgttacgtacggccccgacggtccccgtttaccggaaccggggggttccggttttacgttccctttacccgtaccgtaagttcggtaacttaccccgtacggttccgggttaccgggggaccggttcctttagtcccgttaggaccaacgttaacctaaacccctaaaccctttaccaaccgttacgaaccgtaacctaaccgtttcgttaccgttttttaacttttacggaaccgagtacggtacgttaccgtcgttagtacgtaggttagggtaactttcggtaacccgttagggtaccggggaacccgtaaccgggggtaaaccccttggggttacccacccggtttccgtaccccgtcgtaaccgtcccccgttaaccgacccgtaacgggtcccctaccggg

SEQ ID NO: 210420 - DNA, 645 bp, Homo sapiens
  misc_feature: GYAE6OF01ER5CI.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcacttacttattctgtcaattgggtccgacaggcccctggacaaggccttgactacatgggatggatcaacaccgacactcgggaaccccactatcgcccaggccttacacgacggcgtttgtccttctccagtgtactacctctcggtcgggacggtctttaactcgtgcagtactaacctaaccttacaacctgaccgactaccgtcgtaccgtttttattttcggtaacgtagtaacggtcgttaccgttcgtcgttcgtaaggttacggtaagttcgaaccgttacggtacgggggtacccgtaaccggggtaacccggttcgggtacccgtacccggttaccgtcccgtacgaacgaccccgtaccaacccggaaccgggtacccccg

SEQ ID NO: 210421 - DNA, 580 bp, Homo sapiens
  misc_feature: GYAE6OF01EKRMF.7.78.H01.1.454.CMB.1.raw
  modified_base (266)..(266): a, c, t, g, unknown or other
  misc_feature (266)..(266): n is a, c, g, or t
  modified_base (377)..(377): a, c, t, g, unknown or other
  misc_feature (377)..(377): n is a, c, g, or t
  modified_base (562)..(562): a, c, t, g, unknown or other
  misc_feature (562)..(562): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattcngtcaattgggtccacaggcccctggacaaggccttgactacatggggatggatcgaacaccgacactgggaaccccactatcgccaggccttcacagggcgtttgtcttcnccatggatacctgtgtcgggacgtcttatctgcagtactaaccctaacttcaacctgaaccgactacgtagtcccgtttttaagttttcgaaccgagtaacgccgttacgtcttagtcaggttaggaattgactcggtgggaccgacgggtaaccctgggtccacccgttctcccgtcagtcccncccaccgaacggtccccg

SEQ ID NO: 210422 - DNA, 721 bp, Homo sapiens
  misc_feature: GYAE6OF01E1OEC.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacatcttcacttacttattctgtctaagttgggtccgacacggcccctggacgaaggccttgactacagtgggatggatacaacaccgacacgtacgggaaacccctactatcgacccacggcctttacgacgtacggggtcggttttctccgttcctaccagtcggtaacttaccctcgttcggtaccggggtacgtctttaactcgtgactaacgtaaactaacccgtaacccttaccgaacccgttcgaaaccgtaccctaaccgtttacgtttacccgtttttaagttttttacggaaccggttaaggtacgggtccgttacggttcgttacggttacgtacggttaggtaacgttacgtaccgttaacgggtcgggggtaacccgtaacgggtaacccggttcggttaccctacccggttcctacccggtacacccggtccctacccgaaccggaacccgggtacccg

SEQ ID NO: 210423 - DNA, 778 bp, Homo sapiens
  misc_feature: GYAE6OF01BAB7A.7.78.H01.1.454.CMB.1.raw
  modified_base (312)..(312): a, c, t, g, unknown or other
  misc_feature (312)..(312): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttctggatacatcttcacttacttattctgtcaagttgggtccgacacggcccctggacaaggccttgactacngtgggatggatcaacaccgacacgtacgggaaccccactactcgcccgacggcccttacgaaccgtacggggtccggttttacgttcctttcctacccgtagttcgggtaacttacccgttcgttacgggttcccgggggtaacggttcctttaacgtccgttacggactaacggtaaaccttaaaccccgtaaacccgtttccgaaacccgttcggaaaccggtaccttacgttccggtttacccgttttttaagtttttaccgggaacggtaacggtacgttcccgggttacggttaccgttacggttaccgtaagggttacggtaaacgtttcggaaccgtttaccggtcggggggtacccgtaaacggggtaacccccgttcgggttacccgtacccggttccgttaccccgtaccgtacccggtaccccgtaccccgtaacccggtaaccgggtacccccg

SEQ ID NO: 210424 - DNA, 583 bp, Homo sapiens
  misc_feature: GYAE6OF01D5ES4.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccacctatcgcccaggccttcgacggggtcggtttgtcttctccatcggacttacctcgtcggtcgggacggtcttatctgcaagactaacctaaccttacaaccgtgacgacactcgtccgttttattttgacgagcgtcgtcgtctgtcgagtagtacttgacttacgtcggggccacgggtacccgttggtccgtaccgtctccgtcgacgcccttaccgaccctacgggccctaccgg

SEQ ID NO: 210425 - DNA, 607 bp, Homo sapiens
  misc_feature: GYAE6OF01DMGE4.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattggaggaagcctggggctcagtgagcgttgcctgcaagtccttctggatacatcttcactacttattctgtctaagttcgggtaccacgacggcccctggacaaggccttgactacagtcgggatggatcaacaccgacacgtacgggaaccccacgtactcgaccaggtcccttcgaacgtacggggtcgttttcgtccttcgtaccagtacggactaccgtcgtcgggtcggggacgtcttatcgtgacagtactaaccctaaccttcgaacctgaccgtacacgtcgttccgttttatttacggacgtaagcgtcgtcgtctgtcgagtggattcgactcggtgggaccgtacgggtaccctcgtccacccgtctcccgtcaccgtcctacccgagtaccggtccc

SEQ ID NO: 210426 - DNA, 646 bp, Homo sapiens
  misc_feature: GYAE6OF01A1BEF.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacatcttcactacttattctgtcaattgggtccgacacggcccctggacaaggccttgactacatgggatggatcaacaccgacacgtcgggaaccccacctatcgcccacggccttcacgacgggtcgttttcgtccttctccatcggtactaccctcgtcggtcggggacggtcttacgtctgacctagaactaacccaaccttaccaaccgtacgaaccgactaccgtcgtacccgtttttattttcggtaacgtagtacgccgttccgttcttcgtactaggttaggtaagttcgtaccgttacgtacgggggtccgtacgggtaacccgttcgggtaccctacccgtcctacccgtacgtcgaccccttaccgaacccgtaaccgggtacccc

SEQ ID NO: 210427 - DNA, 806 bp, Homo sapiens
  misc_feature: GYAE6OF01CSG9X.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtcgcccacctcccgaggtgcagctggtacagtctgggtctgaattggaggagccgtggggctcagtgagcgttgcctgcaacgtccttctggactacatcttcacttactttattctgtacaagttcgggtccgaacgaccggtccccgtaggaaccgtaacggtcctttacgaaccgttacgaggtacgggagtaggtaactacccaaaccgaacccgaactaccggtaaccgggaacccccaaccgtactcggacccacggtcccttacgacggtacgggttcggtttacgttcttcctaccgtagttacggtaacttaccgttcgtacgggtaccggggtaccgttctttagtccgtcgtaactaacgtaaaccttaaaaccccgtaaacccttacgtaaacccgtacggaaaccgtacccgttaccgtttacggtttaacccgtttttttaagttttaccgggaacggtaacgtaccggttccgttaccggttcttacggttacgtacggttaagttacgttaacgtaaccgttacggggtccggggaacccgtaaccggggttaacccttcgggtaacccttaccccggttcttaccccgtacgtacccggccccttaacccggaacccgtaaaccgggtcccc

SEQ ID NO: 210428 - DNA, 776 bp, Homo sapiens
  misc_feature: GYAE6OF01CXFYG.7.78.H01.1.454.CMB.1.raw
  modified_base (244)..(244): a, c, t, g, unknown or other
  misc_feature (244)..(244): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactccccaggtgcagctggtacagtctgggtctgaattgaggaagcctggggcgtcagtgagcgttgcctgcaagccttcnggatacatctcactacttattctgtacaagttgggtccgacacggtcccctggacaggtccttgactacagtgggatggatcaacaccgaacaccgtacgggaacccccactactcgcccacggccttcgacgacgggtcgtttgtccttctccagttcggacttaccgtcgtgggtccggggaacggttcctttagtccgttacgaccgtaacgtaacctttaaaccccgaaacccttttaccccgaaccgtacggtaaacccgtaaccccgtacgtttaccggttttaccccgtttttttaaggttttttccggtaaaccgggtacggtacggtttccccggtttaccggtttcgttacggttccgtaaagggtttcggtaaagtttcggtaacccgttacggggtacgggggtaccccgtaaagggggtaacccccctttgggttacccctacccccgggtttcttaccccgtaccggaccgttaccccccgtaaaccccggaacccggtaaacccggggtaccccccg

SEQ ID NO: 210429 - DNA, 804 bp, Homo sapiens
  misc_feature: GYAE6OF01C0ZC8.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggaagcctggggcgtcagtgagcgttgcctgcaagccttcgtggatacatcttcactacttattctgtctaagttgggtaccacgacggcccctgggaccaaggccttgactacatgggatggatacaacaccgacactcgggaaccccacgtatcgacccaggtcccttacgacgtacggggtcggttttcgtcctttacgtcccgtattcgggtaactttaacccgttcgtacgggttccgggggtaaccggtacctttagtccgttacggaccgtaacggtaaaccttaaaccccgtaaaccccttttacgaaaccccgttacggtaaacccgacccttaaccgttccggtttaaccccggtttttttaagttttttacgggtaacccggttaaggtaccggttcccggtttaccgttacccgttacggttaccgtagggtttacggtaaagtttaccggtaacgttaaacccggggttcgggggacccgtaaaaccggggtacccccgttacgggttaacccgtacccccggttccttaccccggtttaccgaccggtacccccgttacccccgaaacccggtaaacggggtcccccccg

SEQ ID NO: 210430 - DNA, 717 bp, Homo sapiens
  misc_feature: GYAE6OF01ECW1H.7.78.H01.1.454.CMB.1.raw
  modified_base (670)..(670): a, c, t, g, unknown or other
  misc_feature (670)..(670): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggacgccgtggggctcaggtgagtcgttgcctgacaacgtccttcgtaggtactactattcttacacttactttattctgtactaagttcgggtcccactacggccccttaggaacctacggtccttagactacgagtggggtactggactacgaaccgaccgacgtaacgtaccggaacccctacgtacgtccgacccgtaggtcccttacgaaccggtaggggttcgttttcgttaccttccgtacgtagttacgggtacttaacccgttcggtacgggttcggggtacgttcctttaagtccgtacgacgtaacgtaaccttaaaccccgtactttaccaaccgtgtaaccctactacgttacgtttaccgttttagtttcgaacgtggtacgtccgttacgtgttacgtgtaacggtaggttacttacggaccgttacggacggtaccggtaccgggttacccncggttcctaccctcgtaccgtcaccgtcccacgtcggaaccgtcccg

SEQ ID NO: 210431 - DNA, 554 bp, Homo sapiens
  misc_feature: GYAE6OF01A84M0.7.78.H01.1.454.CMB.1.raw
  modified_base (379)..(379): a, c, t, g, unknown or other
  misc_feature (379)..(379): n is a, c, g, or t
  modified_base (440)..(440): a, c, t, g, unknown or other
  misc_feature (440)..(440): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccgacaggcccctggacaaggccttgactacatgggatggatcaacaccgacactcgggaaccccactatcgcccaggccttcacgagggcgttttgcttcnccatggatacctctggtcgggcgtcttatctgcagactaaccaaccttcaacctgacgacnctcgtccgttttatttcgacgtagtacgcgtcgtctgtcagtggaattgactacgtcgggcacgggtaccctggtccaccgtctaccgtcgacgccctccgaccgagggtcccc

SEQ ID NO: 210432 - DNA, 567 bp, Homo sapiens
  misc_feature: GYAE6OF01C0XPO.7.78.H01.1.454.CMB.1.raw
  modified_base (458)..(458): a, c, t, g, unknown or other
  misc_feature (458)..(458): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaaggccttgactacatgggatggatcaacaccgacactacgggaaccccacctatcgcccaggccttcacgagggtcggttttcgtcttctccatggactacctcgtcgtcgggacggtcttagtctgcagactaaccaaccttcaactgacacactgtactttntttgtacgtagtagtcgtcgtctgtctagtggaattgactacgtcgggccgtacgggaccctggtacgtacccgtcttcccgtccgcctcccaccgacggcccgtaccg

SEQ ID NO: 210433 - DNA, 563 bp, Homo sapiens
  misc_feature: GYAE6OF01ETMGP.7.78.H01.1.454.CMB.1.raw
  modified_base (382)..(382): a, c, t, g, unknown or other
  misc_feature (382)..(382): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtctaattgggtccgacacggcccctggacaaggccttgactacgagtgggatggatcaacaccgacacgtcggaaccccactatcgccaggcctcgacgggtcgttgtcttcncatgactcgtgtgtcggacgtcttatctgctagactaaccgaacttcaacctgacgacactcgtacgttttattttcgagtagtcgtacgtcgtctgtactagtagattcgacgtacgtgggaccgtacggtacccgtggtcctaccgtctcctacgacgccctaccaccgaggccctacg

SEQ ID NO: 210434 - DNA, 569 bp, Homo sapiens
  misc_feature: GYAE6OF01C7X9W.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattcgggtccgacaggcccctggacaaggccttgactacatgggatggatcaacaccgacacgtacgggaaccccactatcgacccaggccttcacgagggtcggttttgtcttctccagttcggacttacctcgtggtcggggacggtcttatctgacagtactaacctaaccttcaacctgacgacacttgtaccgttttattttcgacgagacgtcgtcgtctgtcagtgattgactcgtgggcctacgggaccttggtcaccgttctccgtcacgtccctccaccgtcggtcccg

SEQ ID NO: 210435 - DNA, 656 bp, Homo sapiens
  misc_feature: GYAE6OF01DQP46.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggccctggacaaggccttgactacagtgggatggatcaacaccgacactcgggaaccccactatcgcccaggccttcacagggtcgtttgtcttctccatggacttacctcgtggtcgggacgtcttatcgtgctagactaacctaaccttcaacctgacgactacgttcgtaccgttttattttcgaacgtagtagtccgttacgttcgtacgttcgtaaggttaggtaacttcggtaaccgttaccggttacggggggacccgtaacgggggtaaccccctttggggtacccttaacccggttccgttaccccgtaccggtacccgtccccgttaaccccgaaacccgggtaaaccggggtaccccccg

SEQ ID NO: 210436 - DNA, 562 bp, Homo sapiens
  misc_feature: GYAE6OF01AT381.7.78.H01.1.454.CMB.1.raw
  modified_base (540)..(540): a, c, t, g, unknown or other
  misc_feature (540)..(540): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaaggccttgactacatgggatggatcaacaccgacactcgggaaccccactatcgcccaggccttcacgagggtcgtttgtcttctccatcggactacctctgtcgggacgtcttatctgcagactaaccaaccttcaacctgacgacactgtccgtttattttcgacgtagagtcgtcgtctgtcagtggaacttgacttacgtcgggaccgtacgggtaaccctggtccaccgtctcccgtacncgccctccaccgtacggtcccc

SEQ ID NO: 210437 - DNA, 692 bp, Homo sapiens
  misc_feature: GYAE6OF01BTJWY.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagtcgttgcctgcaagccttctggatacatcttcacttacttattctgtaccaagtttgggtcccacacggcccctaggaccaaggtcccttgaaccttacgagtggggatggataccaacaccgacacgtcgggaaaccccactaatcgaccctaaggcccttacgacgtaggggtcggttttgtcctttcgccctagtcgggtattaacccgttctaggggtaccgggtacggtactttacgttctaggacgtaaggtaaaccttaaccctaaacccttaccgaacccgttacgaaccgaaccgtacttcggttacccgtttttaagttttcggtaacgtagtacgtcggttacgttacgttgttaccgtaggtaccggtagtttacgacgttacggtcgggaccgtacggggtaaccctgggtcccaccgttcctcgcctacgaccctccgaaccgacgggtccccg

SEQ ID NO: 210438 - DNA, 770 bp, Homo sapiens
  misc_feature: GYAE6OF01CU3G2.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggagtatcctcttcttggtggcagtagcaacaggtcgcccactcccaggtgcagctggtacagtcgtgggtctgtaagttggaaggaagccgtggggcgtcgagtgagcgttgcctgcaagtccttcgtggactactattccttacaacttactttattcgtacgttacgtaagtttcgggtaccgacgaccggtcccctagggaaccaaggtccttacgaacctacgtagtagggataggactacaaccgaccgaacgaccgtaccgggaaccccacgtacgtcgacccgagtcccttacgacggtacgggttccgtttcgttccttctaccgtagtacggtacttaccgtcgtacgggtaccgggtacgttacgtttagtccgtacgaacctaacgtaaaccttaaacccgtaacccgtttaccgaaccgtacggtaacccgtacgtaccgtttacggtttaacccgtttttttaagttttaccgggaaacgtaacggtaccgttaccggttaccgttacgttcgtaacggttaggttaacgtacgttacgtaccgtacggtcggggaccgtaacccgggtacgttcggtacccgtaccggttcctacccgtaccgaccgtacccaccgtaaccgccggtacccg

SEQ ID NO: 210439 - DNA, 659 bp, Homo sapiens
  misc_feature: GYAE6OF01CP6BT.7.78.H01.1.454.CMB.1.raw
  modified_base (392)..(392): a, c, t, g, unknown or other
  misc_feature (392)..(392): n is a, c, g, or t
  modified_base (432)..(432): a, c, t, g, unknown or other
  misc_feature (432)..(432): n is a, c, g, or t
  modified_base (457)..(457): a, c, t, g, unknown or other
  misc_feature (457)..(457): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacatcttcactacttattctgtcaagttgggtaccacacggcccctggaaccaaggccttgaactacgatgggatggatacaacaccgactacgtacgggaaccccactatcgcccaacggccttacgacgacgggtcggtttntccttctctagtggtaactactcgtggtcggacgtcttancgtgcagtaactaaccgtaccttanaaccctgaaccaccgtacttcgtaccgtttttagtttcggaacgtacgtagtccggttacgttccgtgttaccgtaggttaggaaacttttcggaaccgttaaccggtggggggaccctaaacggggtaccccttgggtccctaaccccggttctccgttacccgacggttccccacccctaacggaaacccggggttcccc

SEQ ID NO: 210440 - DNA, 824 bp, Homo sapiens
  misc_feature: GYAE6OF01EGCRM.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcgttggtggcagtagcaacaggtgcccactcccaggtgcagctggtacagtcgtgggtctgaattgaggagccgtggggctcgagtgagtcgttgcctgcaacgtccttctaggactactattccttaccaacttactttattcgtagttactaaggttcgggtacccgaaccgtacgggtccccttagggaacgtaacgggtacccttacgaacctaacgtacggttggggacttagggaacttaccgaaaccgaaccgtaccgtaaccgtacccgggaaacccccctaaccgtactcccgacccgtaacggtcccgttaccgacggtacggggttcgttttcgttccttaccgtcgtagttacgggtaccttacccgttcgtacgggttaccgggaccggttactttacgtccggagtaaccgtaacgtaaacccttaacccgttaaacccttcccgtaacccgttcgaaaccgtacctacggtttaccgtttaccgtttttttaagttttccggtaacgacggttacggtcccgttaacggtcgttaaggttccgaagggttacggtaattcggtaccgttacgggtccggggaccgtaaccggttacccggttcggtacccgttacccggttcctcccgtacgtacccgtcccctaacccgtaaccgggtacccgtaccccgg

SEQ ID NO: 210441 - DNA, 687 bp, Homo sapiens
  misc_feature: GYAE6OF01AFYL1.7.78.H01.1.454.CMB.1.raw
  modified_base (243)..(243): a, c, t, g, unknown or other
  misc_feature (243)..(243): n is a, c, g, or t
  modified_base (357)..(357): a, c, t, g, unknown or other
  misc_feature (357)..(357): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttnggatacatcttcacttacttattctgtctaagttgggtccgacacggccctggacaaggccttgactacagtgggatggataccgaacaccgacacgtacgggaaccccactancgccgaggtccttacgacgtagggtcgtttgtccttctctatcggacttccgtcgtcggtcgggtcgtcttagtcgtgacaagtaacctaaccctaaccctttaccaaccgttcggaacccactaccgttacggtttacccgttttttagttttacggaacggtacgtacggtccgttcgttccgttcggtacgttaagggttaggtaacgttcggtaaccgttaccgggtacggggacccgtaacggggtaaccccgttgggtaccctaccccggttccttaccgtacccggtactacccccgtccgtaaacccggaccgggtaccccg

SEQ ID NO: 210442 - DNA, 611 bp, Homo sapiens
  misc_feature: GYAE6OF01BZ8HO.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcgtggatacatcttcacttacttattctgtcaattcgggtccgacacggtcccgtacggacaacggtccgttgacgtaacgagtgggatggatacaaccaaccgacactcgggaaccccacctatcgaccacgcttcacgcgggtcggttcgtcttctacctatggtactacctcgtggtccgggacgtcttatcgtgactagtaactaacctaaccttacaaccgtgaacgactacgtcgttacgttttattttagacgtagacgtcgttgtctgtacaggtagattcgactcggtacgggaccgtacgggacccgttggtcccgaccgttcctccgtctaccggacccctccgaaccgaccggtcccg

SEQ ID NO: 210443 - DNA, 700 bp, Homo sapiens
  misc_feature: GYAE6OF01EA3IV.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttactttattctgtctaagttcgggtccgacgacggccccgtaggacaacggccttagactacagtgggatggatacaacaccgacacgtacgggaacccctactactcgccacggtccttacgacggtagggtcggtttcgtccttctaccgagtcggtactacccttcgtcgggtccggggtacggtctttacgtccgtacgtacgtaagtaaacctaacccttaaacccttacctaacccgtacgtaacccgtaactaccgtttcggtttaccgtttttaagtttttacggtaacgtaggtacgtcgttcgttcgttagtctaggttaggtaagttcgtacgttacggtacggggtaccgtaaccgggtacccgttacggtcccgtacccgttcccgttccgtaccgtaccgtccctacccgaaccgtaccgggtaccccg

SEQ ID NO: 210444 - DNA, 704 bp, Homo sapiens
  misc_feature: GYAE6OF01CRYBI.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtcgcccactccaggtgcagctggtacagtctgggtctgaattgaggagccgtggggcgtcagtgagcgttgcctgcaagccttctggatacatcttcactacttattctgtactaagttcgggtccgacacggcccctaggacaaggccttgactacgagtgggattggaatcgaacaccgacacgtacgggaaccccactactcgaccctacggcccttacgacgtacggggttcgttttcgtaccttctaccgtacgtcggtacttacccttcgtcgggtacggggtaacgtcctttaactcgtagtacctaagtaacttaaacccaacctttaccgaaacccttcggaaccgtacctacgtttacggttaccgtttttaagttttacgggaacgtaggtacgttccgttcgttaccttggtacacgggtagttaactacggtactcgggtaccggggtcgaaccgggtacccgttcggtaccgtacccggttcctaccgttaccgaccgttacccctacccgacccggtaacggtacccccgg

SEQ ID NO: 210445 - DNA, 855 bp, Homo sapiens
  misc_feature: GYAE6OF01A8M62.7.78.H01.1.454.CMB.1.raw
  modified_base (171)..(171): a, c, t, g, unknown or other
  misc_feature (171)..(171): n is a, c, g, or t
tcagcgtgtctctacacgaccggtgctcgatttagtgtgagtagtttgggtttgggacccaacaaccacacccctcctaagaagaacgcccctagaccacagcctccacaccatggacgtggaccgtggaggacttcccttcttcgttggtggcgagtagcaacgaggtcncccacttccgtaggtgcgagcgtaggtactagtcgtggtctagtaagttggaggacgtccggtggggcgtacgaggtgagtcgttcgccgtgacgaacgttccgttacgtacggtaacttaccgtacttacctttactaacctttacttttacgttcgttacgttaacgtaacggtttccgggacccgtaaccgtccggtaccccgtaggaaccgtacggtccgtttaacggaaccgttaacgtacggttagggtaacgtacggtaactaccgaaaccggtaaccgtaccgtaaccggtacccggaaacccctacgtacgtacccgtacccgacggttcccttacggaccggttacggggtttccgttttacgttacccgttaccgtaccgtaacggttacggtaccgttaccggttcggttacgggtaccggggtaacgttcgtttacgtcgtacgtaacctaacgtaaaccctaacccttaccgtaccctaacgtacggaaccgtactaccgtttacgtttacgttttagtttacggacgtacggtacgtccggttacgttgtacgtaggtacgtagttaactacggtacgttacgggaccggtaccggtacggtacccggttaccggtaccgttccgtcccgtaccttccgaccgaccccttacccgaaccggcgtacccg

SEQ ID NO: 210446 - DNA, 636 bp, Homo sapiens
  misc_feature: GYAE6OF01CX1BA.7.78.H01.1.454.CMB.1.raw
  modified_base (243)..(243): a, c, t, g, unknown or other
  misc_feature (243)..(243): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacatcttcactacttattctgtcaattgggtccgacacggcccctggacaaggtccttgactacagtggatggatcaacaccgacacgtcgggaaccccactatcgacccaggtcccttcacgtacgggtcggtttcgtcttctccgagtacggtactacccttcgtacggtcgggaccgtcttatcgtagcagtaactaaccaacctttacaacctgaaccgactacttcggttaccgttttattttcgaacgtaagtacggtaccgttcgtcgttgttcgtaggttggtaacttcgtaccgtacggtgggacccgtaacggggtaccccttagggtccctaccgttcctcccgtcgacgtccctacccgaccgtaccgggtaccccg

SEQ ID NO: 210447 - DNA, 671 bp, Homo sapiens
  misc_feature: GYAE6OF01BJ7VD.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacatcttcacttacttattctgtctaattcgggtccacgacggcccctggacaaggccttgactacatgggatggataccaacaccgacacgtacgggaaccccactactcgacccaggccttacacgagggtcgttttgtcctttctaccgtagtcggacttaccctgttcggtccggggacgtcttacgttcgtgtacagtaactaacccgtaaccttacaaccgttacgacgtaacctacgttcgtacccgtttttaagttttacggaacgtaaggtaacgttccggtccgttacgttacgtacgtaggtacgtaagttcgtaacgttccgggtacggggaccgtaacgggtaccccgttggtacccgtacccgttcctacccgtaccgtacgcccctaacgacccgtaacgggtaccccg

SEQ ID NO: 210448 - DNA, 545 bp, Homo sapiens
  misc_feature: GYAE6OF01D399W.7.78.H01.1.454.CMB.1.raw
  modified_base (412)..(412): a, c, t, g, unknown or other
  misc_feature (412)..(412): n is a, c, g, or t
tcagcgtgtctctacacgaccggtgctcgatttagtgtgagtagtttgggtttgggacccaacaaccacacccctcctaagaagaagcccctagaccacagctccacaccatggactagacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccgacaggcccctggacaaggcctttgactacatggggatggatcaacaccgacactcgggaaccccacctatcgcccaggccttcacaggggtcgtttgtcttctccatggatacctctggtcgggacgtcttanctgcagactaaccacttccactgacgcagtcgtctttatttgacgagagtcgtcgtctgtcagtgattgactcgtggggccagggtaccctggtccaccgtctcccgtcacgccctacgaccgaagggtcccc

SEQ ID NO: 210449 - DNA, 798 bp, Homo sapiens
  misc_feature: GYAE6OF01BHYO8.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtcaattcgggtccgacacggcccctggacaaggccttggactacagtgggatggatcaacaccgacacgtcgggaaccccactatcgcccaggccttcacgtacggggtcggtttcgtccttccgtccagtcggtactacctcgtcggtcggggtacggtcgttactcgttacgacgtaacgtaacgtaaaccctaaccgtttaccaacccgtagtaaacccgtacctaaccgttacggttacccggttttttaagttttttacgggtaacggtaacggtacggtacccgggtttcccgttaccgtttacggttacggttaacgggttacgggttaaaccgtttacgggtaaccgttaaccgggttacccggggggtaccccggtaaaccggggggttaaaccccccgtttcgggggttacccccgtaaacccccgggtttcccgtttaacccccggttaccgtaaccccgggttaccccccttaaccccgggtaaacccccggtaaacccgggggttaaccccccccg

SEQ ID NO: 210450 - DNA, 752 bp, Homo sapiens
  misc_feature: GYAE6OF01CJIMF.7.78.H01.1.454.CMB.1.raw
  modified_base (243)..(243): a, c, t, g, unknown or other
  misc_feature (243)..(243): n is a, c, g, or t
  modified_base (284)..(284): a, c, t, g, unknown or other
  misc_feature (284)..(284): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactccaggtgcagctggtacagtctgggtctgaattggaggaagccgtggggcgtcagtgagcgttgcctgcaagccttnggatacatcttcactacttatctgtcaagttgggtccgacncggccctggacaaggtccttagactacgagtcgggatggactcaacaccgacacgtcgggaaccccactacgtcgaccccgaggtccttcgaacgaggggttccgtttcggtccttccgtaccctagttacggtaacttacccgtcgtcggtaccggggtaccgttcttacgtccttaggacctaaggtaaaccttaaaccctaaaccctttacgaaacccgtacgtaacccgtaaccgacgtttaccggtttaccggttttttaattttaccgggtaacggttaacggtaccgggttccgtttaccggtagttcggttaacgttaacggttaggttaaacgtttcgtaaccgttacgggttacgggacccggtaaacgggttaacccccgttcggtacccgttaacccggtcccttacccgtcgtacccgaccccgttacccgaaacccggtacccgggtaaccccg

SEQ ID NO: 210451 - DNA, 787 bp, Homo sapiens
  misc_feature: GYAE6OF01BFKF3.7.78.H01.1.454.CMB.1.raw
  modified_base (335)..(335): a, c, t, g, unknown or other
  misc_feature (335)..(335): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattcgggtccgacacggcccctggacaaggccttgactaacagtgggatggatacaacaccganacgtcgggaaccccacctagtcgacccaggtcccttacgacgacggggtcggttttcgtaccgtttcctcccgtagttacgggtaacttaacccgttccggttacgggttaccggggggaaccggttccttttaacgtccgtttacggaccgtaacggtaaacctaaaccccgttaaacccctttccgtaaaccccgttagaaacccgtacccgttaaccgttaccggtttaccccggttttttaagttttttaccggtaacggttaaacggtaacggttacccggttccggttccgttaggttacccgtagggttacggtaaacgtttccggtacgttaaccgggtccgggggtaacccgtaacggggtaacccctttcggggtaccctaacccggttccctacccgttcgaccgtaccccctacccggaacccggtaacgggtacccccg

SEQ ID NO: 210452 - DNA, 561 bp, Homo sapiens
  misc_feature: GYAE6OF01D89J4.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtctaattgggtccgacaggcccctggacaaggccttgactacatgggatggatcaacaccgacactcgggaaccccacctatcgcccaggccttcacgagggcgtttgtcttctcatggatacctctgtcgggacgtcttatctgcagataaccctaaccttcaacctgacactactcgtccgtttttattttgacgagacgtcgttcgtctgtcaggtgaattgtactcgtcggggccacgggtaccctggtccaccgttctccctcgacgccctaccgacgacggtccccg

SEQ ID NO: 210453 - DNA, 644 bp, Homo sapiens
  misc_feature: GYAE6OF01BTM7H.7.78.H01.1.454.CMB.1.raw
  modified_base (364)..(364): a, c, t, g, unknown or other
  misc_feature (364)..(364): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaaggccttgactacatgggatggatcaacaccgacacctgggaaccccacctatcgccaggccttcacgnggtcggtttgtcttctcatggactaccgttctggtcgggacgtcttatcgtgcagtaataaccctaaccttaccaaccgtgaaccgacctacttcgtccgttttattttcggtaacgtacggtacgtcggtcgttaccgttgttacgaggttacggtaactttcgtaaccgttaccggtgggggtaacccgtacggggtaacccgttagggtccccgtaacccgttcccgtacccgttccaccggttccctaaccccgacccggtaaaccggggtccccc

SEQ ID NO: 210454 - DNA, 612 bp, Homo sapiens
  misc_feature: GYAE6OF01DNNU8.7.78.H01.1.454.CMB.1.raw
  modified_base (360)..(360): a, c, t, g, unknown or other
  misc_feature (360)..(360): n is a, c, g, or t
  modified_base (463)..(463): a, c, t, g, unknown or other
  misc_feature (463)..(463): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctgttacagtctgggtctgaattgagaagccgtggggcgtcagtgagcgttgcctgcaagccttctggatacatctcactattattctgtcaattcgggtccgacacggcccctggacaacggtccttgactaccaatcgggatggactcaacaccgacacgtacgggaaccccaccgtatcncccaggtcccttcgacgaggggtcgttttgtcttcctccagttcggactaccgtcgtggtccgggacgtcttagtctgcagtactaacctaaccttccaactnacgacactgttcgtttattttgacgtagtcgtcgttcgttcgtatcgtagtaggtaattcgtacgtcggtacggggccgtaacgggtacccgtggtcccgtaccgttcctacccgtcgacgtcccctacccgaccgtaccgggtacccg

SEQ ID NO: 210455 - DNA, 587 bp, Homo sapiens
  misc_feature: GYAE6OF01B299X.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagtccttctggatactatcttctacttacttattctgtctaagttcgggtaccgacgacggccctaggacaaggtcctgactacgagtgggatggatacaacaccgacacgtacgggaaccccacgtaactcgaccgacgtccttacgacggtagggtcgtttcgtctcgtccagtcggtactacctcgtcggtcgggtacgtcttacgtctagcagtactaacctactacactgacatcgtcgttcgtttatttgacgagacgtcgtcgtctgtcagtgtaatcgtactggtacgggccgtacggtacctcgtcctaccgtctcgtcacgtccctaccgacgtacggtcccg

SEQ ID NO: 210456 - DNA, 566 bp, Homo sapiens
  misc_feature: GYAE6OF01BIVJK.7.78.H01.1.454.CMB.1.raw
  modified_base (349)..(349): a, c, t, g, unknown or other
  misc_feature (349)..(349): n is a, c, g, or t
  modified_base (457)..(457): a, c, t, g, unknown or other
  misc_feature (457)..(457): n is a, c, g, or t
  modified_base (479)..(479): a, c, t, g, unknown or other
  misc_feature (479)..(479): n is a, c, g, or t
  modified_base (509)..(509): a, c, t, g, unknown or other
  misc_feature (509)..(509): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggaccaaggccttgactacatgggatggatcaacaccgacacgtcggaaccccactancgcccaggccttcacgagggtcgtttgtctttctccagttggattacccgtgtggtcgggtacgtcttagtcgtgcacgataaaccctaccttacaacctgaccgacncgttgtccttttatttcgacgngtactcgtctctgtcagtagattgactagngggaccagggtaccctggtccaccggtctcctcgacgccctacccacgtacggtccc

SEQ ID NO: 210457 - DNA, 551 bp, Homo sapiens
  misc_feature: GYAE6OF01AR0KA.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactaatgcccaggccttcacagggcgtttgcttctccatggatacctctgtcgggacgcttatctgcagataaccaaccttcaacctgacgacactgccgttttattttcgtacgagacgcgtccgtctgtcagtggaattgactacgtggggccctagggaaccctgggtccaccgttctccctcacgccctccaccgaagggtcccc

SEQ ID NO: 210458 - DNA, 612 bp, Homo sapiens
  misc_feature: GYAE6OF01CUWNS.7.78.H01.1.454.CMB.1.raw
  modified_base (330)..(330): a, c, t, g, unknown or other
  misc_feature (330)..(330): n is a, c, g, or t
tcagcgtgtctctacacgaccggtgctcgatttagtgtgagtagtttgggttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacatcttcacttacttattctgtcaattgggtcactaggccctggacaaggccttgactacagtgggatggatacaacaccganaaccgtcgggaaccccacgtatgccccaggccttacgactaggggtcgtttcgctttctcaagtcggaactaccctcgttggccgggacggtcttagtctgacaggtaactaaccaaccttacaaccctggaacctaacacttagtccgttttaagttttcgaacgtagacgcgttcgtctagtcagtaggtaattcgaacgtacggtaggggcccaacggggtaccccttggtccgacccgttctcctaccgacgtcccctaccaacccgaacggtacccg

SEQ ID NO: 210459 - DNA, 552 bp, Homo sapiens
  misc_feature: GYAE6OF01DVD61.7.78.H01.1.454.CMB.1.raw
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
  modified_base (517)..(517): a, c, t, g, unknown or other
  misc_feature (517)..(517): n is a, c, g, or t
  modified_base (539)..(539): a, c, t, g, unknown or other
  misc_feature (539)..(539): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtcccgacaggcccctggacaaggccttgactacatgggatggatcaacaccgacactcgggaaccccacctatcgccnggccttcacagggtcggtttntcttctccatggatacctctgtcgggcgcttatctgcagactaaccaaccttcaacctgaaccgacactcgtccgttttattttcgtacgagagtcgtcgtctgtcagtgattgactagtcgggcgacgggtacctggtccnccgtcgtcctcacgccctaccnccgacgggtaccc

SEQ ID NO: 210460 - DNA, 546 bp, Homo sapiens
  misc_feature: GYAE6OF01A0I38.7.78.H01.1.454.CMB.1.raw
  modified_base (243)..(243): a, c, t, g, unknown or other
  misc_feature (243)..(243): n is a, c, g, or t
  modified_base (409)..(409): a, c, t, g, unknown or other
  misc_feature (409)..(409): n is a, c, g, or t
  modified_base (530)..(530): a, c, t, g, unknown or other
  misc_feature (530)..(530): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacatcttcactacttattctgtcaattgggtccgacaggcccctggacaaggccttgactacatgggatggatcaacaccgacactcgggaaccccactatcgcccaggccttcacgagggcgtttgtcttctccatggactacctctgtcgggacgcttanctgcagataaccaacttcaacctgacacactgtctttatttgtacgagagtcgtcgtctgtcagtgtaattgactacgtgggacctacgggtacctggtccaccgtctcccgtcacgcccnccaccgaagggtcccc

SEQ ID NO: 210461 - DNA, 613 bp, Homo sapiens
  misc_feature: GYAE6OF01EQCI6.7.78.H01.1.454.CMB.1.raw
  modified_base (242)..(242): a, c, t, g, unknown or other
  misc_feature (242)..(242): n is a, c, g, or t
  modified_base (573)..(573): a, c, t, g, unknown or other
  misc_feature (573)..(573): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgagagcctggggcgtcagtgagcgttgcctgcaagtccttcnggatactatcttcacttacttattctgtctaagttggtccacacggccctggacaggtccttgactacgagtgggatggatacaacaccgacacgtacggaaccccactatcgccgaggccttacacgtacgggtcgtttgtcttctcagtcggtactacctcgtcggtacgggacgtcttactctgactaagaactaacccaacctttcaacctcgaacacctagttcgtacttttatttacgaacgtagtacgtcgttcgtcgttcgtactaggtacgtaattcggtactcggtacgggaccgtacgggtaccctggtccgacccgttntaccccgtcgaccgtccctacccgaacgtaccggtacccg

SEQ ID NO: 210462 - DNA, 775 bp, Homo sapiens
  misc_feature: GYAE6OF01CQVMC.7.78.H01.1.454.CMB.1.raw
tcagcgtgtctctacacgaccggtgctcgatttagtgtgagtagtttgggtttgggacccaacaaccacacccctcctaagaagaacgccctagaccacagctccacaccatggactggacctggaggatcctcttcttggtggcagtagcaacaggtcgcccactcccaggtgcagctggtacagtctgggtctgaattgaggaagccgtggggcgtcagtgagcgttgcctgcaagccttcgtggatacatcttacacttactttattctgtactaagttcgggtaccgacgacggtcccccgttagggaaccgaacgggtcctttaggaacctacgagtcgggataggactacgaaccgaccgacgaaccgtaccgggaaaccccctacgtaacgtccgacccgtacggtccgttacggacgggggttccggttttcgtccgtttcctcgtagttcggtaccttaccgttcgtcggtaccgggaccgttctttacgtcgtcgacgtaacgtaacttaaaccctaaccgttaccaaccgttcgaaccgtaacctacgttacgtttacccgtttttagttttacggacgtacggtaccgtacggttccgttacgttacgtacgtaaggtttacggtaacgtttcggtaaccggttaccgggtacgggggtaaccccgtaaccggggttaaccccgttgggttacccctaccgggttccctacccgtaccgtacccgtacccctaccggaacccgaccgggtccccttaaccggg

SEQ ID NO: 210463 - DNA, 840 bp, Homo sapiens
  misc_feature: GYAE6OF01C3XQV.7.78.H01.1.454.CMB.1.raw
  modified_base (242)..(242): a, c, t, g, unknown or other
  misc_feature (242)..(242): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacatcttcactacttattctgtcaagttcgggtccgacgaggcccctggacaacgggtccttgactacgagtcgggtaatggatacaacaccgaccaacgtacgggaacccccaaccgtaactcggacccgacggtccttaccaacgtacggggtcggttttcgttccttccttccgattcgggaacttacccttccgtcggtaccggggtaccggttctttaagtccgttacggactaaacgtaaccgttaaaaccccttaaaccccgttaccgtaacccgtacggaaacccgtaaccctaccgtttaccgggtttacccgttttttaagtttttttaccgggaacggtacggtaacggtttcccgggtttaccgttccgtttaccgggttacgtaacgggtttacgtaaacgggtttacgtaaacccggttaaccgggttaccgggggggaaccccggttaaaccgggggttaaccccggtttaccccggggttaacccggtacccccggttttaaccccgttacccgtcccggttaacccgtacccccgttaacccccggtaaacccgggtaccgggggttaacccccccg

SEQ ID NO: 210464 - DNA, 771 bp, Homo sapiens
  misc_feature: GYAE6OF01BJSRT.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagtcgttgcctgcaacgtccttcgtggatacatcttcacttacttattctgtactaagttcgggtccgacacggccctggacgaggtccttgactacgagtgggagtggatacgaacaccgacacgtacggaaccccactacgtcgcccgacgtccttacgacggtacgggtcggttttcgtcctttccgtccgtaacgtcggtaacttaccgttcgttcgggttaccggggtaacgttcttaacgtcgtggacctaaagtaaccgttaaaccctaaccgtttaccaaacccgttcgggaaaccctacgtaccgttacgtttacccgttttttaagttttacgggaacgaacggttaggtacccgttacgtttaccggtacggttaacctaggggttagtaaaccgtttgaaaccggtttcgggtaccggggggtacccgtaaaccggggttaacccccgttgggttaccccgtaacccggttcccttaccccggtacgtaccccggtaccccgttaaccggaaccccggtaacccgggggttacccc

SEQ ID NO: 210465 - DNA, 839 bp, Homo sapiens
  misc_feature: GYAE6OF01CDRZU.7.78.H01.1.454.CMB.1.raw
  modified_base (809)..(809): a, c, t, g, unknown or other
  misc_feature (809)..(809): n is a, c, g, or t
tcagcgtgtctctacacgaccggtgctcgatttagtgtgagtagtttgggttggggacccaacaaccacaccctccgtaagaagaagccccgtacgaccacagctccacgaccactggacttggacctgggacggactccgtcttccttgggtggcagtagcaacaggtgcccaacctcccaggtcgctacgcctggtaccagtcgtgggtctaggaattaggaggaagccgtaggggtctacgagtgaggtcggttgcctgacaagtccttacgtaggaatacgtattcgtacacttaacttatcgtagtactaacgttcggtaccgtacgtacggtccccgtaggtaacctaacgggtcccttaggtaacctacgtagtgggagtcggtacgtaccaaacgaccgtaacgaccgtacgggaaccccctacgtaacgtcgtacccgacggtaccgttacgaacggtacgggttaccgtttcgttccgttacctaccgtagttacggtaacttacccgttcgtacgggttaccggggaccgttacgttaacgtcggttacggtaccctaaacgtaaaccgttaaaccccgttaaaccgttacccgtaaacgtaacccgggtaaccgtaacccgtaaccggtttcccgtttaacccgtttttaattttaccgggacgtaccggtaacgggttccgttacgttcggtaagttaccgtagggttaccggtaattacggtacccgtagggtcccgggaaccgtacccgggtaaccgtcgttacccgtaccgttcccttaccgtccggtacccncccgtaacccggtaccgtaccgggtacccg

SEQ ID NO: 210466 - DNA, 716 bp, Homo sapiens
  misc_feature: GYAE6OF01A4VRR.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtctaattgggtccgacaggcccctggacaaggccttgactacatcgggatggatcaacaccgacacgtacgggaaccccacgtatcgcccaggcccttacgacgaggggtcgtttcgtccttactccgtaatcgggaacttacccgtcttcgggtaccggggtaccgggtactttaacgtccgttcggtaccgtaacggtaaaccttaaacccctaaacccgtttacccgaaacccttacggtaaccggtaacctaaccgttaccggttacccgtttttaagtttttacgtaacggtaggtaccgtaccggtttcgtcgttaggtaccgtaggttaggtaacttgtaactaccggttcgggggaccctacggggtaaccccgttgggaccctaccggttccttacccgtacgaccgcccgttaccccgaacccgtaacgggtacccccg

SEQ ID NO: 210467 - DNA, 725 bp, Homo sapiens
  misc_feature: GYAE6OF01EY28E.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttctggatacatcttcactacttattctgtcaattggtccgacaggcccctggacaaggccttgactacagtgggatggatcaacaccgacactcgggaaccccacctactcgcccacggccttacgaccgggggtcggtttgtccttctccatcggacttacccgtcgtcgggtccgggtacgggtctttacgtcgtgcgtaacgtaacttaaaccctaaccctttaccaaacccttacgaaccgtacctaccgttacggttacccgtttttaagttttttcgaaccggtaggtaacggtccggttaccgttcgttacgttaccgtaggttacggtaacgtttcggaaccgttaccggttcgggggacccgtaaacgggggtaaccccgttacgggttacccgtaaccccggttcgttacccccgttaccgtaaccggacccccttaaccccggaaccccggtaaaccgggtcccccgtaacccgg

SEQ ID NO: 210468 - DNA, 821 bp, Homo sapiens
  misc_feature: GYAE6OF01DVS3Y.7.78.H01.1.454.CMB.1.raw
  modified_base (188)..(188): a, c, t, g, unknown or other
  misc_feature (188)..(188): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacgaggtcgcccactccgaggtgcagcgtggtacngttcgtggtctgtaattggaaggacgtccggtggggtcgtcgaggtggacgtcgttcgccgtgactaacggtccctttcgaggtaactactacttctactaactttactttactttcgtcgtaactaacggtttcgggacccggtaacgccggtcccgtaggtaacgaaccggttccgttacgaaccttacgaacgggttgggaacgtaggtactaaccgaaaccgacccgaacgtaacccggtaacccgggaaacccctacgtacgtaccgacccgtacgtcctacgacggtgggttcgtttcgtctctactagtcgtactccgtcgtcgggtcggtacgtcttagtcgtagactaacgttaaccttaaacccgtacctttaaccgaaccgtacgaaccgtaccgtacgttttccggttttaaccggttttttatttaccgggaacgtgtaaccggttcgttccgttacggttagttacgtaagggtttacgtaacgtttacggaaccggttcggggtacccgggtaaccgggtaaaccggtttacccggcggttaaccccttcccgggttacccttcccgaccggttaccccgtacccgtaaccccggtaaccggaacccgggttaccccc

SEQ ID NO: 210469 - DNA, 693 bp, Homo sapiens
  misc_feature: GYAE6OF01CVUWQ.7.78.H01.1.454.CMB.1.raw
  modified_base (241)..(241): a, c, t, g, unknown or other
  misc_feature (241)..(241): n is a, c, g, or t
  modified_base (365)..(365): a, c, t, g, unknown or other
  misc_feature (365)..(365): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgattgaggagccgtggggctcagtgagcgttgcctgcaagccttcnggatacatctcactactttattctgtactaagttcgggtaccgtacacggtcccctaggaacgaaggtccttgactacagtggatggatacaacgaccgacacgtacgggaacccccacgtacncgcccgaggtccttacgacggtacgggtccgtttgttaccttctaccgagtacggtacttaccgtcgttcggtcggggaccgttcttactcgtcgacgaacgtaactaaccctaaacccttacgaacccttacggaacctaaccgtaccgttaccggttttaccgttttacgtttttacggaacgtacggtacggttaccgttccgttactgtaccgtagttcggtaagttcgtaacgtacgggtcgggacccgcgggttaacccgtcgggtacccgtaccgttcctacccgtccaccgtacccgtacccgacggtaaccgggtcccc

SEQ ID NO: 210470 - DNA, 727 bp, Homo sapiens
  misc_feature: GYAE6OF01CLJ64.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcaggtgagcgttgcctgacaacgtccttctggatacatcttctacttacttattctgtactaagttcgggtccgacgacggccccgtaggaacaggtccttgaactacagtggatggataccgaacaccgacgaccgtaccgggaaccccacgtactcgacccctaggtcccttacgacggtacgggttccggttttcgttccgtttacctacccgagttacgggttaacctttacccgttcgttacgggttacccggggtacgttacctttacgtcgttacggtaccgtaacgtaaaccctaaacccgttaaacccttaccgtaaccgtacggaaccgtacctacgttaccgtttaccgtttttacgtttacggtacgtagtacggttccgtacgttcgttgtacgtaggttcgtaagttcggtaacgtccgggtgggacccgacgggtacccgtcggtacctaccgtcgtcctacgacccgtacctacccgaaccgaccggtacccg

SEQ ID NO: 210471 - DNA, 752 bp, Homo sapiens
  misc_feature: GYAE6OF01BTL5T.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggagatcctcttcttggtggcagtagcaacaggtcgcccactcccgaggtgcagctggtacagtcgtgggtctagaagttggaaggacgccgtggggcgtcaggtgagtcgttgcctgacacgtccttcgaggtatactacttcttactacttactttattctgttacgtaacgttcgggtaccacgccggtcccgtaggaacgaacggtccgttacgaactacgtaggtagggattaggactaccgaaaccgacccgtacgtaccgtaacccggaacccctaaccgttacgcccgaccgtacggtaccttacgaacgggtacgggttcgtttcgtaccttaccgacctagtcggtaaccttaccgtcgttacgggtacgggtaacttcgttacgtacgtcgtaacgaacgtaacccgttaaccctaaccttaccgaacccgtacgaacccgtactttaccgttaccgttttaccgtttttaaggtttccggaacggtacggttaccggttcccgttagggttacttacggtacgttagtacggtacttacggacgtacgggtaccggtacgtaccggtacgtcggtacccgtccgtactccgtcgacacccgcgaccgtccggtcccg

SEQ ID NO: 210472 - DNA, 763 bp, Homo sapiens
  misc_feature: GYAE6OF01AOUZL.7.78.H01.1.454.CMB.1.raw
  modified_base (243)..(243): a, c, t, g, unknown or other
  misc_feature (243)..(243): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcagccttcnggatacatcttcactacttattctgtcaattcgggtccgacacggccctggaacaacggtcttgactacatgggatggataccaaccaccgacaccgtacggggaaacccctaccgtactaccgcccgaacggtcccgttaccaacggacggggtcggttttcggtacctttccgtacctagttacggaacttacccgttcgttacgggttccggggaaccggtccgtttacttccgttacgaccgtaacggtaaaccttaaaccccgttaacccttaaccgaaacccgtttggaaaccgtacctaccgttgttacccgtttttattttacgggtaacgacggtacggtacccgttcgttaccgtcggttacctaggttacggtaaagtttcgtaaccggtttccgggtaagggggtaccccggtaacgggttaaccccggtgggttaccccgtacccgtttaccgtcccttacggacccgtacccgttacccgtaacccgggaaccggggttacccccg

SEQ ID NO: 210473 - DNA, 745 bp, Homo sapiens
  misc_feature: GYAE6OF01BG31C.7.78.H01.1.454.CMB.1.raw
  modified_base (136)..(136): a, c, t, g, unknown or other
  misc_feature (136)..(136): n is a, c, g, or t
  modified_base (474)..(474): a, c, t, g, unknown or other
  misc_feature (474)..(474): n is a, c, g, or t
tcagcgtgtctctacacgaccggtgctcgatttagtgtgagtagtttgggtttgggggacccaacaaccacacccctcctaagaagaagcccctagaccacagcctccacaccatggactggacctggagatcctnttcttggtggtagtagcaacaggtcgcccactcccgaggtgcaggctggtacacgtcgtgggtactggaattggaggaagccgtggggctcaggtgagcgttgccctggcaagcctttcgtaggtactacctattcttacacttacttattctagtactaagttcgggtccacgtacggcccctaggaccaacggtcccgtttagaccttaaccagtcggggaatcggaattaccgaacgtacccgacgaaccgtcgggaaaccccctaccgttaacgtcggaccccgtacggtccctttacgaaccgagggggttccgtttacggtcttcgtaccgngtcgacgttacctcgtcgtaccgggtacgtcttacgtccgcgactaaccgtacgttaacccacgttaccaacccgttcgaaccgtacctaccgttccgttaccggttttacttttacggacgacgtacggtccggtcgttaccgttacggtaccgtagggttcggtaacgttcgtaacggtacggttccgggaaccgtacgggtacccttcgggtaccctacgtccctaaccgtcgtaccgacccttacccggacgtaccgggcctaccgg

SEQ ID NO: 210474 - DNA, 825 bp, Homo sapiens
  misc_feature: GYAE6OF01C9UFF.7.78.H01.1.454.CMB.1.raw
  modified_base (699)..(699): a, c, t, g, unknown or other
  misc_feature (699)..(699): n is a, c, g, or t
  modified_base (782)..(782): a, c, t, g, unknown or other
  misc_feature (782)..(782): n is a, c, g, or t
tcagcgtgtctctacacgaccggtgctcgatttagtgtgagtagtttgggtttgggacccaacaaccaccacccctcctaagaagaacgcccctagaccacagcctccacaccatggactggacctggagatccttctttcttgggtggcagtagacaacgaggtcgaccccacctcccgaggtcgcagcgtaggtacaggttcgtgggtctagtaaagttggaagggaacgccggtggggtccgtcgaggttggacggtcgttcgccgtgactacgtccttgaggaatactattccttactacttacttcttactgtactaacggttcgggaccgtaccgtaccggtcccgtaggtaaccgacggtccgttaggaacctaacgtagggttagggtaacgttaggaccgtaaaccgaaccgtacccgtaacgtaacccggtaccccgggaaaccccttaccgtacgtaccgaccgtaccggttccaacgggtacggtacggggttcgttttccgtaccgttccgtaccgagtccgtaaccttcccgttacgtcgggttaccgggaccgttcttacggccgtacggactaacggttaaacctacccgttaacccgtacctacccgtaaggtacctaaccgttaccgtttacgttttaccgtttttagttacggaggtactacgggttctaccgggtttanacgtaacgggttatacggggttacttcggtaacggaccgggtagggtaacccgaaccggttacggtcctaccggtccccgttntacccgtaccacccgtacccgccggtaaacccgtcggtccccg

SEQ ID NO: 210475 - DNA, 584 bp, Homo sapiens
  misc_feature: GYAE6OF01ARSYZ.7.78.H01.1.454.CMB.1.raw
  modified_base (242)..(242): a, c, t, g, unknown or other
  misc_feature (242)..(242): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttcnggatacatcttcactacttattctgtctaattgggtccgacacggcccctggacaaggccttgactacatgggatggatcaacaccgacacgtcgggaaccccactatcgcccacggccttcacgagggtcggttttcgtctttccgtacctagtcggacttacctcgtcgtcgggtacgtcttatcgtgcagtactaaccaccttacactcgacactctcgtccgtttatttgacgagtacgtcgtcgtctgtctagtgtattgacgtacgtcgggaccgtacggtacccgtggtccaccggtctacccgtacgacgtaccctccgaccgtacgggtaccc

SEQ ID NO: 210476 - DNA, 797 bp, Homo sapiens
  misc_feature: GYAE6OF01AHQG1.7.78.H01.1.454.CMB.1.raw
  modified_base (247)..(247): a, c, t, g, unknown or other
  misc_feature (247)..(247): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagtcgtcgcctgcaacgtccttcgnggtactactacttccttacctacttaactttacttcgtcgttactaaggttccgggtacccgtaaccgaccggtccccgtaggaaccgtaacggtccttacgactacgacgtagggtacgtaggactaaccgaaaccaacccggaacctaccggtaacccgggaaaccccctaaccgtacgtacccgaccccgaaccggtacccttaccgaacggtaccggggttacgttttcgttccttacctacgtacgttacggtaccttacccgttcggtcgggtaccggggtacgttacctttaagttccgtacgacgtaaacgtaaccttaaaccccgtaacctttaacccgaaccgtaccggaaacgtaacccgtacgtttaccggtttaacgttttttacgtttacggaacggtgtacgtccgttcgttacgtcgtagacggttagtacttcggtaacgtacgggtccgggtaaccggtacggtacccgttggtccctaccggttccctaccgtacgcccgttacccacccggtaccggtaaccggtccccg

SEQ ID NO: 210477 - DNA, 692 bp, Homo sapiens
  misc_feature: GYAE6OF01AKIWX.7.78.H01.1.454.CMB.1.raw
  modified_base (244)..(244): a, c, t, g, unknown or other
  misc_feature (244)..(244): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcgnggatacattcttcacttacttattctgtcaagttgggtccacacggcccctggaccaaggtccttgactacatgggatggatcaacgaccgacgacgtacgggaacccccactactcgcccgacggtccccttacgaccgtacggggtcggttttcgtcctttcctcccgagttacggtaacttaccttcgttacgggtccggggtaccggtctttaagtccgtaggtccaacggtaacttaaacccctaaccctttaccaaccccgttgaacccgacctacgttaccgttaccgttttttagttttacggtaacgtaggtacgtccggttcgttacgtggttacgaggttacgtaacttgaccgttacgggtcggggaccgtacgggaacccgttgggtcccacccgttctacccgtcaccgtccctacccgaccgaccgggtcccc

SEQ ID NO: 210478 - DNA, 723 bp, Homo sapiens
  misc_feature: GYAE6OF01CA12P.7.78.H01.1.454.CMB.1.raw
  modified_base (245)..(245): a, c, t, g, unknown or other
  misc_feature (245)..(245): n is a, c, g, or t
  modified_base (371)..(371): a, c, t, g, unknown or other
  misc_feature (371)..(371): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttcgnggatacattccttcacttactttattctgtactagttcgggtccgacgacggccccgtggaccaacggtcctagactacgagtgggatggactacaacaccgacacgtaccgggaaccccactacncgccgacgtccttacaggtcgggtcgtttgtccttccgtctagtacggtacttccgtcgttcgggtccggggaccgttctttaactccgtagctaaacggtaacctaaaccctaaccctttaccaacccgttgaaacccgtacctacgttcggtttacccgttttttaagtttaccggacgtagtacgtccggttcgttccgttagtcgtaaggttacggaagtttcggaccgttacgggtaccggggtacccgtaacccgggttaacccggttacggtccccgtaccccggttcccttacccgtacccgtacgtaacccccgtaccggtaaccccggaacgggttcccccc

SEQ ID NO: 210479 - DNA, 725 bp, Homo sapiens
  misc_feature: GYAE6OF01B4W8Q.7.78.H01.1.454.CMB.1.raw
  modified_base (388)..(388): a, c, t, g, unknown or other
  misc_feature (388)..(388): n is a, c, g, or t
tcagcgtgtctctacacgaccggtgctcgatttagtgtgagtagtttgggtttggggacccaacaaccacacccctctaagaagaagcccctagaccacagcctccacaccatggactggacctggagatcctcttctggtggcagtagcaacaggtgcccactcccgaggtgcagctggtacagtcgtgggtctgaattggaaggagccgtggggctcgagtgagcgttgcctgcagtccttcgtggatacattcttacacttacttatctgtctaagttcgggtccgacgtacggcccctaggactaacggtccttagactacgagttggattcggaataccgaaccaaccggacctaacggtaccgggaaacccccacgttaacncggaccccgtaggtcccgttaccgaacgggtacgggttcgggtttacgtccttcctacctagtacggacttaccgtcgtacgggtcgggacgtcttagtctagacagtaacctaaccgaccttagaacccgttgaccgtacctagttcggttacgtttttaagtttcggaacggtacgtacggtccggtttcgtcgttacggtacgtaagttaggtaagttccgacgttaccgggttcgggaccccgtaacgggtaaccccttggtaccccgtacccgttccgttaccccgtacgacccggtcccgttaaccccgaaccggtaaccgggtacccccg

SEQ ID NO: 210480 - DNA, 651 bp, Homo sapiens
  misc_feature: GYAE6OF01EVDF3.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtcaagttgggtccgacacggcccctggacaaggccttgactacagtgggatggatcaacaccgacacgtacgggaaccccactatcgacccacggccttacacgtaggggtcggttttgtccttctcctagtcgggtactacccgtcgtcggtccggggtacggtctttactcgtcgcaagtaactaacccgtaaccttcaaccctgaaccgacctacttcgtaccgtttttattttagacgtagtacgtccgtcgttctgtcaggttaggtaattcggaaccttacggtcgggggacccgtaacggggtaaccccttgggtaccctacccggttccgttcccgtacgacgtacccctcccgaacccggtaccgggtacccc

SEQ ID NO: 210481 - DNA, 734 bp, Homo sapiens
  misc_feature: GYAE6OF01AIB5V.7.78.H01.1.454.CMB.1.raw
  modified_base (161)..(161): a, c, t, g, unknown or other
  misc_feature (161)..(161): n is a, c, g, or t
  modified_base (242)..(242): a, c, t, g, unknown or other
  misc_feature (242)..(242): n is a, c, g, or t
tcagcgtgtctctacacgaccggtgctcgatttagtgtgagtagtttgggtttggggacccaacaaccacacccctcctaagaagaagcccctagaccacgagctccacaccatggactggacctggaggatcctcttcttggtggcagtagcaacaggtncccactcccaggtgcagctggtacagtctgggtctgaattgagagcctggggctcagtgagcgttgcctgcaagccttcgngatacattcttcacttacttattctgtctaagttcggtccgacacggccctaggacaacggtccttagacttacgagtggatggactacaaccgaccgacacgtaccggaacccctactactcgacccgtacgtccttacacggtcggggtccgttttagtccttcaccgtagttcggtaacctcccgttagtcgggtaccggggtacgttaccttaatccgtacgaccgtaacgtaaaccttaaacccctaacccgtttaccgaaaccccgttcgggaaaccctaccgtaccgtttaccggttacccgttttttttagtttacggaacccggtaggttaccggtaccggtttccgttacgttcggtaacgtagggttagttaacgttcgttaaccggttacgggtaccgggaccggtaacgggttaccccgtggtccctacccggttactccctaaccgtcgtaccccacccgaacggtcccgggtacccg

SEQ ID NO: 210482 - DNA, 667 bp, Homo sapiens
  misc_feature: GYAE6OF01APVNE.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcgtggatacatcttcacttacttattctgtctaattgggtccgacacggcccctggacaaggccttgactacagtggatggatcaacaccgacacgtacggaaccccactactcgccacgtccttacgacgcgggtacggtttcgtccgttctccgtatcggtactaccgtcgtacggtcgggtacggtcttacgtctcgactagactaaccctaacttaccaaccgtacgaacgtacctacgttcgttaccgtttttattttaggtaacgtaggtaacgtccggttcttacgttcgttacgtagttaggtaacgttacgtacgttacggtcggggtaaccggtaccggggtaaccttccgggtccgttacccgtccgttacccgtaccgtacgtacccctacccgaacccgtaacgggtaccccg

SEQ ID NO: 210483 - DNA, 686 bp, Homo sapiens
  misc_feature: GYAE6OF01DK3XU.7.78.H01.1.454.CMB.1.raw
  modified_base (245)..(245): a, c, t, g, unknown or other
  misc_feature (245)..(245): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattggaggacgccgtggggctcagtgagcgttgcctgacagtccttcgnggatacatcttcactactttattcgtgtactaagttcgggtaccacgacggtcccctaggactaaggtccttagacctacgagtgggatggactacaacaccgacacgtcggaaccccncgtacncgccacgtccgttcgaccggggtcgtttcgtcttcctcgagtcgtactaccgttgtcggtaccgggtacgtctacgtcgtacgactaacgtaacctaacctaaccttcaaccgttgacctactacgttcgtttacgtttttaagttcgaacgtgtacgttccgtacgttccgtagtccgtaaggttacggtatttacgggaacctggggtaccgggtacccgtaaccgggtacccgttgggtaccccgtcccggttccctaccgtcccgtaacgtacccctacccgggaacccgtaacccggccctttaacccggg

SEQ ID NO: 210484 - DNA, 905 bp, Homo sapiens
  misc_feature: GYAE6OF01AMSPZ.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgattgaggagccgtggggctcagtgagtcgttgcctgcaagtccttcgtggatacattcttcacttaccttattctgtactaagttcgggtcccgacgacgggtcccctaggaaccgtaacgggtccttacggaacctaacgacgttggggtatacgggaacttaccgaaaccgacccgaacgaaccgtacgggaaacccccctaccgttacgtaccggacccgaccggtaccccttaccgaaccggtacggggttaccgttttcgttcctttccgtaccgtagtccggtaacgtaccccttcgttaccgggtaccgggggtaccgtacgtttaccgtccgttacggaccctaaacggttaaacccttaaaccccgttaaacccgtttacccgaaacccggtttaccggtaaacccggaaccgtttacccgtttcgggtttaaccccgtttttttaggttttaaccgtaaacgggttacgtacgggttcccggtttaccgtccgggtttaggacgtttaacgggttacggtaaacgtttcccgggtaaaccggtttacccggggtaccgggggtaaccccgggtaaaccggggttacccccgtttaggggtccccgttaaacccccgttttcccggtcccccgttaaccggaaccccgttccccccggttaacccccggtaaaccccggggtaaccccgggttaccccccg

SEQ ID NO: 210485 - DNA, 691 bp, Homo sapiens
  misc_feature: GYAE6OF01COBUG.7.78.H01.1.454.CMB.1.raw
  modified_base (145)..(145): a, c, t, g, unknown or other
  misc_feature (145)..(145): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggnagtagcaacaggtgcccactccaggtgcagctggtacagtctgggtctgaattggaggaagccgtggggcgtcgagtgagcgttgcctgcaagtcctctggatacatcttcactacttattctgttacaagtttggtaccgaacacggtacccctaggaacgaaacggtccttaggacttaacgagttaggataggactacaacaccgagaccgtacgggaaccccacgtactcgcccaggtccttacacggtaggtcgtttcgtctctacagtcggtactactcgtacggtacgggcgtacttatccgtagacgaacgtaaactaaacccgaacctttacgaacgtcgaaactacctacgttaccgttacgttttagttttacgaacgtaacgtcggtaccgttacgtacttggtaccgttaaggtagtaacgttagtaacccggtagggtaccggggacccgtaacggggttaacccgtcgggtaccctacccgttaccgtccgttaccaccggaccctacccgaaccggtaccgtaaccccgg

SEQ ID NO: 210486 - DNA, 780 bp, Homo sapiens
  misc_feature: GYAE6OF01DQI3W.7.78.H01.1.454.CMB.1.raw
  modified_base (638)..(638): a, c, t, g, unknown or other
  misc_feature (638)..(638): n is a, c, g, or t
tcagcgtgtctctacacgaccggtgctcgatttagtgtgagtagtttgggtttgggacccaacaaccacacccctcctaagaagaacgcccctagaccacagctccacaccatggactggacctggaggactccttcttcttgggtggcagtagacaaacgaggtcgcccactcccgaggtgcagctggtacagttcgtgggtctagtaagttgaaggaacgccgtggggctcgagtgagtcgttcgccgtgcgtaacgtccttcgtagtactactattccttactaaccttacgtttacttcgtacgttacgtaacgtttcgggtaccgtaccgtaccggtcccctaggaaccgtaacggtccttacgaactaacgtaggtggtagttacggactaaccgaaccgtaccgacgtaacccggtaccggaaaccccctacgtacgtccgacccgtacgtaccttacggaacggtcgggtttccgtttctaccgttctacgtagtacgtaccgttaccgtcgtacgggtccggtacgttcttagttccgacgtactacgtaaaccgtaaccctaccgtacaaccgtagtaaccctactccgtttagtttaccttttagttagacgtagacgtcgttcgtntacgcgttaagtacgttaacgttcgtaacggtcgggaaccgggtacccgtaacggtacccgttccggttaaccctcccgttaacccgttcccaaccgggttaccaccccccgaaacgttaccccgggtaaccggttcccccg

SEQ ID NO: 210487 - DNA, 680 bp, Homo sapiens
  misc_feature: GYAE6OF01DP8GZ.7.78.H01.1.454.CMB.1.raw
  modified_base (328)..(328): a, c, t, g, unknown or other
  misc_feature (328)..(328): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattcgggtccgacacggcccctggacaaggccttgactacagtgggatggatcaacnccgacactacgggaaccccactatcgccaggccttcacgtagggtcgttttgtccttcgtccagtggacttaccctcgttcggtcggggtaacgtctttagtctgacacgactaaaccctaacttaccaacctgaaccgtacacgttcgttaccgtttttagtttttgaacgtaacgtacgccggttacgttcctagttccgtaaggttcggtaaagtttcgaaccgttacggtaccgggggacccgtaaacgggggtaacccccgttgggttaacccgaaccccggtttccgttaccccgtacctaacccggtccccctaaccccgtaacccggaacccgggttacccccg

SEQ ID NO: 210488 - DNA, 708 bp, Homo sapiens
  misc_feature: GYAE6OF01ATG6Y.7.78.H01.1.454.CMB.1.raw
  modified_base (333)..(333): a, c, t, g, unknown or other
  misc_feature (333)..(333): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaagttgggtccgacacggcccctggaccaaggccttgactacatgggatggatcaacaccganacgtacgggaacccccactatcgcccgaggtcccttacacgtacgggtccggttttcgtccttcctccagttcggactacccgtcgtcggtcggggtacggtctttacgtccgtgacaaggaacttaaacccaacctttaccgaaccttgacgtacgactactcgtttacccgttttatttttcggaacgtaggtacgttccggttaccgttccgttacggttacgtagggttaaccgggtaagtttccggaaccgttaaccggggtccgggggtaacccgtaaccgggggttacccccgttcgggtacccgtaccccgggttccttcccgtacccgaccggtcccccttaaccccgaacccgggtaaccccggg

SEQ ID NO: 210489 - DNA, 716 bp, Homo sapiens
  misc_feature: GYAE6OF01AW282.7.78.H01.1.454.CMB.1.raw
tcagcgtgtctctacacgaccggtgctcgatttagtgtgagtagtttgggtttgggacccaacaaccacacccctcctaagaagaagccactagaccacagctccacaccatggactggacctggaggatcctcttcttggtggcagtagcaacaggtgcccactcccaggtgcagctggtacagtctgggtctgaattgaggaagccgtggggcgtcagtgagtcgttgcctgcaacgcctttcgtggatacatcttcacttacttacttctgtctaagttcgggtccgacgacggcccctggacgaaggtccttagactacagtgggatggatcaacaccgacacgtacgggaaccccactagtcgacccgaggtcctcgacgtagggtcgtttcgtcttctcctagtcggtacttacccgtcgtcgggtaccgggtacggtaccgtttagtccgtcgactaacggtaaccttaaaccccgaaccctttaccgaaacccgttcggaaccgtaccgaccgtttacgtttacccgtttttagttttacggtaaccgtaggtacggttacggttccgttacttgttaccgtaggttacggtaacgttcgtaaaccgttaccggtacggggtacccgaagggttaaccccggttcgggtaccctacccgttcccgtaccgtcgtaacccgtccccgtaccgaacccggtaacccgggg

SEQ ID NO: 210490 - DNA, 585 bp, Homo sapiens
  misc_feature: GYAE6OF01BKYK3.7.78.H01.1.454.CMB.1.raw
  modified_base (380)..(380): a, c, t, g, unknown or other
  misc_feature (380)..(380): n is a, c, g, or t
  modified_base (479)..(479): a, c, t, g, unknown or other
  misc_feature (479)..(479): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggccctggacaaggccttgactacatgggatggatcaacacgacactcgggaaccccactatcgcccaggccttcacgagggtcgtttgtcttcnctagtcggataccctcgtggtcgggacgtcttatctgcagactaaccaaccttcaacctgacacactcgtcgttttatttcgacgagtacgtcgtcgtntcgtcgtaggtggtaactggtactacggtcggggaccgtagggtaaccttcgtcggtccctaccggttcctcctacgaccgtcccctaccgaaccggtaacccggg

SEQ ID NO: 210491 - DNA, 596 bp, Homo sapiens
  misc_feature: GYAE6OF01B4MLZ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtctaattgggtccgacacggcccctggacaaggccttgactacagtgggatggatcaacaccgacactacgggaaccccacctactcgcccgacggtccttcgacgagggtcggttttcgttcttctccagtggactaccgtctggtccggggacgtcttactctgcagtaactaacctaccttaccaacctgacgactacgtcgttacgttttatttgtacgagtacgtcgtcgttctgtctaggtgtattcggtactacggtcgggccgacgggtaccctggtccaccgttcctcctacgacgaccctccgacccgacggtcccg

SEQ ID NO: 210492 - DNA, 709 bp, Homo sapiens
  misc_feature: GYAE6OF01A8OX6.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatactatcttcacttacttattctgtcaattgggtccgacaggcccctggacaaggccttgactacatgggatggatcaacaccgacactgggaaccccacctatcgcccaggccttcacagggtcggtttcgtcttctccagtggactaccttcgtcggtcgggtacggtctttacgtctcggacgacgtaaccgtaaccctaacccttaccaacccgtacggtacccgtaacgaccgtttcggttaccgttttttaacgttttacggtaaccggtaacgtaacgtccggttccgttacgttcggttaccgttaggtacggttaacgttacggtaccgttaaccggtccggggggtaacccggtaaccggggttaccccgttcggggtaccccgttcccgttaccccgttacccgtacggtacccgtcccccgttaacccgacccgggtaacccgggtaccccg

SEQ ID NO: 210493 - DNA, 815 bp, Homo sapiens
  misc_feature: GYAE6OF01DWWFZ.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggaagccgtggggcgtcagtgagtcgttgcctgcaagtccttcgtggatacatcttcacttacttattctagtactaagttcgggtacccgacgacggtccccgtaggaaccaacgggtccctttagaacctaacgagtaggggagttcggactaccgaaacgacccgaacaccgtacgggaacccccaccgtatcgacccacggtccttacgacgtacgggtcgttttcgtccttccgtcctagttcggaacttacccgttcgttcgggttaccgggggtaccggttacctttacgtaccgttacgggaacctaaacggtaaccttaaaacccccgtaaacccttttacccgaaaccccgttggaaacccgtaacctaccgtttaccggttttaccgtttttttaacgtttttacgggaaccggtaaggttaccggtacccgtttccgttacgttacggttacgtaaggttggttaaactttcgggaaaccgttccgggtaggggaccccgtaaaccggggttaacccccgttgggtacccctaaccccggttcccttaccccgtacgaaccccggtcccccttaaacccgaaccccggtaaccgggtaccccc

SEQ ID NO: 210494 - DNA, 781 bp, Homo sapiens
  misc_feature: GYAE6OF01C0YTM.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttcgtggatacatcttcacttacttattctgtcaagttcgggtaccgacgacggtccccgtaggaccgaacggtccttacggaactacgagtgggactaggactacaaaccgaccgacaaccgtaccgggaaaccccctacgtaacgtccgacccgtaacggccctttacgaacgtacggggttccggttttcgtcctttccgtaccgtagttacggtaacttacccgttcgtcgggtaccggggtaccggtactttacgtccgtagtaccgaaggtaaccttaaaccctaacccgtttaccaacccgttagaaccgtaacctaacttccggtttaccgtttttacgtttttacggtaaccggtaaggtaaccggttccgttaccggttccgttacggttcgttaaccggttaggtaacgtttacgaccgttaccgggtcggggtaccccgtaacgggtaccccgttgggtaccccgtacccgttcccttacccgtacgtaccgtaccccgttaacccgaacccggtaaccgggtacccccg

SEQ ID NO: 210495 - DNA, 595 bp, Homo sapiens
  misc_feature: GYAE6OF01C7FW4.7.78.H01.1.454.CMB.1.raw
  modified_base (450)..(450): a, c, t, g, unknown or other
  misc_feature (450)..(450): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattcggtccgacaggcccctggacaaggccttgactacatggatggatcaacaccgaacacgtacgggaaccccacctatcgcccaggcccttcacgtagggtcggtttgtcttctccatggacttacctgtgtcgggacgtcttatctgcagactaaccaaccttcaacctgaccgacncgttcgttccgttttattttcgacgagtacgtcgtcgtcgtgtcaggttagacgttgaccgtacggtggggacccgtacgggtaacccttcgggtccacccggttcctaccctcgacgtccctacccgacccgaacgggtacccc

SEQ ID NO: 210496 - DNA, 881 bp, Homo sapiens
  misc_feature: GYAE6OF01C4K0W.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtcgcccactcccaggtgcagctggtacagtcgtgggtctgtaagttgaaggagccgtggggcgtcagtgagtcgttcgccgtgacaagtcccttgtaggaactactattcctttacaactttaactttattctacgttacgtaagttcgggtaccgtacgaaccggtccccgtaggaaccgtaacggtccgttacgtaaccgtacgaaggttggggagtacggtaacgtaaccaaaccgaacccgtaaccaaccggttaaccggggaaccccctaaccgttaacgtaccggaccccgtaacggttaccccgttaccaaaccggggttacggggttaccgggttttacgttcccgttacctacccgtacgttacggtaaccgtttaacccgtacggttaccgggttaccggggtaccgggttactttaaccggtacgttacgaaccgtaaacgttaaccgttaaaaccccttaaaccctttaacccggaaacccgttacggaaaccccgtacgtaccgtttaccggttttaaccgtttttaacggttttaccgtaacggtacggtaccgttacccggtttaccgtacgttacggtacggtaagttacggttaaacgttcggtaaaccgtccgggttacgggtaccccgtaacgggtaacccttcgtaccccgtaccggtccctaccgtacctacgaccccttacccgaacccgtaccggtacccg

SEQ ID NO: 210497 - DNA, 638 bp, Homo sapiens
  misc_feature: GYAE6OF01C85NR.7.78.H01.1.454.CMB.1.raw
  modified_base (360)..(360): a, c, t, g, unknown or other
  misc_feature (360)..(360): n is a, c, g, or t
  modified_base (404)..(404): a, c, t, g, unknown or other
  misc_feature (404)..(404): n is a, c, g, or t
  modified_base (520)..(520): a, c, t, g, unknown or other
  misc_feature (520)..(520): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtcgtgggtctgaattgaggaagccgtggggcgtcagtgagcgttgcctgcaagccttctggatacatcttcacttacttattctgtacaagttcggtccgacacggccctaggacaggccttcgaactacgagtgggatggactacaacaccgacacgtacggaaccccactancgccgagtcctcgacgggtcgttgtcttctcagtgtactccgtntcggtcgggacgtctactcgtcgacaacgtaactaacctaaccttacaactacgtaccgaactacgttcgttaccgttttattttacgaacgtaggtacgtcgttccgttgtcgtntacggtggtaacttcgtacgttcggtaccgggtactaacccggggtaacccgtggtacctcccgtccgttcccgtacgtacccgtaccctacccgaaccgaacccggggtccctacgg

SEQ ID NO: 210498 - DNA, 602 bp, Homo sapiens
  misc_feature: GYAE6OF01BQKSL.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcagtgagcgttgcctgcaagccttctggatacatcttcacttacttattctgtcaattgggtccacaggccctggacaaggccttgactacgatgggatggatcaacaccgacactacgggaaccccactagtcgcccaggccttacacgagggtcgtttcgtcttcgtcctagtgactacctcgtggtacggggacgtcttacgtctgactagtaactaaccctaccttacaccgtagaccgaactacgtcgttaccgttttatttcgaacgtagacgtcgttcgtcgtgtactggtagtaattcgagtcggtcgggtaccgagggtaccctcggtccaccgttccgtccctacgacgtacctccccgtaacgacggtaccccg

SEQ ID NO: 210499 - DNA, 822 bp, Homo sapiens
  misc_feature: GYAE6OF01C2HMD.7.78.H01.1.454.CMB.1.raw
tcagcgtgtctctacacgaccggtgctcgatttagtgtgagtagtttgggttgggacccaacaaccacacccctcctaagaagaagcccctagaccacagcctccacaccatggactggacctggagatcctcttcttggtggcagtagcaacaggtcgcccactcccaggtgcagctggtacagtcgtgggtctagaattggaggaagccgtggggcgtcagtgagcgttgcctgcaagtccttcgtggatactatcttactacttactttattcgtagttactaaggtttccgggtacccgaacgaccggtccccgtagggaaccaacgggtccttagaacctacgtagtggggtataggactaccgaacgaccgacaccggtaccggaaccccacgtactccgacctacggtccttacgaacggtacgggttcgttttcgtccttacgtaccgtagttacggtaacctttacccgttcggttaccgggttaccggggtacgtttacctttaacgtcggttacgaccgtaaacggttaaaccctttaaaccccgtaaccttacccggtaaccgttacggaacccgtaaccgtacgttttaccggttttaacccgttttttaagttttccgggaaacgtacggttacggttcccggtttacgttcgtacggttacgttaaggtttacggtaacgtttcggtaaaccggtccgggtacggggaacccgttaacgggtaaccccgttcggtaaccccgttcccgttaccgttacccctacggtaaccccgtcccctaaaccccggaccggtacccggtccccg

SEQ ID NO: 210500 - DNA, 573 bp, Homo sapiens
  misc_feature: GYAE6OF01C46XD.7.78.H01.1.454.CMB.1.raw
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (405)..(405): a, c, t, g, unknown or other
  misc_feature (405)..(405): n is a, c, g, or t
  modified_base (432)..(432): a, c, t, g, unknown or other
  misc_feature (432)..(432): n is a, c, g, or t
  modified_base (449)..(449): a, c, t, g, unknown or other
  misc_feature (449)..(449): n is a, c, g, or t
  modified_base (461)..(461): a, c, t, g, unknown or other
  misc_feature (461)..(461): n is a, c, g, or t
  modified_base (484)..(484): a, c, t, g, unknown or other
  misc_feature (484)..(484): n is a, c, g, or t
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttcnggatacatcttnactacttattctgtcaattgggtcacaggcccctggacaaggccttgactacatggatggatcaaacaccgacaacgtcgggaaaccccactactcgcccaaggccttacgaacgagggtcgtttagtcttctcgtatgggactacctntacggtcgggacggtcttatcgtgcanaacttaacccaaccttnaacctgacaacnctcgtccttttattttgacgagngtccgtacgtngtnacgtggtattgacgtacgtgggccgtaaggaccctggcctaccgtctccgtccacgccctacaccgacggtcccg

SEQ ID NO: 210501 - DNA, 862 bp, Homo sapiens
  misc_feature: GYAE6OF01BKKVV.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtcgtgggtctgaattgaggaagccgtggggcgtcaggtgagtcgttgcctgactaacgtcctttcgtggaactacacttcttaccacttactttattccgtgttaccgtaagttcggggttacccgaccgaccggtcccccgtagggaaccgaacggtcccctttacggaccttaaccgtaggttacgggggtatcgggaacttaccgaaacccgtacccggaaccgaacccggttaacccggggtaaacccccctaaccgtaacgttaccccgggaccccgttaaccggtaccccctttacgaaacccgggttacgggggttccggtttttaccgtccctttaccgtacccgttaagtcgggtaaacctttacccgttcggttacgggtccggggtaccgttacgttacttcgtacggaccgtaagtaaaccgtaaccctaacccgttacctaacccgtacggtaacccgtacctaccgtttacgtttacccgtttttagtttttaccgggaacggttacggtacgttccggtttcgttacttggttacgtacggttagggtattaccggtacggtacggttccggggaacccgtacgggtaccccgttacggttaccctcccggttacctccccgtacgaccccgtacccgtacccgtaaccggacccggtcccg

SEQ ID NO: 210502 - DNA, 1014 bp, Homo sapiens
  misc_feature: GYAE6OF01B96BL.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgactaacgtccttcgtaggactactacttccttacaactttactttacttcgtacgttacgttaaggttcggggtacccgacgtaccggtaccccgtagggaaccgtaaccgggttcccttacgtaaaccttaccggaagggttcggggtaacgttacgggtaaacctacccgaaaaacccggtaacccggtaacccgtaacccgggtaaccccggggtaaaacccccctaaccgttaaccggtaccccggtaccccggtaacgggtttacccccgtttaaccggaaaccggggtaaccgggggttttccgggtttttaccggtttaccctttaccccgttaccgtaacgggtttaccgggttaacctttaaccccggttccgggtttacggggttaccccgggggtaaccgttaccgttttaaccgttccgttaggtaacccgttaaacgtaaacccgtttaaaaccccgttaaaccccgtttaacccgtaaacccgttaaccggtaaacccgtaaccgttaccggtttaccgttttaaccggttttttaacggttttttacggaaaccggttacgggttaaccggtcccggtttaccgtttacgggttacgttaacggttaacgggtttacggttaaacgtttccggtaaaccgttaccgggggttaccgggtaccgggtaaacccgggttacccggttaccgggtcccgtaacccgtttcccgtacccgtaccgtacccggtacccctacccggtaacccggtaacccgggtaaccccg

SEQ ID NO: 210503 - DNA, 645 bp, Homo sapiens
  misc_feature: GYAE6OF01AT596.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaacgccttctggatacatcttcacttactttattctgtctaagttgggtccgacacggcccctggacaaggccttgactacagtgggatggatacaacaccgacacgtacgggaaccccactatcgcccaggtccttcgacgtacgggtcggtttcgtccttctccgtagtcggtactacccgttcgtcgggtccgggtacgtctttactcgtcgcaacgtaactaaccctaaccttacaacccgtcgacgacctacgttcgttaccgtttttatttacggtaacgtacgtacgtccggttcgtaccgttgtacgtaggtgtaacgttcgacgttacggtcgggaccgtacgggtacccgtggtccctaccgtctcccgtacaccgaccctcccaaccgtccggtacccg

SEQ ID NO: 210504 - DNA, 660 bp, Homo sapiens
  misc_feature: GYAE6OF01A188I.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacaccgacactcgggaacccccactatcgcccaggccttacacgaggggtcggttttgtcctttctcccagtggacttacccgtcgttggtccggggtaacggtctttaactcgtgctaacgtaactaaaccctaacctttaccaaacccgttcgaacgacctactcgtcccgtttttaagttttcgtaacgagtacgtcgttaccgttcgtgtcaggtaggtaacttcggaacttaccggtgggggacccgtaacggggtaacccgttgggtacccgtacccggttccttacccgtaccgaccgtccccttacccgaacccggtaacgggtacccccg

SEQ ID NO: 210505 - DNA, 795 bp, Homo sapiens
  misc_feature: GYAE6OF01BDK93.7.78.H01.1.454.CMB.1.raw
  modified_base (446)..(446): a, c, t, g, unknown or other
  misc_feature (446)..(446): n is a, c, g, or t
  modified_base (733)..(733): a, c, t, g, unknown or other
  misc_feature (733)..(733): n is a, c, g, or t
  modified_base (743)..(743): a, c, t, g, unknown or other
  misc_feature (743)..(743): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtcgcccactcccaggtgcagctggtacagtctgggtctgaattggaggaagccgtggggcgtcaggtgagtcgttcgcctgacaacgtcctttcgtggtaactactacttcctttaccaacttaaccttttatttccttcgttactaagtttcggggtacccgaaccgaccggtcccccgtaggaaccgtaacgggtccctttacgaacctacgtagttaggggtagtacggactaccaaacccgaaccggaaccgaaccgtaacccgggaaaccccctaaccgttacnccggaccccgacggtccccttaccgaccggtacgggttcggttttcgttccgttcctacctagtcggtaaccttacccgttcgttcgggtaccggggtcggtcctttactccgtagtaccgaacgtaaccttaaaccctaacccgtttaccaaacccgtaggaacccgtaacttaccgttacggttttaccgtttttacttttacggaacggtaacggtcgtccgttcgttcgtgtcgtaagtagtaagttcgtacgttaccggcgggtaccgaacgggttaccccngggtaccccnccgttccctacgtccgtacccgtaccccaccgaacccggacccggtaccccg

SEQ ID NO: 210506 - DNA, 614 bp, Homo sapiens
  misc_feature: GYAE6OF01B278K.7.78.H01.1.454.CMB.1.raw
  modified_base (567)..(567): a, c, t, g, unknown or other
  misc_feature (567)..(567): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggctcagtgagcgttgcctgcaagtccttctggatacatcttcacttacttattctgtcaagttcgggtccgacacggcccctggacgaaggtccttgactacagtgggattgggacttcaacgaccgaacacgtcgggaaaccccactagtcgcccacggccttacacgacgggtcggtttcgtccttctaccattcggacttaccgtcgtcggtcgggacgtcttatctgctagacttaaccacttacaacctgacactacgtgttaccgttttatttcgtacgagtagtcgtcgtctgtactaggttagtaattcgacgtacggcggggtacccacggggtacctcgggtaccncccggttctacccgtcgaccgaccctcccgaacggtcccgggtaccc

SEQ ID NO: 210507 - DNA, 564 bp, Homo sapiens
  misc_feature: GYAE6OF01CZ44K.7.78.H01.1.454.CMB.1.raw
  modified_base (348)..(348): a, c, t, g, unknown or other
  misc_feature (348)..(348): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattggaggaagcctggggcgtcagtgagcgttgcctgcaagccttctggatacatcttcactacttattctgtcaattggtccgacacggccctggacaggccttgactacagtggatggatcaacaccgacacgtcgggaaccccactancgcccaggccttcacgacgggtcgtttcgtcttctccagtggactaccgtcgtggtcgggacgtcttactcgtgcagactaaacctaccttcaacctgacacacttcgtcttttattttcgacgagacgtcgtcgtgtgtcaggttgaattcgactacgtgggaccacgggtaccctggtcccaccgtctccgtcacgccctaccacgcggtaccc

SEQ ID NO: 210508 - DNA, 852 bp, Homo sapiens
  misc_feature: GYAE6OF01DQ8Z2.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcgagtgagcgttgcctgcaagccttctggatacatcttcacttacttattctgtctaagttcgggtccgacacggcccctggaaccaggccttgactacagtgggatggatacaacaccgacgaccgtacgggaaccccctacctactcgaccccgtacggtcccttacgaacgacggggtcggttttacgttccgtttcctaccgtacgttacggtaaccttaacccgttcggttacgggttaccgggggtaaccggttccttttaacgttcccgttacgggaaccttaacggtaaaccttaaaaccccgttaaacccctttacccgtaaaacccggtcggtaaaaccgtaacccgttaacccgtttacggtttacccgtttttttaagttttttaccgggtaacggtaaggttaccggttccggttaccggtttaccgttacggttaccgttaagggtttacggttacgttttaccggtaaccttaccggggtcgggggtaaccccggaaaccgggggttaaacccccggtttcgggtaacccgttaccccggtttcccgttaacccccggttcgaacccccgggttacccccttaaccccggtaaacccgggtaaaccccggggtaccccc

SEQ ID NO: 210509 - DNA, 826 bp, Homo sapiens
  misc_feature: GYAE6OF01CP7M4.7.78.H01.1.454.CMB.1.raw
  modified_base (246)..(246): a, c, t, g, unknown or other
  misc_feature (246)..(246): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttgggtggcagtagcaacaggtgcccactcccaggtgcagctggtacagtctgggtctgaattgaggagccgtggggcgtcagtgagtcgttgcctgcaagtccttcgnggatacattcttcacttactttattctgttactaagttcgggttaccgacacggccctggaaccaggtcctgaactacagtgggatggatacaacaccgacaccgtacgggaaccccctaacgtactcgaccccacggtcccttaccgaacggtacggggttcggttttacgttccttacctaccgacgttagggtacctttaacccgttcggtcggttaccggggtacgttaccgtttacgtccgtaggtaccagttaaaccctaacccgttaaacccgttacctaaacccgtacggaaacccgtaacgtacccggtttacggttttaacccgtttttacgtttttaacgggttacgtaaaccggggtacgttacccggggtttaccgttccggttagggttaccttaggggtttaacggtaacgttttacgggtaaacccgttaccgggtacgggggtaacccggtaaaccggggtaaccccggtttacgggttaccccttacccgggttccctttacccggtcccggtaacgttcccccgtaccccgggtaaaccggttaaccccggggtaaccccc

SEQ ID NO: 210510 - DNA, 764 bp, Homo sapiens
  misc_feature: GYAE6OF01AFMG7.7.78.H01.1.454.CMB.1.raw
  modified_base (317)..(317): a, c, t, g, unknown or other
  misc_feature (317)..(317): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcagccttctggatacatcttcacttacttattctgtcaattgggtccgacacggcccctggacaaggtccttagactacatggganggatacaacaccgacactacgggaaccccactatcgcccacggtcctcgacgacgggtcgtttcgtcttctctagtcggtactacctcgtcggtacgggacggtcttactcgtacgactaagtaactaacccgtaaccttaccgaacccgttacgaaccgaccgtaccgtacggtttacccgttttttaacgtttttaccgtaacggtaaccggttacggttaccggttaccggttccgttacggttaccgttacggggttacgttaaacgtttccgggaaacgtttaccccgggttagggggtacccccggttaaacggggggtaaccccccgtttacggggttacccccgttaaaccccgggtttacccttaccccccggttacgtaacccggttacccccgtaaacccccgtaacccggtaaaccccgggggttaacccccccg

SEQ ID NO: 210511 - DNA, 856 bp, Homo sapiens
  misc_feature: GYAE6OF01CVZFI.7.78.H01.1.454.CMB.1.raw
  modified_base (223)..(223): a, c, t, g, unknown or other
  misc_feature (223)..(223): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtgcagtagcaacaggtgcccactcccaggtgcagctggtacagtcgtgggtctagaattggaggacggccgtggggccgtnagtgagtcgttcgccttggcaaacgtccttacgtggactactattacttctaacttactttatttcgtagttactaagtttcgggtacccgtacgtaccgggtccccttagggaaccgtaaacggtccctttaggaacctaacgtaggtacggggtacgttacgggtaacttaccgaaaaccggtaaccccgtaacggtaacccggttaaccgggaaacccccctaaaccgttacgtcggaaccccgtacggtacccttaccgaacgggtacggggttcggtttttacgtaccgtttccgtaccgtacggttacggtaacctaccgttcggttacgggtaccgggttacccgggttacttacggttccgtacggtaacgtaaaccgtaaaccgttaaaccctaacctttaacccgaaccgttacgaacccgtactaccgtttcggttttaccgtttttaagtttaccgtaaggaccgtacggttccgttacgttcgtacgtacgtaacggttagtacgttacgtaccggtacggtacggggtacccgtaaacgggtcccgttaccggtcccgttaccggttacctcccgttacgcccggtaaccctacccgggtaccgaacccggggtacccc

SEQ ID NO: 210512 - DNA, 648 bp, Homo sapiens
  misc_feature: GYAE6OF01A2YZ8.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtcaattgggtccgacacggtcccctggacaaggccttgactacagtgggatggactcaacaccgacacgtcgggaaccccactagtcgacccacggtccttcgacgacgggtcggtttagtccttctccagtcggactaccgtctggtcgggacgtcttaacgtctcgactagtaactaaccctaacttacaacctacggaacctacgtaaccttcgtacccgtttttaattttacggtaacgaggtaacgtccggttcgttccgttgtccgtaaggtcgtaacgttgtaccgtacggtacgggccgtaaccggggtacctcgggttcccacccggttctcctccgacggtcccctaccgaaccgtaccgggtaccccg

SEQ ID NO: 210513 - DNA, 572 bp, Homo sapiens
  misc_feature: GYAE6OF01DV9U6.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaagttggtccgacaggcccctggacaaggccttgactacatgggatggatcaacaccgacacgtgggaaccccactatcgcccaggccttcacgagggtcggtttgtccttctccagtggactacctcgtggtcgggacgtcttatctgcagtactaacctaactcaacctgacgtacactcgtcgttttattttacgtacgaagtcgtcgtcgtctgtcagtgtaattgtactcggtgggacctacggggaacccttggtccaccgttctaccgtccacgtccctacgccgaacgggtccc

SEQ ID NO: 210514 - DNA, 698 bp, Homo sapiens
  misc_feature: GYAE6OF01DO3GU.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggctcagtgagcgttgcctgcaagccttcgtggatacattcttcactacttattctgtcaagttgggtccgacacggcccctaggacaaggccttgactacagtgggatggatccaacaccgacaccgtacgggaaccccctacctagtcgacccacggtccctttacgacgtacggggtcggttttcgtccgttctccctagtcgggtaacttacccgttcgtcgggtaccggggtaccgtactttacgtccgtggaccaaggtacctaaaaccctaaccttccaaacccgtgaacccgacctacttcggttaacccgtttttattttacgggaacgtacggtacgttccggttacgttcttaggtactaggttacggtaatttcgaccgttacgggtcggggacccgtaaccggggtaaccccttggtacccgtacccgttcctaccgttccgacgtcccctaacccaccggtaacggtacccccg

SEQ ID NO: 210515 - DNA, 852 bp, Homo sapiens
  misc_feature: GYAE6OF01APM06.7.78.H01.1.454.CMB.1.raw
tcagcgtgtctctacacgaccggtgctcgatttagtgtgagtagtttgggttgggacccaacaaccacacccctcctaagaagaagcccctagaccacagctccacaccatggactggacctggaggatcctcttcttggtggcagtagcaacaggtgcccactcccaggtgcagctggtacagtctgggtctgattagaggaagcctggggcgtcagtgagcgttgcctgcaagccttctggatacatcttcacttacttattctgtcaattggtccgacacggcccctggacaaggccttagactacatggatggatcaacaccgacgactcgggaaccccaccgtactcggccccaacggccctttacgaccgacggggtaccggttttcgtccgtttctacccgaagtacgggtacttaacccgtcgttacgggttaccggggtaacgggtcctttaacgttccgttacggtacctaacggtaaaccttaaacccccgtaaacccgttttaccaaaccccgtcggtaaacccggtaccgtaaacccgtttcgggttaaccccggttttttttaacgttttttaccgggttaaacccgggtaacgggttaacgggtacccggtttccgggttaccgttttacgggttaccgttaacggggtttacgggttaaaaccgttttccgggtaaaccgttaaacccgggttcgggggggtaaccccctaaccgggggggttaacccccgttcggggttaaccccgtaccccgggttaccccgtttccccgtaacccggtacccgttaccccccggtaacccggtaaaccccgggtaaaccgggggttccccccg

SEQ ID NO: 210516 - DNA, 729 bp, Homo sapiens
  misc_feature: GYAE6OF01CKLSU.7.78.H01.1.454.CMB.1.raw
  modified_base (241)..(241): a, c, t, g, unknown or other
  misc_feature (241)..(241): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggaagcctggggcgtcagtgagcgttgcctgcaagtccttnggactacatcttcactacttattctgtcaattcgggtccgacacggccctaggacaaggtccttgactacagtgggatggatacaacaccgaacacgtacgggaaccccctacgtactcgaccccaggtcccttacgaccgtaggggtccgttttcgtacgttctacccgtagtcgggtaacttacccgtcgttcgggtaccggggtacggtacctttaagtccgtaggacctaaagtaaccttaaacccgtaacccttaccgaacccgtacgaaccgtaacctaaccgtttcgttaccgtttttaacgtttttacggaacgtaacggtacgttaccggttacgttcgttacggtacgtaaggttacggtaaacttcgtaaccgtacggttacggggacccgtaacgggtaaccccgttcggtacccgtacccgttccgtacccgtacgtaccgtaccccgtccgtaaccccggtaacgggtaccccc

SEQ ID NO: 210517 - DNA, 771 bp, Homo sapiens
  misc_feature: GYAE6OF01BWFIV.7.78.H01.1.454.CMB.1.raw
  modified_base (358)..(358): a, c, t, g, unknown or other
  misc_feature (358)..(358): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggaagcctggggctcagtgagcgttgcctgcaagccttcgtggatacatcttcactattattctgtcaattgggtcccgaacacggcccctaggaacaagggccttggaactacagtgggatggatccaacaccgacacgtcgggaaccccacttancgacccaggtccccttcgaacgtacggggtcgttttacgtcctttccgtcccgaagtcgggtaacttacccgtcgtcgggttaccggggacgtacctttaatccgttacgacctaaaggtaaccttaaaaccccgtaacctttaccgaaacccgtggtaaaccgaccgttacgttacggttacccgttttttattttacggtaacgtaaggtacggtccgttaccgtcgtacggtttaacgacggttacgggtaactttcgtaacccgttaacgggttaccggggggtaacccctaaacgggggttaaccccccgtttacgggggttaccctacccccgggtttacccgtaaccccgttaccgaccggtaccccctttaccccggaaacccggtaaccggggtaacccccccg

SEQ ID NO: 210518 - DNA, 687 bp, Homo sapiens
  misc_feature: GYAE6OF01AKADH.7.78.H01.1.454.CMB.1.raw
  modified_base (242)..(242): a, c, t, g, unknown or other
  misc_feature (242)..(242): n is a, c, g, or t
tcagcgtgtctctacacgaccggtgctcgatttagtgtgagtagtttgggtttggggacccgaacaaccacaccctcctaagaagaagccctagaccacagctccacaccatggactggacctggagtatcctcttcttggtggcagtagcaacaggtgcccactcccaggtgcagctggtacagtctgggtctgaattgaggaagcctggggcgtcagtgagcgttgcctgcaagccttcnggatacatcttcacttacttattctgtcaattgggtccgacaggcccctggacaaggccttgactacatggatggatcaacaccgacactcgggaaccccactatcgcccacggccttacacgaggggtcggttttacgtcctttcgtccagttcgggaacttacccgttcgttcggtacggggtaccgtctttaatccgttgactaaggtaaccttaaacccgaaccctttacgaacccgttggaacccgtaccacgttcggtacccgtttttaatttttcggaacggtgtaacggtcgttcgttccgttaggtcgtaggttaggaactttcggaacgttaccggtcgggggacccgtaacggggtaaccccttgggtacccgtaaccccgttctaccccgttcgacgtaccccctacccgtaacccggtaaccggggtccccc

SEQ ID NO: 210519 - DNA, 790 bp, Homo sapiens
  misc_feature: GYAE6OF01BQXF0.7.78.H01.1.454.CMB.1.raw
  modified_base (364)..(364): a, c, t, g, unknown or other
  misc_feature (364)..(364): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggagatcctcttcttggtggcagtagcaacaggtcgcccactcccaggtgcagctggtacagtctgggtctgaattgaggaagccgtggggctcagtgagcgttgcctgcagtccttgtggatacatcttacacttactttattctgtactaagtttcgggtacccgacgtacgggcccccttaggaacctaacggtcctttaggaacctacgtagtggggattggataccaacgaccganaccgtccgggaaaccccacttagccgacccgaggtcccttacgacggtaggggtcgttttcgtcctttccgtcgtaagttcggaacttacccgttcggttacgggtaccggggaccgttactttacgttccgtacggactaacgtaaaccttaacccgtaacccttaccgaacccgttcggaaaccctaccgtaccggtttgtttacccggttttttaagtttttccggaaacggtacggtaccggttccgttaccgttacgttacggttaccgtaagggttcgttaaacgtttccgggtaaccttacgggtaccggggtacccgtaaaccggggttaacccctcggggttacccctacccggttcccgttcccttaccggtacccgtaacccccgtacccggtaaacccggaccggggtaccccc

SEQ ID NO: 210520 - DNA, 709 bp, Homo sapiens
  misc_feature: GYAE6OF01DDX9X.7.78.H01.1.454.CMB.1.raw
  modified_base (487)..(487): a, c, t, g, unknown or other
  misc_feature (487)..(487): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtcgtgggtctgaattggaaggaacgccgtggggcgtcgaggtgagtcgttcgcctgacgaacgtccctttcgtggaactacctacttcttcaacttactttacttctgttactaacggttcggggtcccgaacgaccgggtccccgtaggaaccgaacggtccttacgaactacgagtgggatggaactccaaccgaccgacgaccgtaccgggaacccctacctacgtcgcctacggccttacgacggtacgggtcgtttacgtctctccagtcgactcgtcgtcggtcgggcgtcttcnctgactacgtaactaaccctactaccaacgcgtaccgactacgttcgtttcgttttaacgtttcgaacgtgtacggtcgttcgttcgtcgttacgtacgggttacggttaacttcggtaaccgttcgggtaccggggtaccgacgggttaacccgcggtaccccgtaccgttctaccccgtacgacccgtccccgtaaccgaccgggtaaccggtcccccgg

SEQ ID NO: 210521 - DNA, 723 bp, Homo sapiens
  misc_feature: GYAE6OF01BWUUE.7.78.H01.1.454.CMB.1.raw
  modified_base (243)..(243): a, c, t, g, unknown or other
  misc_feature (243)..(243): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggagatcctcttcttggtggcagtagcaacaggtcgcccactcccaggtgcagctggtacagtctgggtctgaattgaggaagccgtggggctcagtgagcgttgcctgcaagccttcgnggatacattcttcacttactttattcgtgttactaagttcgggtaccgaaccgacggtcccctaggaaccgtaacggtccttacggactacgagtacggggatggaactacgaacaaccgacgacgtaccgggtaacccccactacgtcgccccgtacggtccttacgacggtacgggtcgtttcgtccttacgtacctagtacgacttaccgtcgttacgggtacgggtaccgttacttacgtcgtcggacttaacgaacttaaccctaacttaccaacccgttagaccgtaacctacgttacgttacccgttttatttacggacgtagtcgtacgtcgtctagtcaggttacgaagttcgtaacgttcgggacgggtaacccggtaaggtaccccgttacggtccccgttacccggttccttacccggtacctaaccccggtcctaaccccgaaacccggggtaacgggttacccccg

SEQ ID NO: 210522 - DNA, 773 bp, Homo sapiens
  misc_feature: GYAE6OF01DI0Z4.7.78.H01.1.454.CMB.1.raw
  modified_base (242)..(242): a, c, t, g, unknown or other
  misc_feature (242)..(242): n is a, c, g, or t
tcagcgtgtctctacacgaccggtgctcgatttagtgtgagtagtttgggtttggggacccaacaaccacacccctcctaagaagaagcccctagaccacagcttcacaccatggactggacctggaggatcctcttcttggtgcagtagcaacaggtgcccactcccaggtgcagctggtacagtctgggtctgaattgaggagcctggggcgtcaggtgagcgttgcctgcaagccttcnggatacatcttcactacttattctagtcaagttcggtcccgacacggccctaggacaacggtccttagactacagtgggatggactacaacaccgacacgtacgggaacccctactagtcgaccacggtccttacggacggggtcggttttcgtcctttccgtcctagtcgggtaacttcccgttacgttcgggtaccggggtaccggtactttacgtccgtggtaccgtaacggtaacttaaacccctaaacccgtttaccgaaacccgtttacggaaccgtaacccgttacgttacggtttacccgtttttttaagtttttcgggaaccgtagggtaccgttaccggtttccgttacgttcggtaacgttacggttagggtaacgttacggtaaccgttacgggtaccgggggaacccgtaccggggtaaacccgtttcgggtaaccgtaccccggttccgttacccgtaccgtcccggttaacccccgtacccctaaacccgggaacccgggttccccgtaaccccgg

SEQ ID NO: 210523 - DNA, 785 bp, Homo sapiens
  misc_feature: GYAE6OF01BZKTB.7.78.H01.1.454.CMB.1.raw
  modified_base (252)..(252): a, c, t, g, unknown or other
  misc_feature (252)..(252): n is a, c, g, or t
tcagcgtgtctctacacgaccggtgctcgatttagtgtgagtagtttgggtttgggacccaacaaccacacccctcctaagaagaacgcccctagaccacagctccacaccatggactggacctggagatcctcttctggtgcagtagcaacaggtgcccactcccaggtgcagctggtacagtctgggtctgaattgaggaagccgtggggctcagtgagcgttgcctgcaacgtccttcgtggatacgtntacttctaacttacttattcgtgtactaagtttcgggtacgaccgtacggcccgtaggacctaaggtccttagactacgagtcgggatggactaccgaacgaccgaactaccgtaccgggaaacccctacgtacgtacgaccccgtaggtacccttaccgaacgggtacggggttcgttttacgtcctttaccgtacgtacgtacgtaacttaccgtcgttacgggtccgggtacgtctttagtccgtacgtactaaggtaacctaaaccctaaccgtttacgaacccgtacgaccgtacctacgtttccgttaaccgtttttattttaccgggacgttaaggtaccgttccggttacgttaccgttacggttaaccgtaaggttacgtaaacgtttacggttaacccggttagggttaccgggggtaaccccgtaacggggttaaaccccgttcgggttaaacccgtcccgtttaccggacccgttacgacccgttacccttaccccggaaacccgtaccgggtacccccgg

SEQ ID NO: 210524 - DNA, 733 bp, Homo sapiens
  misc_feature: GYAE6OF01CHGLV.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctgtacagtctgggtctgtaattgaggaagccgtggggcgtcagtgagcgttgcctgcaagtccttctggactacatcttactacttacttattctgtctaattcgggtccgacgacggccctggacgaacggtccgttcgactaccagtggatgactacaacaccgacacgtaccgggaacccctactacgtcgaccacggtcccttacgacggacggggttcggtttcgttcttaccgtccagttaggtactaccgtcgtcgggtccgggtacggtacttagtccgtacgactacgtaaaccttaaccccgtaaacctttaccaaaccgttacgtaacccgtaccgtaccttacggtttacccgttttttagtttacggaacgtacggtacggttaccgttcgggtacttgggtaccgtagggtacgttaacgttcggtaaccgttagggtaccggggtaaccgtaccgggggtaccccttacgggtcccgttacccgtcccttacccgtaccacccggttaccccaacccgtacccggaccgggttacccccg

SEQ ID NO: 210525 - DNA, 687 bp, Homo sapiens
  misc_feature: GYAE6OF01B7267.7.78.H01.1.454.CMB.1.raw
  modified_base (243)..(243): a, c, t, g, unknown or other
  misc_feature (243)..(243): n is a, c, g, or t
  modified_base (619)..(619): a, c, t, g, unknown or other
  misc_feature (619)..(619): n is a, c, g, or t
  modified_base (650)..(650): a, c, t, g, unknown or other
  misc_feature (650)..(650): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggagccgtggggcgtcagtgagtcgttgcctgactagccttcnggatacatcttcacttacttattctgtctaagttcgggtccgacgacggtccccgtaggacgaacggtccacgttttttaacacgtagtacgggatggtactaccgaaccgaccgaaccgtaacgtaccgggaacccctaaccgtaacgtccgacccgaacggtcccgttaccggaccggggttcggtttcgtccgttctaccgtagtcggtacttaccgtcgtacggtaccgggtacgtccttagtcgtacgactaacgtaactaaacctaaccgtaacctaaccgtacgtaccgacgtacgtacgttaccgttttagtttcgtaacgtagtaacgtccgttctcgttcgtacgtagtaggtatcgagttacggnggaccgtacggtaccgtcgtaccgtccgtcnccgtacacgtacccgaccaccgtaccgccgttacccg

SEQ ID NO: 210526 - DNA, 804 bp, Homo sapiens
  misc_feature: GYAE6OF01E4VPK.7.78.H01.1.454.CMB.1.raw
  modified_base (245)..(245): a, c, t, g, unknown or other
  misc_feature (245)..(245): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagtccttcnggatacatcttcacttacttatctgtctaagttcgggtccgactacggcccctgggaccaaggtccttgacctacgagtgggatggactacaaccaccgacgaccgtacgggaaccccctactactcgcccaacggtcccttacgacggtacggggtccggttttacgttcctttccgtaccgtacgtacgggtaactacccgttcgttcgggtacccggggtacggtccttagttccgtacgaccgtaaagtaaccttaaaccccgtaaccctttaaccgaaaccccgttacggtaaacccgtaaccctaaccggtttccggtttaacccgtttttttaagttttaccgggtaacggtaacggtaacggtcccggtttacgttcgttacgtacgtaagggttaggtaaacgtttcgtaaccgtttaccgggtaccgggggtaacccgtaaccggggttaccccgttacgggttaccccttaacccgggtcccttaccccgtacccgacccggttacccccgtaccccgtaaacccgggtaaacccgggggttaccccc

SEQ ID NO: 210527 - DNA, 771 bp, Homo sapiens
  misc_feature: GYAE6OF01EAIQ7.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttacacttacttattctgtcaattgggtcgtacaggcccctggacaaggccttgactacatgggatggatacaacaccgacacgtacggaacccctgaaccctatacgtacccgaacggccgtttctaaccgacggggtaccgggtttcgttaccgtttccgtaccctaacgtcggtaacggttacccgttaccgttcggttaccggggtacccgggtaccgtttaacttacgtcgtaccgaaacggtaactaaacccgtaaccctttaacccgtaaacccttacggtaacccgggtaaccttaaccgttacgttacccgtttttaacgttttttacgttaaccgtaacggtacggtaccgttaccgttacggttcgttcgtacggttagtaagttacggtacctaacgggttccgggtaccgggtaacccgggtaaccccggttccggttaccggtacccgttacccgttcccgttacccaaccggtcccctacccgtaaccccggtaaaccccgggg

SEQ ID NO: 210528 - DNA, 918 bp, Homo sapiens
  misc_feature: GYAE6OF01AX61L.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtcgcccactccaggtgcagctggtacagtctgggtctgaattgaggagccgtggggctcagtgagtcgttgcctgacaacgtccttcgtaggtactactatcttacacttacttattctagttactaagttcgggtaccgaaccgtaccggtccccgtagggaaccaacgggtaccctttaggaaccttaaccggaaggttagggggaacttaggggtaacttaacccgaaaaccgaacccggtaaccgtaaaccgggttaacccggggtaaaacccccctaaccgttaaccggtacccggtaaccccggtaaccgggttacccctttaaccggtaaccgggtaacggggggtttcccgggtttttaccggttacccttttacccggtaacccgttaaggtttaccggggttaaaccctttaccccggttaccggtttcgggggttaacccgggggtaaccggtttacccttttaacggtccgttacggtaacccgtaaacggtaaaccctttaaaaccccgtaaccctttacccgaaaccgtcggaaaccgtacctaacgtttcggtttaaccgttttttaagtttacgggaacgtaggtaccgttaccggttccgttacttcggacgttaagggtacggtaactttcggaccgtacggggttacggggacccgtaacgggttaccctcgggtaccctacccggttacctccggtaaccggtaccgacccccttacccggaaccggtaccgggtacccc

SEQ ID NO: 210529 - DNA, 747 bp, Homo sapiens
  misc_feature: GYAE6OF01DNZFJ.7.78.H01.1.454.CMB.1.raw
  modified_base (706)..(706): a, c, t, g, unknown or other
  misc_feature (706)..(706): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtgcagtagcaacaggtgcccactcccaggtgcagctggtacagtcgtgggtctgaattggaaggaacgccgtggggcgtacagtgagtcgttgcctgacacgtcctttcgaggtactactattacctttaccgaacctttacttttacgtttcgtagttacgtaaacggtttccggggtacccgtacgaaccggtcccccgtaggaaccgttaaggtccgtttacgaacttaccgaggttcgggattaggacctacaaaccgaccgacaccgtaccggaacccctacgtaacgtcgacccgtacggtccgtttacgggacggggttcgtttcgtccttaccgtaccgtagttacgtaccgttaccgttcggttacggggttacccgggtaccgttaccgtttactcgttacggaccttaaaccggtaacttaaaacccctaacgttccaaaccgtccgaacgtacttaccgttcgtttaccggtttttaagttgaaccgtagtcgtcgtaccgttgtcgttagagttagtacgtgtacgtacggtcgggaaccgtacggtaccgnggtaccctcgtctcgctacgccacgtaacgcgtcctaccgg

SEQ ID NO: 210530 - DNA, 821 bp, Homo sapiens
  misc_feature: GYAE6OF01CN3J7.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggacgccgtggggcgtcagtgagtcgttgcctgacaagtccttcgtggactacatcttcacttattattctagtactaagttcggtcccgacgacggcccctaggaacgtaacggtccttagaactacgagtagggagtcggaactaccgaacaccgactaccgtaccgggaacccctaacgtactcgacccgtacgtaccgttacgaaccggtaggggttccggttttacgttccttaccctacgtacgtagtaccgttacccgttcgtacgggttaccgggtacgttctttacgtcgttagacctaagttaacccttaaacccgtaaacccgtttaccgaacccgtacggtaaacccgaaccgttaccgttttaccgttttaaccggtttttttacgttttacgggaacgttaacggaccggtttcccggtttaccttcggttacgttaacggttaagggttaccggttaaacgtttacggtaacccggttacgggtaccgggggtaaccccgtaaacccgggtacccggttcgggttaccccgtaaccccgtttccgtaccccgtttcgaaccccggtccccgtttaacccgaacccgggtaaacccggttccccgg

SEQ ID NO: 210531 - DNA, 1008 bp, Homo sapiens
  misc_feature: GYAE6OF01BWFBL.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcagtgagcgttgcctgcagtccttctggactacattcttcacttacttattctgttactaagtttcggggtaccctacgaacggtccccgtagggaacctaaacgggtcccttaggaaccttaacgagttacgggggattacgggaatacccaaaccgtaacccggaactaaccggttacccgggaaaccccctaaccgtaacgttccgaccccggtaacggtcccctttaccgaaaccgggtaacgggtttcccggggtttttcggttaccctttacccggtaccctaagggttaccgggttaaacgtttaacccccgttccggttacggggttacccggggggttacccggttaccgttttaaacggttcccgttacgggaaccttaaaaccgggttaaacccttaaaaacccgtaaaacccccgttttacggtaaaccccgtttaaacgggaaaaccggttaaccccgttaacccggttttaccgggttttaacccgtttttttttaaacgggtttttttaccgggaaacccggttaacgggttaaccgggttaccccggttttaaccgggttaccgtttacgggtttaacctaaggggggttaaccgtttaaaacgtttcggggttaaacccggtttaccgggtaaccggggggtttacccccggaaacgggggttaacccccgtttacggggtcccccgtttaaacccgtttccgttaaacccccgggttcgttaaccggtacccccttaacccgggaaaccccgtaccggggggttaaacccccc

SEQ ID NO: 210532 - DNA, 736 bp, Homo sapiens
  misc_feature: GYAE6OF01CJ157.7.78.H01.1.454.CMB.1.raw
  modified_base (244)..(244): a, c, t, g, unknown or other
  misc_feature (244)..(244): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttcnggatacatcttcactattattctgtcaattcgggtccgacacggcccctaggacaaggccttgactacatgggatggatcaacaccgacacgtacgggaaccccactactcgacccgaggccttcacgacgggtcggttttagtcttctccagtcggtacttaccgtcgtcggtcggggaacggtctttaacgtccgttacgacgtaacgtaaacgttaaacccctaaaccctttccgaaacccgttggaaacccgtaacctaccgtttaccggtttacccgttttttaagttttttacggtaacggtaacggtacggtccggtttacggttacgtttcggttaccgtaagggttaggttaaactttacggtaaccgttacggtccggggggtacccgtaaacgggggtaaccccttcggggttaccctacccggttccttaccccgttcgaacccgtaccctacccgaacccggtaaccgggtaacccccg

SEQ ID NO: 210533 - DNA, 636 bp, Homo sapiens
  misc_feature: GYAE6OF01CNSRL.7.78.H01.1.454.CMB.1.raw
  modified_base (551)..(551): a, c, t, g, unknown or other
  misc_feature (551)..(551): n is a, c, g, or t
  modified_base (598)..(598): a, c, t, g, unknown or other
  misc_feature (598)..(598): n is a, c, g, or t
  modified_base (607)..(607): a, c, t, g, unknown or other
  misc_feature (607)..(607): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggctcgagtgagcgttgcctgcaagccttctggatacatcttacacttacttattctgtctaagttgggtaccgacacggtcccctaggacaaggtccttagactacagtgggatggatacaaacgaccgaacacgtcgggaaaccccacgtactcgcccgaggcccttagacgagggtcgttttgtccttctaccgagtcggtaacttcccgtcgtcgggtccgggaacgtctttacgtcgtaggacaaggtaactaaccctaaccttccgaaaccgtgaaccgactaccgttgttaccgtttttagtttacgacgtagacgtcgttacgtctcgtntaaggtgtaacttgaccgtacgtggggaccagggtaccctggtaccncccggttcncgtaccacgccctaccgacggacggtccc

SEQ ID NO: 210534 - DNA, 729 bp, Homo sapiens
  misc_feature: GYAE6OF01B6IYJ.7.78.H01.1.454.CMB.1.raw
  modified_base (271)..(271): a, c, t, g, unknown or other
  misc_feature (271)..(271): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacatcttcactacttattctgtnaattgggtccgacacggcccctggacaaggccttgactacagtgggatggatcaacaccgacactcgggaaccccactactcgacccaggcccttacgacgacggggtccggttttcggtcctttctacccgtagttacgggtaacttaacccgtcgttcgggtccggggtaacgggtcctttaacgttccgttggaccgtaaacgtaacttaaaccccgtaaaccttttacccaaaccgttacggaaccgtaacctaaccgttcgttaacccggttttttatttttaggtaaccgtagtaacggtccggttccgttacgttgttaccgtaggttaggtaagttacggtacttaccgggtggggtacccgtaacggggtaacccgttcgggtacccgtaacccggttctacccggtactaccggtccccttaccggaaaccggtcgggtaaccccccg

SEQ ID NO: 210535 - DNA, 763 bp, Homo sapiens
  misc_feature: GYAE6OF01B2N3S.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagtcgttgcctgcaagtccttcgtggatacatccttcacttacttattctgtactaagttcgggtccgacgacggtccccgtaggaccaacggccttgactacgagtgggtatggactacaaccgaccgacgaaccgtaccgggaaacccccactacgtaccgacccgtacggtcccttacgacggtacggggttcggttttcgttccttcctaccgtagtcggtacttacccgttcgttcgggtccgggtacgtcgtttactcgtcgaccgtaagtaacccttaaccgtaacccttaccgtaaccgtcgaaccgtacctacgtttaccgtttaccgttttttaagttttaccgaacggtacgggttacgtccggtttcgttacgttggttaccgtaagggttaggttaacttacggtaaacggtcgggttaaccggggacccggtaaccggttaacccccgttcggttacccgtacccgttccttaccccgtaccgaaccgtcccccaaccggtaacccgggacccgggttaacccccg

SEQ ID NO: 210536 - DNA, 949 bp, Homo sapiens
  misc_feature: GYAE6OF01A7B3O.7.78.H01.1.454.CMB.1.raw
tcagcgtgtctctacacgaccggtgctcgatttagtgtgagtagtttgggttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggaatacacttcttaccaacttacttaacttctacgttacgtaaagtttcggggtacccgaccgaaccgggtcccccgttaggaaaccgtaacgggtaccccgttttacggaaaccttaaccggtaaggtttacggggggtaacgttacggggtaaacttaccccgaaaaacccggaaccccggtaaaccgtaaaccccggttaacccgggggaaaaccccccctaaaccggtttaacgttaccggaaccccccgttaaacggggtaccccttttaacccgaacgggttaacggggggttcccgggtttttggttacccgttttcccgtaccgtaacgttacggtaactttacccgtcggttacggtaccgggggtaccgtacctttaagtccgtacgaccgtaaacggttaaacctaaaaccccttaaacccgtttacccgtaaacccttacggaaccgtacctaaccgtttacgtttacccggtttttaagtttaccggtaacggacggtacggttaccgttcgttacgtttacggtacgtaacggttacggtaaacgtttaccggtaaccggtttaccgggtacggggggaaccccgtaaccgggggttaaccccgttacgggttaacccgaccccggttccttacccgttacccggacgtacccccgttaaccccgaacccggggttaacccgggtaacccccg

SEQ ID NO: 210537 - DNA, 762 bp, Homo sapiens
  misc_feature: GYAE6OF01DI8WU.7.78.H01.1.454.CMB.1.raw
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctaggtacagtctgggtctgaattgaggacgccgtggggcgtcagtgagtcgttcgcctgcaagtccttcnggatacntcttcacttactttattctgtactaagttcgggtaccgacgacggccccgtaggaaccgtaacggtccgttgaactacgagtgggactaggactaccaacgaccgacacgtaccgggaacccctacgtacgtcgacccgacggtcccttacgaccggtacgggttccggttttcgtccttaccgtaccgtagttacggtaacttacccgttcgtacgggttccggggaacgttccgttactcgtacgacgtaacgtaaaccttaacccgtaaccttaccctaaccgtacggtaacccgtaccgttacgtttcgttttacgtttttaacgttttcggtaacggtacgttacgggtaccgttcggttacgtcggtacgttaacgggtaggttaacgttacgtaccgtaccgggtacggggtacccggtaaccgggtacccgttcgggtccctacccgtttctacccgtaccgtaccgacccgtaacccgaccggtaaccgggttccccg

SEQ ID NO: 210538 - DNA, 619 bp, Homo sapiens
  misc_feature: GYAE6OF01BDBKI.7.78.H01.1.454.CMB.1.raw
  modified_base (353)..(353): a, c, t, g, unknown or other
  misc_feature (353)..(353): n is a, c, g, or t
  modified_base (508)..(508): a, c, t, g, unknown or other
  misc_feature (508)..(508): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtcaattgggtccgacaggcccctggacaaggccttgactacatgggatggactcaacaccgacacgtaccggaaccccacctancgccgacggtcctcggacggggtcggttcgtcttctccagtcgtactacctcgtcggtcgggacggtcttagtcgtgactagtaacctaaaccctaaccttacaacccgtgaacctacactcgttcctttttatttcggacgtagcgtcgtcgtntcgttcgtagttacggtattcgacgtcgggtcgggaccgacgggtacccgtggtaccctcccggtccttcccgtcgaaccgtcccctacgacccggtacggcccctaccgg

SEQ ID NO: 210539 - DNA, 769 bp, Homo sapiens
  misc_feature: GYAE6OF01EZWWJ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagtccttcgtggatacatcttcacttacttattctgtactaagttcgggtccgacgacggcccctaggaaccaaggtccttgactacgagtgggatggactacaacgaccgacacgtacgggaacccccactacgtcgacccgaggtcccttacgaacggtacggggttccggttttcgttccctttccgtacccgtagttacgggtaccttacccgttcgtacgggttaccggggtaccgtctttactccgttgaacctaggtaaaccttaaacccgtaaccctttaccaaacccgtgaaaccgtaccctacgtttcggtttacccgtttttagttttacggaacggtagtacggtccgtttcgttcgttcggttacgtagggttacggtaacttcgggtaacccgttacgggtccggggtaacccggtaaacggggttaaccccgtgggttaccccgtaaccccggttcccgttaccccgttaccggaaccgttcccccgtaacccggaaccccgaccgggggttaccccc

SEQ ID NO: 210540 - DNA, 716 bp, Homo sapiens
  misc_feature: GYAE6OF01EN5KT.7.78.H01.1.454.CMB.1.raw
  modified_base (594)..(594): a, c, t, g, unknown or other
  misc_feature (594)..(594): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacgaggtcgcccactcccgaggtgcagctggtacagtcgtgggtctagaagttgaggacgccgtgggctgagtgagtcgttgccgtgactaacgtccttcgtggatactattcttacacttactttattctgtactaagttcggtaccgacgtaccggcccgtaggaccgacggtccttcgaactacgaggttggactggactaccaaccgaccgacaccgtaccggaacccctacgtacgaccgcccgtacggtccgttacgggaccgggttcggtttcttaccgttcctacgtagtacggtacttaccgtcgttacggtcgggtacttacgtttactacgtcgtaaccgtaactaaccctaaaccctaccgttaccaacgttacgacctactacgtttacgtttacgtttttagttacggacgtagacgtttcgtcgttntacggtataggtagtacgttacgacggttccggtaccggggtacgtaacccgggtccgttacggtcccttccgtccgttacgacccgacctccccgtaaccgccggttacgcccgttaccgg

SEQ ID NO: 210541 - DNA, 709 bp, Homo sapiens
  misc_feature: GYAE6OF01BPCNP.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagtccttctggatacatcttcacttacttattctgtctaagttcgggtccgacgacggcccctaggaccgaaggtcccttggacctacgacgtgggatggactaccgaacgaccgaactacgtaccgggaaacccctactacgtccgaccgacggtcccttacgggaccggggttcggtttcgtccgttcctcgacgtcgggtacttaccgtcgtcgggtcgggacgttcttagtccgtgacgtaacgtaacctaaaccctaccgttacaaccgtcgaacctacgtaccgttcgtttaccgtttttaagtttcggaacgtacgtcgttaccggtcgttacgtcgtacgtaggttagtaacttcggtaaccgttcgggtccgggaaccggtaaccgggtacccgttacgggtacccgtccgttacccgtccgaccgtaccgtccctaacccggaccgtacggtaccccgtcccgg

SEQ ID NO: 210542 - DNA, 1087 bp, Homo sapiens
  misc_feature: GYAE6OF01D1ICD.7.78.H01.1.454.CMB.1.raw
tcagcgtgtctctacacgaccggtgctcgatttagtgtgagtagtttgggtttggggacccaacaaccacacccctcctaagaagaacgcccctagaccacagctccacaccatggactggacctggaggatcctcttcttgggtggcagtagcaacaggtcgcccactcccgaggtgcagctggtacagtcgtgggtctgaagttggaggacgccgtggggcgtcgaggtgaggtcgttcgccgtagacgtaacgtccttcgtaggtactactacttcctttacctaacctttactttacttccgttacgttacgttaacggtttccggggtaccgaccgtaccgggtccccgtacggaaccgtaaccgggtcctttacggaaccttacggtacgggttaggggaacgttacgggaaccgtaaccgaaacccggtaacccggtaaccgtaacccgggtaaccccgggtaaacccccgtaaccgtttaccggtacccggtaccccggtaccgggttaccccggtttaccggggtaacccgggggtttcccggttttacgtttcccgtttaccgttaaccggtaacggttaccggtaaccgtttacccgttccgggttacggggttaccggggtaccgtttaccgttttacgtaccgggttacggaaccgttaaaaccggttaaacccccgtttaaaaccctaaccccgtttaaccggtaaacccgtacggttaaaccccgttaacgttacccggttttaccggtttttaccgtttttttaaggtttttaccgggaaacccgtttacgggttaccggttttcccggttacggttttacgttacggttaaccgggtttaaacgggttaacggttaaccgtttaccgggtaaaccccggttttaccgggggggaccggggggtaaacccccggttttaaacccggggggtttaacccgttaccccggggttttaacccccgtacccccggtttacccgggtaaccccttacccggggtaaccccgtaccccccgggtttaaaacccccggacccggggtttaaaccccggcccccggttttaccccgggg

SEQ ID NO: 210543 - DNA, 699 bp, Homo sapiens
  misc_feature: GYAE6OF01C0A8L.7.78.H01.1.454.CMB.1.raw
  modified_base (444)..(444): a, c, t, g, unknown or other
  misc_feature (444)..(444): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattggaggaagccgtggggcgtcaggtgagcgtttgccctgacaacgccttctggatacatcttcacttacttattctgtactaattcgggtccgacgacggcccctaggaacaacggtccttagactaacagtgggatggaactcaacaccgacacgtaccggaacccctaacgtactcgaccctaggcccttacgacgtacggggtcgtttcgttccttcgtcctagtacggtactacccgttcgnggtaccgggtacgtacgttacttcgtcgtacgaacgtaactaaaccctaaacccttacgaacctacgaacgaacctaacgttacgttaccgttttattttacgtaacgtaaggtacgtaccgttcgttacgttgttacgtacgtaggtaagttacgtacgtacggtcgggtaccgtaaccggtacccgtacggtaccctacccgtcctacccgtaccgaaccgtccctaaccccggacgtaacccgggtaccccg

SEQ ID NO: 210544 - DNA, 539 bp, Homo sapiens
  misc_feature: GYAE6OF01AZ9NS.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaaggccttgactacatgggatggatcaacaccgacactgggaaccccacctatcgcccaggccttcacagggcggtttgtcttctccatcggatacctctgtcgggacggcttatctgcagactaaccaaccttcaacctgacgacactgtccgtttattttgtacgagagcgtcgtctgtcagtgaattgactacgtgggccacgggaccctggtcaccgtctcctcagcctccaccgaaggccc

SEQ ID NO: 210545 - DNA, 724 bp, Homo sapiens
  misc_feature: GYAE6OF01A8OOC.7.78.H01.1.454.CMB.1.raw
  modified_base (216)..(216): a, c, t, g, unknown or other
  misc_feature (216)..(216): n is a, c, g, or t
  modified_base (241)..(241): a, c, t, g, unknown or other
  misc_feature (241)..(241): n is a, c, g, or t
  modified_base (312)..(312): a, c, t, g, unknown or other
  misc_feature (312)..(312): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggctnagtgagcgttgcctgcaagccttcnggatacatcttcacgtacttattctgtctaagttgggtccgacaggcccctggacaaggtccttgactacntggatggatcaacaccgacacgtcgggaaccccactatcgcccacggcccttcgaccgagggtccggttttcgtcttcctccgagtcggacttacccgtcgtacggtacggggtaccggtctttaacgtccgttgctaacgtaacttaaacccgtaaaccttccgaaaccgtacggtaaccgaccttaaccgttcggttacccgtttttaagtttttacggaacgttaaggtaccgtaccggttccggttacgtttacggtacgtaaggttacggtaacgttttacggaaccgttaccggtccggggtacccgtaaacggggtaaccccggtttggtacccgtacccgtttcccgtacccgttaccgacccggtttaccccgtccccgtaaacccggtaccgggtacccccg

SEQ ID NO: 210546 - DNA, 707 bp, Homo sapiens
  misc_feature: GYAE6OF01BLKJ0.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttgtggatacattcttcacttacttattctgtctaagttcgggtccgacgacggtccccgtagggaaccaacgggtccttaggaaccttacgagtaggggatggactacgaacaccgacacgtacgggaaccccactactcgccaggtcccttacgacgtacggggtcgttttacgtcttcctacctagtacggtacttaccgttcgttcgggtaccggggtaacggttctttacgtccgtacggtacgtaacgtaacttaaaccccgtaaccttttacccaaacccgttcgtaaccgaaccctacgttccgtttacccgttttttagtttacggtaacgagtacggtccgttcggttctgtaccgtagttacggtaagttgaccgtcgggtagggaccgtacgggtacccgtggtacccgaccgttccttacgaccgtaccgaccctccgaaccggtaccggtccccg

SEQ ID NO: 210547 - DNA, 894 bp, Homo sapiens
  misc_feature: GYAE6OF01AUKR2.7.78.H01.1.454.CMB.1.raw
tcagcgtgtctctacacgaccggtgctcgatttagtgtgagtagtttgggtttggggacccgaacaaccacacccctcctaagaagaagccctagaccacagctccacaccatggactggacctggaggatcctcttcttggtggcagtagcaacaggtgcccactcccaggtgcagctggtacagtcgtgggtctgaattgaggaagccgtggggcgtcaggtgagtcgttgccgtgacgaacggtcccttttacggtaggaacttaccgtacttccttttaccactttactttatttccttagttacttaaggtttcgggtaccgaccgtacgggccccgttggaaccgtaacggtccgtttagacctacgtagtaggggactggactacaaaccgtaccgtaccgaccggttaaccgggaaacccctacgtactaccggcccgtaaacggtccctttaaccgacggttacggggttcggttttacgttacccgtttaccgtccgtaacgttcgggtaacccttacccgttcggttaccggggtaccggggtaaccgtttcgttaacgttcccgtaggtacccgtaaaggttaaccctaaaccgtttaaccccgttaacgacccgtttaacgggtaccgtaaacccgttccgtttaccggttttaacccgtttttacggttttacggtaaccgtaacgggttacggtttccgtttaccgtttaccggttacggttaccgtagggttaacggttacgttaccggtaccggtttaaacgggtccgggggttaaaccggacccggtttacccggttacgggttaacccctaccggttcccggttaccttaccggacccggtttacccaccccggtaaaggccccgggttaacccg

SEQ ID NO: 210548 - DNA, 772 bp, Homo sapiens
  misc_feature: GYAE6OF01CD509.7.78.H01.1.454.CMB.1.raw
  modified_base (253)..(253): a, c, t, g, unknown or other
  misc_feature (253)..(253): n is a, c, g, or t
tcagcgtgtctctacacgaccggtgctcgatttagtgtgagtagtttgggtttggggacccaacaaccacacccctcctaagaagaacgcccctagaccacagctccacaccatggactggacctggaggatcctcttcttggtggcagtagcaacaggtcgcccactcccaggtgcagctggtacagtcgtgggtctgaattggaggaagccgtggggcgtacaggtgagtcgttgcctgacaagtccttgnggactacattcttctaacttactttagttctgttacgtaagtttcgggaccgtaccgaccggtccccgtagggaacctaacgggtccctttagaaccgtacgaggttagggggtacgttagggactaccgaaaccgaccgtaaccgtaccggtaccgggtaaaccccctaccgtaccgtcgaccccgtaccggtaccgttaccgaacggtaccggggttcggttttcgttcctttccgtccgtagtacggtacttaccgtcgtacgggttccgggtacgtcttacgtcgtagccaaacggtaactaacccctaaccgttaccgaaccctacggtaaccgactacccgtttaggtttaccctttttaacggtttttcggaacgtacggtacggttcccgttaacgttccgtacgttagtacggttagtacgttaggtaccgtacggtcgggaccgtaccgggtacctcggttcccacggttccaccgtacacccgtaccacccgaaccgtccggtacccg

SEQ ID NO: 210549 - DNA, 743 bp, Homo sapiens
  misc_feature: GYAE6OF01CQDI9.7.78.H01.1.454.CMB.1.raw
  modified_base (161)..(161): a, c, t, g, unknown or other
  misc_feature (161)..(161): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaaacaggtncccactcccaggtgcagctggtacagtctgggtctgaaattgaggagcctaggggctcaggtgagcgttgcctggaccaaaggtcctttacgtggattacatcttcaccttaattattcctgttacaagttcgggtaccgacacggcccctaggaacaaggccttagactacacgtggaagtcggataccaacgtaccgacacgtacggaaccccacgtaacgtcgacccacggccttacgacgtacggggttacgtttcgtacttcctaccagttagactaccttcgtcggtcgggaacggtcttagccttcgacgacgtaacttaaacctaaacccttcaaccgttacggaacctaccgtacgttacgttacggtttttaactttagggaaccgtaaggtacgttaccggttacggtcctttcggtacgttaacggttaagggtaactttaacgaaccggttttaccgggagggttaacccggtaaacccgggtaaccggttacgtaccccgggttaacccctccgtaccctaccgtaaccggtaccctaaccccgaaaccgggtaacccgggtaccccg

SEQ ID NO: 210550 - DNA, 651 bp, Homo sapiens
  misc_feature: GYAE6OF01A24BQ.7.78.H01.1.454.CMB.1.raw
  modified_base (245)..(245): a, c, t, g, unknown or other
  misc_feature (245)..(245): n is a, c, g, or t
  modified_base (383)..(383): a, c, t, g, unknown or other
  misc_feature (383)..(383): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggctcagtgagtcgttgcctgacaagtccttntggactacatcttcacttacttattctgtctaagttcgggtccgacgacggcccctaggacaaggtcctgactacagtggatggacacacgacacacgaccgaccactcgccgacgctcacgacggtgttgtctctcnctgatactcgtcgtacggtacgtcttactctcgactacgtaactaaccaaccttacctaacctacgacgacctagtaccgttacgttttcgttttacgtacgtacgtacgtacggttccgttcgttacgtctagggttaggtacgttagttaccgtacggttccggggtaaccgggacccggttaaccggtccggttaccgtaccccgttcccgttacctaccgtaccgacccctacccggacccggtaaaccggtcccggtacccgg

SEQ ID NO: 210551 - DNA, 757 bp, Homo sapiens
  misc_feature: GYAE6OF01B06JT.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattggaggaagccgtggggcgtcgaggtgagtcgttgcctgacaagtccttgtggatacattccttcaacttactttacttctgtactaagttcgggtaccgacgacggtccccgtagggaaccgtaacggtcctttacgaccttaacgaggttggggagtggactaccgaaaccgacccgaacgtaccgtaccgggaaaccccctaccgttaacgtccgaccccgtacggtcccttacgacgggtacgggttccggttttcgtcctttccgtccgtagtcggtacttacctcgtacgggtcgggaccgttcttactcgtagactaacgtaacctaaccctaccttaccaaccgtagaaccgtacctacgttacgtttaccgtttttaatttaccggaacggtcgtacggttccgttcgttcgtagttacgttaagtacgttagttcggtaaccggttaccggcgggtaacccgtacggggttaccccttgggtaaccctccgttcccgtacccggtacgacccgttacccctcccggaaacccggtccgggtaaccccg

SEQ ID NO: 210552 - DNA, 694 bp, Homo sapiens
  misc_feature: GYAE6OF01BVNTY.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtcgcccactcccaggtgcagctggtacagtctgggtctgaattgagagcctggggctcagtgagcgttgcctgcaagccttctggatacatcttcacttacttattctgtcaagttgggtcccgagaggcccctggacaaggtccttgactacagtgggatggatcaacaccgacactcgggaacccctacctagtcgcccaggtcccttcaacgtagggtcgttttcgtccttctcgtagtcggattaccctcgtcggtcgggacggtccttatcgtgactacgacgtaaacctaaccttacgtaacctcggaaccgactaccttacggttacccgtttttaagtttttcggaccgtaaggttaccgtacggttccggttcgttacggttacctagggttacggtaaacgtttacggtaacgttacccggttagggggacccgtaaacggggtaaccccttcggggtaccctacccccggttcttaccccgtcgtacccgtacccgtccccgtaaaccggtaccgggtacccccg

SEQ ID NO: 210553 - DNA, 733 bp, Homo sapiens
  misc_feature: GYAE6OF01DIY97.7.78.H01.1.454.CMB.1.raw
  modified_base (159)..(159): a, c, t, g, unknown or other
  misc_feature (159)..(159): n is a, c, g, or t
  modified_base (214)..(214): a, c, t, g, unknown or other
  misc_feature (214)..(214): n is a, c, g, or t
tcagcgtgtctctacacgaccggtgctcgatttagtgtgagtagtttgggttggggacccaacaaccacacccctcctaagaagaagcccctagaccacagcctccacaccatggactggacctggagatcctcttcttggtggcagtagcaacaggtncccactccaggtgcagctggtacagtctgggtctgaagtgagacgccgtgggctnaggtgagtcgttgcctgcaagtccttgtggatacattccttcacttacttattcgtagtacgtaagtttcgggtaccacgaccggtcccctagggaaccaaggtcctttacgaacgttacgagttggggaactaggtactaaccgaaaccgtacccgactaacccggttaccgggaaccccctaactaccgtacggaccccgtacggtacccttacgaacgggtacgggtttccggtttacgttacccttcgttacgtacgttacggtacctttaccgtccgtggggttccggtacggtctttacgtcgtacgtacgaacgttaaactaaccctaacgttaccaaccgtaggtaaccacgtacttccggtttacttttaagtttcgaaggaggtacttccggttcgttagtcgtagtacgtaggtaacgttcgtaacggttccggacgggtacgtaccgggtacttcggaccttaccggtccacccgtcgaccttccgacccttacgggaccgttcccg

SEQ ID NO: 210554 - DNA, 905 bp, Homo sapiens
  misc_feature: GYAE6OF01AV7G3.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggaacgccgtggggcgtcagtgagcgttgcctgcaagccttgtggatacctatccttacacttacttattctgtactaacgttggtaccgacgaccggtcccctaggacctaacggtccttacgaacgtacgaggtgggatacggactaccgaacgaccgactaccgtaccgggaaccccaaccgtacgtccgacccgaacggtcctaccgaacggtacgggttcgttttcggtacctttccgtaccgtagtacggtaacttaccgttccggtacgggtaccggggtaccgttaccgtttacgtaccggtacggtacctaaacgttaaaccgtttaaaaccccgtaaaccccgttttaaccgaaacccgttaacggtaacccgtaaaccgttaaccggtttaccgggttttaccccgtttttttttaacggttttaaccgggtaaacgggtaccggtaacccggtttaccgggtttacccgtttacggttacggttaacccgttaaggggttaacgttacccgggtttttaacgaccgggtttaaaccgggtacccgggggtaaccccggttaacccgggggttaaccccgtttaccgggtaaacccgtttaccccgggttacccctttacccggtacccgggtaaacccgtttaccccccggtaaacccgtaaaccccgggtaaaccccggggttaccccccg

SEQ ID NO: 210555 - DNA, 869 bp, Homo sapiens
  misc_feature: GYAE6OF01ECW7I.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccgaggtgacagctggtacagtcgtgggtctagtaagttggaggaacgtccggtggggcgtcgaggtgacgtcgttcgcctgacgaacgtccttcgtaggactactattccttactacttactttacttctagttactaaggttccgggtacccaacgtaccgggaccccttagggaaccgtaacgggtccccgtttacggaaaccgttacgtaacggggttagggggtaactcgggtaaactaacccgaaaacccggaccgttaaccggtaaccgtaacccgggaacccctaaccgtacgtcccgaaccggtcgtacccctaagtaccggtacgggttccgttttcgtacctttaccgtcgtacgtacggtaccttaaccgttcggtacggtaccgggtcgtactttacggtccgtagtaacgtaacgtaaccctaaaccccgtttacctacccgaaacccgtcgaaccgtacccgtttacgtaccgtttttacgttttttaacggtttccggaaggttacggtaccgtcggtttacccgtgttaacccggttgtaaggttccgggtaattacccggtacggttccgggaccgggttaaacccggaccggttaacccggttcggttacccgtaaccccgttccttacccgtaccggacccctaccccggtttaaccgacccgggttaaccgggtacccccg

SEQ ID NO: 210556 - DNA, 636 bp, Homo sapiens
  misc_feature: GYAE6OF01BXPAF.7.78.H01.1.454.CMB.1.raw
  modified_base (369)..(369): a, c, t, g, unknown or other
  misc_feature (369)..(369): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggcccctggacaaggccttgactacatgggatggatcaacaccgacacgtcgggaaccccactactcgcccaggccttcaacgngggtcggtttcgtcttcctccagtcggattaccctcgttcggtcggggacgtcttatcgtgcagaactaaccaaccttcaacctgaccactactcgttaccgttttattttcgacgtagtagtccgttcgtactgttacgaggttaggtaacttcgtaacgttaccgtcgggggacccgtaacggggttaacccctgggttaccgtacccgttccttacccgtccgaccggtaccccttacccgaaacccgtaccggggtacccccg

SEQ ID NO: 210557 - DNA, 774 bp, Homo sapiens
  misc_feature: GYAE6OF01CXZ4A.7.78.H01.1.454.CMB.1.raw
  modified_base (87)..(87): a, c, t, g, unknown or other
  misc_feature (87)..(87): n is a, c, g, or t
  modified_base (175)..(175): a, c, t, g, unknown or other
  misc_feature (175)..(175): n is a, c, g, or t
  modified_base (735)..(735): a, c, t, g, unknown or other
  misc_feature (735)..(735): n is a, c, g, or t
tcagcgtgtctctacacgaccggtgctcgatttagtgtgagtagtttgggttgggacccaacaaccacacccctcctaagaagaacncccctagaccacagctccacaccatggactggacctggaggatcctcttcttgggtggcagtagcaacaggtcgcccactcccaggtncagctggtacagtcgtgggtctagtaattggaggaagccgtggggctcaggtgagtcgttgcctagcaagccttcgtggactactatcttcacttacttattcgtagtactaagttcgggtacccgacgaccggcccctagggaaccgaacggtccgttacgaaccgttaacgaacggttggggagtacggaactaccgaaacccgaaccggtaaccctaaccggtaaccccggggtaaaccccctaaccgttaaccgtcccggtaaccccgtaccgggtaccccgttaccggggtacccgggggttacggttttcgttcccgtttaccgtacgtacggtacgtaaccttcccggttcgtacgggtcgggtacgtccttagtcgtcacgtaagaacctaaccgtaaccttcaaccgtacgaccgtactcgttacgttacgttttattttacgcgtacgtcggtacgttcgtacgttcgtctacggttagtaacgttcggtaccgttacggaccgggtacccggtaaccggtaacccgtccgtacgtacccgtccgtaccncgtacccgtccctaccgaacccgtccgggccttacccgg

SEQ ID NO: 210558 - DNA, 633 bp, Homo sapiens
  misc_feature: GYAE6OF01ERP23.7.78.H01.1.454.CMB.1.raw
  modified_base (159)..(159): a, c, t, g, unknown or other
  misc_feature (159)..(159): n is a, c, g, or t
  modified_base (243)..(243): a, c, t, g, unknown or other
  misc_feature (243)..(243): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtncccactcccaggtgcagctggtacagtctgggtctgaattgaggaagccgtggggcgtcagtgagcgttgcctgcaagccttcnggatacatcttcacttacttatctgtacaagttcgggccgacgacggcccctaggaccgaacggtccttagactacgagtgggagaggtctaacaccgaaccgacctacggtacccgaaccctactagtcccaccgacgtcctacacggcggttcggttctctctactgtgtactcctgtcgggtcgcgtctagtcgtacacgacgtaacctacctactaccctaacgtacgaactactacgttcgtttacgttttagtttacggtacgtacgtcgtcgtccttcgtactacgtaggtagttacgtcgtaccgtacgggtacgacggtaccgtacgttcggtccgtacccgtccttccgaacgtccgtacccgaccaccggcccgtaccc

SEQ ID NO: 210559 - DNA, 831 bp, Homo sapiens
  misc_feature: GYAE6OF01AYJG3.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacattcttcacttactttattctgttactaagttcgggtccgaccgacggtcccctagggaccaaggtccttagacctacagtgggatggatacaaccgaccgacacgtacggaaccccactatcgaccgacgccttacacgtacgggtcgtttcgtcttctcctagtcgtactcctcgtcggttaccggggacggtcttacgtcgtcgtactaaacgtaacttaaacccctaaacccgtttaccaaacccgttcggaaacccgtaaccgttaaccgtttccggtttacccggtttttttaagtttttaccggtaaccggttaacgggtaccggttaccccgggtttcggtttacccgttagggtttaccggtaacgggtttacggttaaaccgtttcgggtaaacccgtttaccgggggttaacccggggggaaccccggttaaacccggggggttaacccccggtttacgggttaccccggttaacccccggtttacccctttaccccggtacccggtaaaccccgggttaccccccttacccccggaaaacccggggtacccccggggttaaaccccccg

SEQ ID NO: 210560 - DNA, 671 bp, Homo sapiens
  misc_feature: GYAE6OF01ALLES.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgagagcctggggctcagtgagtcgttgcctggcaagcccttcgaggactacattcttacacttacttattactgtacaagtttcggggtaccgacgtacggccccgtaggactaacggccttgacctacagtggactggactacgaacaccgacacgtccgggaaccccactactcgccacggtccctaccgacgacgggtcgttttacgtcttccgtccagtcgggtactaccgttcgtcggacgggtaccgtcttagtcctgacaggtactaacctaccttaacaccgtacgacgtacctacgttccgttacgttttctttacgtacgaggtacggtcgttaccgttcgttacgttcgtacggttacggtaagttcggacgtaccggtcgggacggtaccggtaccgtcggtcccgtacccgttccgtacccgttcgaccgtaccccgtcctaaccgggacggtccccg

SEQ ID NO: 210561 - DNA, 698 bp, Homo sapiens
  misc_feature: GYAE6OF01D2QII.7.78.H01.1.454.CMB.1.raw
  modified_base (489)..(489): a, c, t, g, unknown or other
  misc_feature (489)..(489): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacgaggtgcccactcccaggtgcagctggtacagtctgggtctgattgaggagccgtggggctcagtgagtcgttgccgtagtaacgtccttcgtggtactaccattccttactacttactttattctgttactaacggtttcgggtccgacgtaccggcccgtaggaaccgaacggtccttagtactacgaggtagggatggactacctaaccgaccgacaccgtaccgggaaaccccctacgtaacgtccgcccgtacgtccttaccgacggtacgggttcgtttcgtccttcgtcctagttcgacttaccgtgtcggtcgggacgtcgttacncgtgactagtactaaacctaccttacctaaccgtacaacgaccttacgttcgttaccgtttttagttttcggaacgtaggtacgtcgttaccgtcgtacgtacgtagttagtacttagtaccggttacggcgggtaccgaacgggtcccgttgacccttcgttccgtaccctacgtacccgaccctaccgacgtaccggccttacccgg

SEQ ID NO: 210562 - DNA, 686 bp, Homo sapiens
  misc_feature: GYAE6OF01AVKKI.7.78.H01.1.454.CMB.1.raw
  modified_base (218)..(218): a, c, t, g, unknown or other
  misc_feature (218)..(218): n is a, c, g, or t
  modified_base (376)..(376): a, c, t, g, unknown or other
  misc_feature (376)..(376): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtcgcccactcccaggtgcagctggtacagtctgggtctgaattgaggagccgtggggcgtnagtgagtcgttgcctgcaacgtcctttcgtggatacattcttactacttactttattctgtctaagttcgggtccacgacggcccctaggacctaaggtccttgactactagtgggatggataccaacgaccgacacgtaccgggaaaccccacgtanccgcccgacggtccctacgacggacggggtcgttttacgtccttacgtcctagtcggacttccgtcgtcgggtacgggtacgtcttacgtcgtcgactaagtacctaaccctaacctttccaaccgtagaccgactacgttccggttctttttaacgtttgacgacgtacgtccgttacgttcgtagtaccgtaggtacgtattcggtaaccgtcggtacggggaccgtaccggggtaccctcgggtccctaacccggttcctaccgtaccgtacgtaccccgtacccggaccggtaaccgggtcccccg

SEQ ID NO: 210563 - DNA, 806 bp, Homo sapiens
  misc_feature: GYAE6OF01DKJ79.7.78.H01.1.454.CMB.1.raw
tcagcgtgtctctacacgaccggtgctcgatttagtgtgagtagtttgggttgggacccaacaaccaccacccctcctaagaagaagcccctagaccacagctccacaccatggactggacctggaggatcctcttcttgggtggcagtagcaacgaggtcgcccactcccgaggtgcagcgtaggtacagtcgtgggtactgaattggaggaacgccggtggggcgtcgaggtgagtcgttcgccgtggactaacgtccgttgtaggactactattccttctacttactttattccgttagtactaaggttccgggtaccgaccgaccggtcccgtaggaccgtaacggtccttacgactacgaggttcgggagtaggactaaccgaaccgacccgaccgtaaccggtacccggaaaccccctcgtaacgtccgaccccggtacgtacccgtacgaaccggtacgggttccgtttacgttcccttctacgtagtacgtactccgtcggtcgggtacggcgttcttacgcgtagactaaacgtaacctaacctaccttaacgaccgttagaaccggtaccttcgtttacggttttaccgttttaagtttaccggaacggtacgtccgttcgttaccgtttcgtaggtcgtttaagggtacgtacgtttacccggaggtaccgggttaaccggggaacccgttaacccgggttacccgtcggggttaaaccccctccggttacccgttaccccgacgggttaacccccacccgtaccccgggttaaacggccccggtttaaccccgg

SEQ ID NO: 210564 - DNA, 799 bp, Homo sapiens
  misc_feature: GYAE6OF01EM1UA.7.78.H01.1.454.CMB.1.raw
  modified_base (242)..(242): a, c, t, g, unknown or other
  misc_feature (242)..(242): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttntggatacatcttcactacttattctgtctaagttcgggtccgacacggcccctaggacaaggtccttgactacagtgggtatggataccaacgaccgacacgtacgggaaccccctacctatcgcccacggccttacgacgtacgggtccggttttacgtcctttacctcccgtaacgtcgggtaaccttacccgttacccggttacgggtcccgggggtacccgggtacttttaacgtccgttacggaccgtaacgtaaaccgttaaacccctaaacccgtttacccaaacccgttcgggaaacccgtacctaccgtttaccggtttacccgttttttaagtttttacgggtaaccggtaaggtacggtaccggtttccgttaccgttacggttaccgtaagggttacggtaaagttcggtaaccgtttaacgggtccgggggtaacccgtaaccggggggttaacccccttcggggttaaccctacccgggttacctcccccggttacgacccggtaccccgtacccgtaaacccccggtaacggggtacccccg

SEQ ID NO: 210565 - DNA, 736 bp, Homo sapiens
  misc_feature: GYAE6OF01BA7TX.7.78.H01.1.454.CMB.1.raw
tcagcgtgtctctacacgaccggtgctcgatttagtgtgagtagtttgggttggggacccaacaaccacacccctcctaagaagaagcccctagaccacagctccacaccatggactggacctggaggatcctcttcttggtggcagtagcaacaggtgctcactcccaggtgcagctggtacagtctgggtctgaattgaggaagccgtggggcgtcagtgagcgttgcctgcaagccttctggatacatcttcacttacttattctgtactaagttcgggtccacggggacgccccgtaggacaaggccttgactacagtggatggactcaacaccgacacgtacggaaccccactactcgacccgaggccttacgacgtaggggtcgtttgtccttctaccagtcggtactaccgtcgtacgggtccgggacgttctttaagtcgtaggacctaacgaaccttaaaacccttaacccgtttacaaaaccccgtgggaaacccgtaacctaccggtttacggttttaccccgttttttaaatttttcgggaacgtaacggtacggtcccggtttaccgttcgttacggtacgtagggtaacgttaacgtttcgaaccgttacggggtaccggggaacccgtaaccgggggttaaccccttgggttaaccccctaccggttaccccgttaccctaccgaaccggtcccccttacccggaacccggtaaacccggg

SEQ ID NO: 210566 - DNA, 800 bp, Homo sapiens
  misc_feature: GYAE6OF01ADU2O.7.78.H01.1.454.CMB.1.raw
tcagcgtgtctctacacgaccggtgctcgatttagtgtgagtagtttgggtttgggacccaacaaccacacccctcctaagaagaagccactagaccacagctccacaccatggactggacctggaggatcctcttctggtggcagtagcaacaggtcgcccactccaggtgcagctggtacagtcgtgggtctgtaattggaggacgccgtggggctcgagtggacgtcggttcgcctgcgtaacgtccgttacgtaggtaactaccgtaacttccttacctacctttaactttaacttccttaggtaacgttaacggttcgggtacccgaacgacccgggtcccccgtagggaacctaaccggtcccttaggtaaccgttaaccgtaggtacgggtacgtacggtaacctacccgaaaccccgtaacccgtaaccgtaacccggtaccccggtaaacccccaccgtacgtcccgacccggtacgtcccgttacggacggttacgggttccgtttgtcccttacgctagtacgtactaccgtcgtacggtcggtacgtacgttcgtacgtcgtacgaacgtaacctaaccctaccctaccgtaaccgtacgaccgtaccgtacgttacgtttacgtttacgtttacgtacgtacgtacgtccgttcgtactcgggggggttactaggtagtacgtacggtacgtaccgggtaccgggtaccggtaaccggtaccggtccgtccgtacccgttacccgtccgtaccgacccgtacccgtacccgtaacccggtaccccgg

SEQ ID NO: 210567 - DNA, 811 bp, Homo sapiens
  misc_feature: GYAE6OF01BNNGX.7.78.H01.1.454.CMB.1.raw
tcagcgtgtctctacacgaccggtgctcgatttagtgtgagtagtttgggtttgggggacccaacaaccacaccctcctaaggaagaagcccctagaccacagctccacaccatggactggaccttgggacggactcctcttcttggtggcagtagcaacgaggtcgcccacgtccaggtgcgagctggtactagtcgtgggtctagtacttggaggacgtccgtggggcgtcgaggtgacggtcgttgccgtgacgtaacgtccttacgtaggactaactacttcgttactaacttacttattcgtacgtaactaaaggttccgggtaccgaacgtaaccggtccccgtaaggaaccgtaacggtccttaagtaactacgtaacggtgggtacgtacgggaactaccgaaccgaaccgacgtaaccgtaaccgggaacccctaacgtacgccgacccgtacggtcccgttacgaacgggtacggggttcggtttaccgtaccttaccgtccgtaacgtcggtacccttaccgtcggtcgggtaccggtaccgttacgttacttccgcgtactaacggtaacctaaccgtaccttaccaccgttacgaacgtacctacgtacggtttacgttttaacggttacgtaacgtacggttacggtccggttacgtcgttacggttcgtaacggttacgttaacgttccggaacggttccgggtacgggtaacccgtaacggggttacccgtacggtacccgtaccggttaccctccgtaccgacctcccggtaaccgtaccggaccggtaccccg

SEQ ID NO: 210568 - DNA, 840 bp, Homo sapiens
  misc_feature: GYAE6OF01C4SCX.7.78.H01.1.454.CMB.1.raw
tcagcgtgtctctacacgaccggtgctcgatttagtgtgagtagtttgggtttgggacccaacaaccacacccctcctaagaagaacgcccctagaccacagctccacaccatggactggacctggaggatcctcttcttggtggcagtagcaacaggtcgcccactcccaggtgcagctggtacagtctgggtctgaattggaggagccgtggggcgtcagtgagtcgttcgccgtgacctaacgtccctttcgtaggtacttaacctactttacctttacctaaccttttaacttttaattttccgttacgttacgtaaaggttttcggggtacccggtaaccgtaccgggtcccccggttagggaacctaacgggtcctttacggaacctaacgaggtcggggtaatggaactaccgaaaccgaccgaacgtaccgtaccgggaacccctaccgttacgccgaccctacggtcccttacgaccggtacggggtttaccgttttcgtccgtttaccgtacccgtagttacggtaccttacccgttcgtacgggttaccggggaacgtttcttacttacgtacggaccgtaaacgttaccctaaaacctacccttaccgtaacccgttcggaaccctactaccgtttcggttttaaccgtttttagttttacgaaggtaccgtaggttcccgttcgtcgttcggtacgttaggttcgtaattccggaacgttaccgggtcggggtacccgtaaaccgggtacccgttacggttcccgtaacccgttcgtccccgtaccgtaccgtccccgttaaccggaacccggttacccgggtaccc

SEQ ID NO: 210569 - DNA, 619 bp, Homo sapiens
  misc_feature: GYAE6OF01DTPTX.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagtccttctggatacattcttcacttacttattctgtcaagttgggtccgacacggcccctggacaaggccttgactacatgggatggactacaacaccgacacgtcgggaaccccacctactcgcccgaggtcccttacacgtacgggtcggtttcgttccttctccgactggtactacccgtcgtcggtcggggtacggtcttactcgtgacagtactaaccaccttacacctgacctacacttcgtcgttttatttacgtacgtgtacgtcgttcgttctgtcgagtgtattcgacgtacgtcgggacccgtaacgggacccgttcggtccgtacccgttccttcccgtacaccgtcccacccgtaaccggaccggtccccg

SEQ ID NO: 210570 - DNA, 842 bp, Homo sapiens
  misc_feature: GYAE6OF01CWRXN.7.78.H01.1.454.CMB.1.raw
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttgggtggcagtagcaacaggtcgcccactcccaggtgcagcgtggtacagtcgtgggtctagaattggaggaacgtccgtggggctcgaggtgagtcgttcgcctgactaagtccttagnggactacnttcttactacttactttattctgttactaagttcgggtaccgaaccgaccgggtccccgtagggaacgtaacgggtccttacgaacctacgaaggtggggtatacggtaactaccgaaccgaacccgtaaacgtaccggtaaacccgggaacccctaaccgttacgtccggcccgtaacggtaccccttacggaccgggtacgggtttcggtttctcccttacgtaccgtagtcggtaacttccgttacggtggtccgggacgttcttacgtcgtacgacgtaacgtaaccttaacccgtaaccttaaccgtaaccctacgggtaaacctaccgtacgttaccggttttacgttttaacgttttacggtaaccgggtaacggtacggttccgtttaccgtacgtttacggtacgttaacggtacggtttaacgtacggtaccgggttacccgggtacggggtaccccggttaaccgggtaaccgttaccgggttacccgtaccccggtttcctaccccgtacccggtaccccgtaacccttaacccccggaaccggggtaaccccgttaccccgg

SEQ ID NO: 210571 - DNA, 910 bp, Homo sapiens
  misc_feature: GYAE6OF01DC2FM.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtcgcccactcccaggtgcagctggtacagtctgggtctgaagttgaggacgccgtggggcgtcaggtgagtcgttgaccgtgcgaacgtcccgttcgtagggtatacctattaccttcctaacttaccttttaatttcctgttaccgtaaggtttcggggtaccccgaaccgtaccggtcccccgttacggaaccgtaacgggtcccctttacggaaccttaaccgaaggttacggggtagttacgggtaactaacccgaaaccgaacccggaacccgtaacccggtaacccggggtaaacccccctaaccgttaaccgttcccggaacccccgtacggttacccccgtttaccgaaacccgggttacgggggttcccggtttttcggttcccgttttacccgttacccgtaaccggtttgggttaaacccctttaacccgggtttccgttaccggggtttacccggggtaaccggttacccggtttttaaccttaccgggttacgtaacccgttaacgtaaaccgtttaaaccccttaacccgttaaccgtaaccgtacgtaaacccgtaacgttcccggtttacgtttaaccgtttttaacgttttacgggttaacgaggtaccgttcgttcgttcgtcggtacgtagttggtaacgttcgaaccggtcgtacggggaaccctaggggtacccttcggtacccgtacccgttcacccgtcaacccgtcccgaccctacggacccgtacccg

SEQ ID NO: 210572 - DNA, 802 bp, Homo sapiens
  misc_feature: GYAE6OF01DLZEO.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattggaggaagccgtggggcgtcagtgagtcgttgcctgcaagtccttcgtggatacattcttctacttacttattcttgtactaagttcgggtaccgactacggccctaggaactacggtccttaggactaacgagttgggatcggactacgaacaccgactacgtacggaaccccactacgtcgacccgtacggtacccttacgacggtacggggtccggttttcgtacctttccgtaccgtagttacggtaacttacccgtcgtacgggtacggggtaccgtacttatccgtagacctaagtaaccgttaaccctaaccttacccgtaacctacggtaacccgtaaccgtaaccgtttccgttttaccggttttttaagtttttaccggtaacggtaacggtaaccggttccggtttcccgttacgttcgggtttaactacgggtttacgggaagttttaccggtaaccggttcgggttaccggggggacccgttaaacccggggttaacccgtttaccggggtaccctaccccgggtttcctaccccggttacgaaaccccttcccggtaaaccccgaaccggtaaccccgggttaccccg

SEQ ID NO: 210573 - DNA, 804 bp, Homo sapiens
  misc_feature: GYAE6OF01ESMNS.7.78.H01.1.454.CMB.1.raw
  modified_base (163)..(163): a, c, t, g, unknown or other
  misc_feature (163)..(163): n is a, c, g, or t
  modified_base (253)..(253): a, c, t, g, unknown or other
  misc_feature (253)..(253): n is a, c, g, or t
tcagcgtgtctctacacgaccggtgctcgatttagtgtgagtagtttgggtttgggacccaacaaccacacccctctaagaagaacgcccctagaccacagctccacaccatggactggacctggaggactcctcttcttgggtgcagtacgcaacgaggtcncccactcccgaggtcgcagctaggtacagttcgtgggtactagtaattggaggtacgtcggtggggctacgagtggagtcgttcgccgtnacgtacgtccttagtggtactactacttccttactaacgtttactttacttccgttattacgtaaggttccgggtacccgaaccgtaccgggtcccgtaggaaccgtacggttacccttagtaccgtaacgtaggttacgggtagtaggtaacctaccgtaaccgaaccgtaccgtaccggtaacccgggaacccctacgtacgccgtacccgtacggttcctacgacgggttacgggtccgtttagtcccgttaccacgttacgtcgttaaccttacgtcgttacgggtcgggttaccttcgttactcgtaacgtacgtacgtaaaccttaacccgtactacctaccgtacgtaaccgtaccgttgttaacccgttttacgttttagtttacggaggtaacgtacgttaccggtctttggtacgttacttagggtaccgttagtaccgttaccggtaccggtcgggtaccgtacggttaacccgtcggttcccgtaccgtccggtaccctaccggacccttacccgtaaccggacccggtcgtaccccgg

SEQ ID NO: 210574 - DNA, 739 bp, Homo sapiens
  misc_feature: GYAE6OF01DH2OY.7.78.H01.1.454.CMB.1.raw
  modified_base (248)..(248): a, c, t, g, unknown or other
  misc_feature (248)..(248): n is a, c, g, or t
  modified_base (706)..(706): a, c, t, g, unknown or other
  misc_feature (706)..(706): n is a, c, g, or t
tcagcgtgtctctacacgaccggtgctcgatttagtgtgagtagtttgggtttgggacccaacaaccacacccctcctaagaagaagcccctagaccacagcctccacaccatggactggacctggaggatcctcttcttggtggcagtagcaacaggtcgcccactcccaggtgcagctggtacagtctgggtctgaattgaggacgccgtggggctcagtgagtcgttgcctgacaacgtccttcnggtatacattcttacacttatttacttctagtacctaagttcgggtacccgtaccgaacggtcccccgtagggaaccgtaacggtcccttaggacctaacaggttcggggaatcgggaactaccaaaccgtaccgaactaccgtaccgggaaaccccctactacgtccgaccctacggtccttacgaaccggttgggggtaccgttttcgtccttaccgtacacgtaggtacctacccgttcgtcgggttcgggtaccgtcttaactcgtcgactaacgtacctaaaccgtaacctcgaacccgtggtaccctactaccgtttgtttaacgtttttagtttagaacgagtaccgtcggttaccttcgtaggttactaggttacgttaacgttacgtaccgttacggtacggggaacccgtacgggttacccgtacggtcccaccggttctaccccgtnacccgttcccgaaccacccggtaacggtccccg

SEQ ID NO: 210575 - DNA, 760 bp, Homo sapiens
  misc_feature: GYAE6OF01DURSH.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtcgcccactcccaggtgcagctggtacagtcgtgggtctgaattggaggaacgccgtggggcgtcaggtgagtcgttgcctgcaagtccttcgtggactacatcttcacttacttattctagtactaagttcggtaccgacgacggtccccgtaggacgaacggtccttaggacctacgagttagggtagtggtaactaccgaaccgtacccgaacgtaaccgtaaccgggaaaccccctaccgtaacgtccgaccccgaacggtccctttacgacgggtacgggttaccggtttcgttaccgttccgtaccgtagttacggtacttaacccgttcggttacgggttaccgggtaccggttacgttacttcgtcgaaccgtaagtaacctaaacctaccttaccgacctacgaaccgtacgtacgttacgtttaccgtttttagtttacggtaacgtacgtaggtaccggtcgttacgttgttacggtagttacggtagttacgtacgttacggtcgggacccggtaacgggtaacccggttggtaccctaccggttccgtaccctacgaccgacccttacccggaccgtaccggtaccccg

SEQ ID NO: 210576 - DNA, 707 bp, Homo sapiens
  misc_feature: GYAE6OF01ASCLU.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtactaagttcgggtaccacacggtcccctaggaaccaacggccttaggacctacgagtgggatggatacaaaccgaccgacacgtacgggaacccccactacgtcgacccaggtcccttacgacgacgggtccgtttcgtcctttcgtcctagtacgggtaacttacccgtcgtcgggtaccggggaccgtcgtttagtccgtacgccgtaactaaccgtaaccctaaaccctttacgaacccgttgaaccgtaaccgtaccgtttcgttacccgttttttaattttacggaacgttaaggacgttcccggttacgttccgttaggttaccgaggttacggaactttcggacgttacggtccgggggactaaccggggtacccttcgggtcctaaccggtctacccgtacgacgtcccctaccgaccgaacggtccccg

SEQ ID NO: 210577 - DNA, 1087 bp, Homo sapiens
  misc_feature: GYAE6OF01C459V.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcagtgagtcgttgccctgacaacggtccctttcgtagggtaacttaccgtactttcccttttaccaaccgttaacctttttaacttttccgttacggtttaccgtaaaaggttttccgggggttacccccggtaaaccggtaacccggggtacccccccgttagggggaaacccgtaaaaaccgggggcccccgttttttaacgggaaaccctttaaccggtaaggtttaggggggggtaactttacgggggtaaaccttacccgaaaaaccccggaacccccgggtaaaccgttaaccccgggttaaaccccgggggaaaacccccccccttaaacccgttacggttaccccgggaacccccggtacgggttaccccctttaacccgggaaaccggttaccgggggggtttcccgggtttttacggtttccccgttttacccgttacccccgtaacgggtttacgggtaaaccctttaaccccggtttaccgggtttacggggttccccggggggtaacccgggttaccctttttaacggttcccggttacggtaacccgtaaacggttaaacccttaaaaacccccggttaaaccctttacccccgtaaacccggttacgtaaaccccggtaacctttacccgtttccggttttaaccccgtttttttaagtttttaccgggtaacgtaacggtacggttcccggtttacgttcgttaccgttacggtaaggttcgggttaaacttccgggaaccgtttaccggggtccggggtaacccgtaaccgggggtacccctttggggtacccctaccccggttcttacccgtcgtaacccgtccctacccggaaaccggtccggtacccccg

SEQ ID NO: 210578 - DNA, 597 bp, Homo sapiens
  misc_feature: GYAE6OF01AS5JS.7.78.H01.1.454.CMB.1.raw
  modified_base (242)..(242): a, c, t, g, unknown or other
  misc_feature (242)..(242): n is a, c, g, or t
  modified_base (355)..(355): a, c, t, g, unknown or other
  misc_feature (355)..(355): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacatcttcacttacttattctgtctaagttgggtccgacacggcccctggacaaggccttgactacagtggatggatacaacaccgacacgtacgggaaccccactacncgcccagtcctcacgagggtcgtttcgtcttctccagtcggactacgtcgtggtacgggtacgtcttatcgtgcagaactaaccgtacttcaacctgaccgactactcgttacttttagtttacgaacgtcgtacgtcgttacgtctgtcgagtagtaacgttcgacgttccgagggtaccgacgggtacccgtggtcccaccgtcctccctaccgcgtaccctacccgaccgtaccggccc

SEQ ID NO: 210579 - DNA, 593 bp, Homo sapiens
  misc_feature: GYAE6OF01BSUY3.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtcaattgggccacaggcccctggacaggccttgactacatgggatggatcaacaccgacacgtacgggaaccccactatcgccagccttcacgtaggtcggtttcgtccttctccagtggactacctctgtccgggacgtcttactctgcagactaaccaacgttaccaacctgaacgactactcgtaccgttttattttcgtacgagtacgtcgtcgtctcgtcaggtaggtaattgtactacggtcggggacctaacggggtaaccctgggtcccaaccgtccttcccgtactaccgaccctcccaaccggtacgggacccc

SEQ ID NO: 210580 - DNA, 705 bp, Homo sapiens
  misc_feature: GYAE6OF01BU7UQ.7.78.H01.1.454.CMB.1.raw
  modified_base (162)..(162): a, c, t, g, unknown or other
  misc_feature (162)..(162): n is a, c, g, or t
  modified_base (219)..(219): a, c, t, g, unknown or other
  misc_feature (219)..(219): n is a, c, g, or t
  modified_base (564)..(564): a, c, t, g, unknown or other
  misc_feature (564)..(564): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggactcctcttcttggtggcagtagcaacaggtcncccactcccgaggtgcagctggtacagtctgggtctgaatgaggagccgtggggctnagtgagcgttgcctgacagtcccttgtggactactatcttcaacttacttattctgtactaaggttcgggtcccacgacggcccctaggaaccaaggtccttgactacgagtgggatggactacgaaccaccgacacgtaccgggaaaccccctactaagtccgtaccacggttcccttacgaaccggtcgggttcggttttctccttaccgtcgtaagttcgtacttaccgtcgttcgggtaccggtacggttcttagtctacgcctaagtaaacctaaccctaacctaccgaacctacgtaccgaaccgtacttccggtttaccttttagttttacggaacgngtacgtcgttaccgttcgtggtactaggtacgttacgttaggtaccgtacgggaccgggtaccgaaccgggttacctcgggtaccctcccggttctaccggtacccgacggtaccctaaccccggacggaccggtaccccg

SEQ ID NO: 210581 - DNA, 697 bp, Homo sapiens
  misc_feature: GYAE6OF01C0USN.7.78.H01.1.454.CMB.1.raw
  modified_base (239)..(239): a, c, t, g, unknown or other
  misc_feature (239)..(239): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggctcagtgagcgttgcctgcaagccttntggatacatcttcactattattctgtcaattcggtccgacacggcccctggacagccttgactacagtggatggatcaactaccgacacgtacggaccccactactcgccagcccttcacgtagggtcgttttgtccgttctccctattacggacttacccgtcgtcgggtaccgggacggttaccttacgttcgtcggacctaggtaaaccgttaaaccccgtaaaccctttccgtaaaccgtcggtaaacccgtaacctaaccgtttccggttttacccggtttttaagttttttaccgggtaacggtaacgttccggtaccgggtttcttacttcggtacgtaggttgtaactttggaacctacgggtcgggaccgtaaaccggggcccttaggtccccgtaccgttcccaccgttaccgaaccgttcccaccccgaggtaacccggtacccccg

SEQ ID NO: 210582 - DNA, 875 bp, Homo sapiens
  misc_feature: GYAE6OF01BVFF0.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgtaattgaggaacgccgtggggcgtcagtgagcgttgcctgcaagtccttgtaggatacattccttacctacttactttattctagttacaacgtttcgggtacccgaaccgaccgggtaccccgtaggaaccgtaacggtcctttacggaacctaccgtagtagggtagtacggtataccgaaccgaacccgtaacgaaccgtacccgggaaaccccctaacctacgtacgaccccgtacggtccccttacgaacggacgggtttcggtttcgttaccttctaccgtacttggtacctaccgttacgttcgggtaccggggtaacgttcgtttacgtccgttagacctaacggtaacctttaaaccccgtaaaccctttaaccgaacccgttccggtaaacccgtaccgttacccggtttaccgttttaaccggttttttacgtttttaacgggtaacggtaacggttcggttaccggtttccgtaccgtttacggtcgttaagggtacggttaaacgtttcggaacccgttacggggtaccgggggttaaccccggaaacgggttaaccccccggttaggggttaccccgttaaccccggtttccctaccccggtttacccggaacccccggttacccccgtaacccccgaacccgggttaaaccccggggtacccccg

SEQ ID NO: 210583 - DNA, 778 bp, Homo sapiens
  misc_feature: GYAE6OF01CJJOI.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattggaggaagccgtggggcgtcgagtgagcgttgcctgcaagtccttctggatacattcttcacttactttattctgtctaagttcgggtccgacgtacggccccgtggacaacggtccttgacctacgtagtgggagtaggataccaaaccgaccgactaccgtaccgggaacccccactacgtccgacccgtacggcccttaccgaacggtcgggttaccggttttcgttcctttccgtaccgtaggttacggtaactttacccgtcggttacgggttaccggggacgttccgtttagttccgttacgacgaacgtaaccttaaaccccgtaaccgttaccaaccgttcggaaccgtacctaaccgtttccggtttaccggttttttatttttacggaacgtacggtcggttaccggtttccgttcgttgtaccgtaagggtaggttaacgttcggtaacgtaccgggttacggggtacccgaaccggggttaacccgttccgggtaccctacccggttccccttaccggtacccgttacgtacccccttacccggaaacccgtaaccggggtccccc

SEQ ID NO: 210584 - DNA, 878 bp, Homo sapiens
  misc_feature: GYAE6OF01DDTLR.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtcgcccactcccaggtgcagcgtggtacagtcgtgggtctgaattggaggaacgccggtggggctcgagtgagcgttcgcctgacaacgtccttcgtggatacattcttacacgttactttattctgtacctaagttcggggtaccgaccgtaaccgggtcccccgtaggtaaccgaacgggtcctttacgaaccgtaacgtaggtaggggtaagtacggtaactaccgaaaccgaacccggtaacccaaccggtaacccgggaaacccccctaacgttactaccgaccgtaccggttacccttaccggacggtacggggtttcggttttaccgtttcccgtttaccgttaccgtacgtttaccggggtaaccctttccgtttaccggggtttacggtaccgggggtaccgggttactttaccgtaccgttacgaaccgtaacggttaaacctaaacccggttaaaccccttaccgtaaccgtacggaacccgtaccgttacgttaccgttttacgtttttagttttacggttacggaacggttacggtcgtttaccggttctacggtacgttaacggtcggttaatccggtttaaccgtaccggggttccgggtaacccgggtaaaacccgggttcccgtaccggttacccggtaccccgttacgtaccccgtccgtacccgtacccccgttccggaaccccggtacgggttaacccccg

SEQ ID NO: 210585 - DNA, 613 bp, Homo sapiens
  misc_feature: GYAE6OF01EPRTG.7.78.H01.1.454.CMB.1.raw
  modified_base (450)..(450): a, c, t, g, unknown or other
  misc_feature (450)..(450): n is a, c, g, or t
  modified_base (535)..(535): a, c, t, g, unknown or other
  misc_feature (535)..(535): n is a, c, g, or t
  modified_base (584)..(584): a, c, t, g, unknown or other
  misc_feature (584)..(584): n is a, c, g, or t
  modified_base (592)..(592): a, c, t, g, unknown or other
  misc_feature (592)..(592): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttctggatacatcttcactacttattctgtcaagttcgggtccgacacggcccctaggacaaggtccttgactacagtgggatggatcaacaccgacacgtacgggaaccccactatcgacccgacggtcccttacgaccgtacggggtcgttttcgtccgttctcccgtagtcggtactacccgttcgtcggtccggggtacgtctttacncgttcgactaagaacctaaccctaaccttccaaccgtgaccgactacgtcgtactttttattcgacgtgtacgtctcgtctgtcngtacgtattcggactaggcgggaccacgggtaccctggtccaccgttcncctcgacnccctaccgccgacggtccccg

SEQ ID NO: 210586 - DNA, 695 bp, Homo sapiens
  misc_feature: GYAE6OF01C1MPC.7.78.H01.1.454.CMB.1.raw
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacagtgcccactcccaggtgcagctggtacagtcgtgggtctgaattggaggaacgccgtggggcgtcagtgagtcgttgcctgcaacgccttctgatacatcttcactattattctgtcattcgggccgacgccggcccgtggaacacggtcctagtactacagtgggatggactacaacgaccgacaccgtacggaccccacgtacncgacccncgtccctcgacgcggtcgtttcgtcttctaccgtacgtacggtacttaccgtcgttcggtcgggtacggtcttcgtctacgactaacgtaaccttaaacctaacccttcctaacctcggaaccgtactccgttacgtttcgttttaacgttttcggaacgtagtacggtccgtttacgtcgttcgttacgtaggttacgtagttacggtaaccgttccgggtacgggtacccgggtaaccgggtacccgttcggtaccccgtacccggttacctacccgtaccgtaacccggtcccctaaaccccgaccggtaacccggtccccgg

SEQ ID NO: 210587 - DNA, 779 bp, Homo sapiens
  misc_feature: GYAE6OF01APQMN.7.78.H01.1.454.CMB.1.raw
  modified_base (252)..(252): a, c, t, g, unknown or other
  misc_feature (252)..(252): n is a, c, g, or t
  modified_base (550)..(550): a, c, t, g, unknown or other
  misc_feature (550)..(550): n is a, c, g, or t
tcagcgtgtctctacacgaccggtgctcgatttagtgtgagtagtttgggtttggggtacccgaacaaccacacccctcctaacgaagaagaccctacgaccacacgctccacaccatggactggacctgggaggatcctcttcttggtggcgagtagcaacaggtgcccactccacggtgcagctggtacagtctggtctgattgaggaagcctggggcgtcagtgagcgttgcctgcaaggtcctttcgngggtatactattcctttacacttacctttattcttgttactaagtttcgggtccggtaaccgacggtccccgtaggaccgtaacggtccgtttagaccgtacgtaacgtcgggtagtacggtacttacgaaccaaccgaccgtaaaccgtaccggggaaaccccctaaccgttacgtaccggcccgtaacggtccccgttacacggggtacgggttccgtttcgggttccttcgttcccgtagttacgggaacttcccgttacgttccgggttcggaccgggtacgtttactcggttnaccgtaagtaaccttaaaccgtaccttaacgtacccttcggaaccgtactacgtttacgtttccgtttttaacgttttcggttaacgtaggttaccggttcggttccgttaccgttcggttacgtacggttacggttaagttacgcgttaccgggtaccggtccggaacggtaccggttcgcccttaaccgggttcctacgtcgacctcccaccgtccggcgtaacccg

SEQ ID NO: 210588 - DNA, 819 bp, Homo sapiens
  misc_feature: GYAE6OF01AK1E9.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgatgaggacgccgtggggcgtcaggtgagcgttgcctgcaacgtccttcgtggatacactcttctacttacttattctacgtctaagttcgggttaccgaccgacggtcccccgtaggaaccgtaacggtccttacggacctacgagtagggatcggacttacaaaccgaccgacaccgtaccgggaacccctaccgtacgtaccggacccgacggtcccttacgaccggtacgggttaccggttttcgttaccttccgtaccgtacgtcggtaaccttccgttcgtacgggttaccgggtaacggttcttaccgtcgtacgtacgtaaacgtaaacctaaccctaacccttaaccgtaaccgttacggaacccgttacttacgttaccggtttacccgtttttaattttacgggaacggtttcgaacggttcccggttacggtttcttacgggttaccggtaaggttacggtaacggtttcggtaaccgttaccgggtaccgggggtaacccggttaaccgggtacccccggttgggttaccccgtacccgggttaccttaccccggtaaccggtcccgggttaaccccctaccccgggtaacccgtacccgggtacccccgg

SEQ ID NO: 210589 - DNA, 807 bp, Homo sapiens
  misc_feature: GYAE6OF01EZVCP.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggctcagtgagtcgttgcctgacaacgtccttcgtaggtatacctagttccttactacttactttattccgttgttacgtaagtttcggggtacccgaccgtaccggccccgtaggaacctaacgggtaccctttagaacctaccgaggttcggggtagttcgggaactaccgaaaccgaaccgaccgtaccggtaccgggaaaccccctacgtacgtccggacccctacggtaccccttacggaccgggggttcggtttcgttccgtttccgtccgtagttacgggtaaccttcccgttcgtcggggtaccggggtaccgttacgtttacttcggtacgtacgaacgtaaccgttaaaccctaacccttacgtaaaccccgtgtaacccgtacctacgtttaccgttaccgttttttaagttttaccgaacggtacgtcggtaccgttcgttacgttacgtacgtaggttacggttaatcggtaacgttcgggttcgggacccgtaacgggtacccttggggtaccctacccggttcctcccgtaccgtaccggtccccctacctaacccgggacccggtcccgttaacccggg

SEQ ID NO: 210590 - DNA, 904 bp, Homo sapiens
  misc_feature: GYAE6OF01BO736.7.78.H01.1.454.CMB.1.raw
  modified_base (188)..(188): a, c, t, g, unknown or other
  misc_feature (188)..(188): n is a, c, g, or t
  modified_base (271)..(271): a, c, t, g, unknown or other
  misc_feature (271)..(271): n is a, c, g, or t
tcagcgtgtctctacacgaccggtgctcgatttagtgtgagtagtttgggtttggggacccaacaaccacacccctcctaagaagaagcccctagaccacagcctccacaccatggactggacctggaggattcctcttcttggcggcagtagcaaacgaggtgcccactcccaggtgcagctggacncgtctgggtctagtaatggagaacgccgtaggggctcgaggtcgaggtcgtttcgcctggactaacggtccttgtagatactnttccttcacttaactttagttcctagtactaacgttcgggtacccgaacgtaccggtccccgttacggaacgtaacggtccgttagaactacgacggtggggtaactgggtaactaccgaaaccgtaaccggaccgtacgtaaccgggaacccctaagtacgcctaccgagtacccttacgaacggtcgggtgtttcgtctaccgtcagttccggtactaccgttcgacgggttaccgggtacgttccgttaacgttacgtacggtaccgtaagttaacccgtaaacccgttaaacccgtttaacccgaaacccgttacgggaaaccgttaacccgtaaccggttttaccggtttaacccgttttttaaggttttacccggttaacggtaaccgggttaacggttccgggtttacccggtttaccgttacggttaccggtaaaggtttacggttaaacggtttaccgtaaacgggtttaccgggttaccggggggtaacccgtaaaccgggggtttaaacccccggtagggttaacccgttacccggttacccgtttaacccggttaaccccgttaaccggttaacccccgttaaaccgtaaacccccgggtaacccgggtttaaacccccgg

SEQ ID NO: 210591 - DNA, 694 bp, Homo sapiens
  misc_feature: GYAE6OF01B76W1.7.78.H01.1.454.CMB.1.raw
  modified_base (223)..(223): a, c, t, g, unknown or other
  misc_feature (223)..(223): n is a, c, g, or t
  modified_base (258)..(258): a, c, t, g, unknown or other
  misc_feature (258)..(258): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcgttggtggcagtagcaacagggtcgcccactcccgaggtgcagctggtacagtcgtgggtctgaattggaggagccgtggggcgtnagtgagtcgttgcctgacagtccttctggatactntcttcacttacttacttctgtactaagttcgggtaccgacgtacggccccgtaggaccaacggtccttaggaactacgagtgggatggaactaccgaacgaccgacgtaccgtaccggaaccccacgtactccggacccgtacggtccttacgaacggtacggggttcgttttacgtccttctcgtagtacggtacttaccgtcgttagggtccgggtaacgttctttacgtctacgtactaacgtaaccttaaaccctaccttaacaccgtacggaacctacctacgttacgtttacttttagtttacgacgtaacggtctcggttccgttgtacgtgtacggtagtacttcgacgtccggtagggacccggtacggtaccgtcggtccctaccgtcttccgtacgtaccaccctacggaacccgacggtacccg

SEQ ID NO: 210592 - DNA, 836 bp, Homo sapiens
  misc_feature: GYAE6OF01AUJLI.7.78.H01.1.454.CMB.1.raw
  modified_base (184)..(184): a, c, t, g, unknown or other
  misc_feature (184)..(184): n is a, c, g, or t
  modified_base (246)..(246): a, c, t, g, unknown or other
  misc_feature (246)..(246): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctgtacngtctgggtctgaattggaggaagccgtggggcgtcagtgagcgttgcctgcaagtccttcgnggatacatcttcacttacttattctgtactaagttcgggtccgaccgacggccccgtaggaccgaacggtcccttaggaacttaccgagttggggaacttcggaacgttaccgaaacccgaaccgaaccgtaacccggttacccggggaaacccccctaaccgttaacgtacccggtaccccgtacggtacccctttaccgtaacgggtaccgggggtttaccggtttttcgtttaccggttccttaccgtaacggttacggtaaccttacccgttacgggttccgggtaccgggggttaaccgttcgtttaacgtcgtacggtacgtaacggtaaacctaaaccctaccgtttacccaaccgtaacggtaccgtaacctaccgtttcggtttacccgttttttaagtttttacgggaaaccgtcggttacgttaccggttcccgttaccggttcgtacggttaggttacggtaagtttccgggaacggttaccgggtacggggacccggttaaccgggtacccgtcggttcccgacccgttccctccgtacgacccggtaccctaacccggtaccgaaccgggttcccc

SEQ ID NO: 210593 - DNA, 736 bp, Homo sapiens
  misc_feature: GYAE6OF01DSI6F.7.78.H01.1.454.CMB.1.raw
  modified_base (500)..(500): a, c, t, g, unknown or other
  misc_feature (500)..(500): n is a, c, g, or t
tcagcgtgtctctacacgaccggtgctcgatttagtgtgagtagtttgggttggggacccaacaaccacacccctcctaagaagaagcccctagaccacagctccacaccatggactggacctggaggatcctcttcttggtggcagtagcaacgaggtcgcccactcccgaggtgcagcgtggtacagtcgtgggtctagaattggaggacgccgtggggcgtcaggtgagtcgttgcctgacaacgtcctttcgaggtaactactacttcttactaacttactttattctgtactaagttcgggtccacgcggtccctaggaacgacggtccttagaactacgtaggtggtatcggtaactaccgaaccgaccgactaaccgggtaccggaaacccctacgtacgtaccgaccgtacggtcccttacgacgggttacgggttcgtttcgtcttacgtaccgtagtacgtactaccgtcgtcgggtacggacgtcttanacgtacgtacaagtaaccgtaacctacctacgacgtacgacctacgtacgttacgtttacgttttagttacgtacgaacgtcgtcggttcgttacgtagttacgtaggttacgtaacttacggtaacgttccggggtcgggaacccggtaacggtaccccgtttacgtacccgttacccgtccgtacccgtcgacccgtaaccccgtaccccggaacggtaccccgggtaaccccg

SEQ ID NO: 210594 - DNA, 845 bp, Homo sapiens
  misc_feature: GYAE6OF01BRKAP.7.78.H01.1.454.CMB.1.raw
  modified_base (299)..(299): a, c, t, g, unknown or other
  misc_feature (299)..(299): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtcgcccactcccaggtgcagctggtacagtctgggtctgaattgaggagccgtggggcgtcaggtgagcgttcgcctgcaacgtccttcgtggactacacttcttacacttacttattcgtgtactaagttcgggtccgacncggaccctggacaacggtcctacgactacgagtgggatggatacaacgaccgacacgtacggaaccctactagtcgaccgacgtccttacgacgtagggtcgtttctcttctctagtcgtactcgtcgtggtcggggtacgtcttactcgtcgacgtaacgtaaccttaacccgtaaccttaccgtaaacccgttacgaacccgtaaccgttacccgtttaccggttttaacccggttttttacggtttttaaccggttaaccgggtaacggttaacccgggttacccgggtttcccgtttaccgttaggggtttaacccgttaggggttaaaccggtttaacggttaaccgggttaaacccgggtttaccggggtacccggggggttaaacccccggttaaacccggggggttaacccccgtttacgggttaaacccccgttacccccgggtttccttaacccccggttaccccggtaaccccggttaccccccggtttaaaccccggaaaccccgggggttaacccccgggttaaccccccggg

SEQ ID NO: 210595 - DNA, 852 bp, Homo sapiens
  misc_feature: GYAE6OF01BJ14L.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggagatcctcttcttggtggcagtagcaacagggtcgcccactcccgaggtgcagtcgttggtacaggtcgtgggtctaggtaattggaaggacgtccggtggggccttagaggttgagtcgttacgcctggactaacgttccttacgtggtaactactacttcttactaaccttacttttagttcttagtacgttaacgggttccgggtaccgtaacgtccggtaccccggtaggaaccgtaacggtccgtttacgaacctacgagttcggggtatacggactaaccgaacgtaccgaacaccggtaaccggaaacccctacgttagtacccgaccgacggttccttacgacgggtccggggtttacgtttccgtacgttcttaccgacgttcggttaaacctccggtttacggtaccggttacggggtaaccttttcgttacgttccgtaagaccgtaaacgtaacccttaaaccgtacctaaccgaacgtcggtaacctaccgtcgtttcgttttaaccgttttttagttaaccggaacgttcggtaacttcggtttagtccgttaagggttaccgtaaggttaccgtaaaggttcgtaaacgggttcggggacccgggtttaacccgggaacggtttaccgggtccgttaaccccgtacgtttccccgtaacgtcccgtacccggttaaacccggtccccggtaaaacccggccgggtttacccc

SEQ ID NO: 210596 - DNA, 797 bp, Homo sapiens
  misc_feature: GYAE6OF01A9SPO.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagtcgttgcctgcaagccttcgtggatacattccttacacttactttattctgtctaagttcgggtccgacgacggcccccgttgggaaccgaacgggtcctttaggaaccttacgagttggggtagtgggaactaccgaaccgaacccggaaccgaaccgttaaccggggaaacccccctaaccgtatccggaccccacggtcccctttaccgaaccggtaacggggttccgggttttaccggttcctttccgtacccgtagtcggttaacgttaacccttcgttcgggttaccggggacgttctttaacgtcgtcgactaagtaaccttaaacccgtaacccttacaacccgttagaaccgtacctacgttacggtttacccgttttttaagttttacggtaacggtacgtacgttccggttccgttacgttcggttacgtaggttacggtaagttacggtacgtaccgggtacggggacccgtagggggttaacccccttcgggtacccgtacccgttccttacccgtccgtacccgtaccccctaccgaaccccggtaacgggtcccccg

SEQ ID NO: 210597 - DNA, 999 bp, Homo sapiens
  misc_feature: GYAE6OF01BQUUO.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggctcgagtgagtcgttcgcctgcaagtccttcgtaggtatactactttccttacctaaccttacttttattccgttagttaccgtaagtttcggggtacccgtacgaccgggtacccccgtagggtaaccgaaccggtcccgtttacggtaaccttaacgaggttacgggggaacgtttacggggaacttaaccgaaacccgtaacccggaaccgtaacccgggttaccccggggtaaaacccccctaaccgtaaccgttacccggacccccggtaccggttccccgtttaacggaaccgggttaccgggggttccggtttttacggtttacccgttttacccgtacccgtaacggtttaccgggtaacctttaccccgtttaccggttacggggttacccggggggtaacccggtttacgttttaaccgttccggtaggtaacccggtaacggttaaacccctttaaaccccgtaaacccgttttaacccgaaccccgggttacggaaacccggttacccgttaaccgtttaccggttttaccggtttttttaacggtttttccggaaaccgggtaccggttacgggttacccgtttccggtttacgttccggttccgttaacgggtacggtttaaacgttcgggtaaccgtttaccggggaccgggggtacccgggtaaccgggttaaccccggttcgggtaccccgttaccccggtacccgttaccccgtaccggtaccccggttacccccctacgggaaaccccggtaccccgggttaccccg

SEQ ID NO: 210598 - DNA, 733 bp, Homo sapiens
  misc_feature: GYAE6OF01A9XS9.7.78.H01.1.454.CMB.1.raw
  modified_base (155)..(155): a, c, t, g, unknown or other
  misc_feature (155)..(155): n is a, c, g, or t
  modified_base (160)..(160): a, c, t, g, unknown or other
  misc_feature (160)..(160): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacnggtcncccactcccaggtgcagctaggtacagtcgtgggtctgaagttggaggaagccgtggggcgttcaggtgacggtcgttcgaccgttggacaacggtccttagtaggtaatacattccttacaaccttacgtttattctgtacgtaagttcgggaccgacaccggtccctagggaacctaaggtccttaagacctagaagtgggatggaactacgaaacgtaccaagaccgaacgggtaaccccactacgtcgaccgacgtccttacgaacggtgggttcctttactccttcgtaccgaagttcggaccttaccgttcggtgggtaccggacgttattacgtcttggaactacgaaacttaacccgtacgttacgaaccgttacgaacccgacttacgttacgggtttaccctttttaaggttaccgacggtacgtaacggttcctacgtttacgtacggtagttaacgtacggtaacttggtaaccggtacgtcggggtaaccgaccgggtacccttgggtaccaccggttcctaccgtcgacgtaccccctagaaaccccggtcggtacccc

SEQ ID NO: 210599 - DNA, 820 bp, Homo sapiens
  misc_feature: GYAE6OF01AVZII.7.78.H01.1.454.CMB.1.raw
  modified_base (249)..(249): a, c, t, g, unknown or other
  misc_feature (249)..(249): n is a, c, g, or t
tcagcgtgtctctacacgaccggtgctcgatttagtgtgagtagttgggtttggggtacccgaacaaccacacccctcctaagaagaagccctagaccacagctccaccaccatggactggacctggaggatcctcttcttggtggcagtagcaacaggtgccactcccaggtgcagctggtacagtctgggtctgtattgaggaagccgtggggcgtcgaggtgagtcgttgcctgcaagtccttcgnggatacattcttctactattattcgtgtactagttcgggtaccgaccgacggtccccgtagaacgtaaccggtccgtttacgacgttaaccgagttacggggaacgttagggtaactaaccgaaaacccgtaacccgggaaccgtaacccgtaacccgggggtaaaacccccctaaccggttacgtccgtaccccggacggttaccgttaccgacggtacgggttccggtttttacggttccgttacccgttccgtagttaccggtacgttacccgttccggtttcggtacccgggggtacgtcctttaacgttccgtacggacgtacgtaaaaccgtaacccgttaaaccccttacgaaaccccttgaacccgaaccgtttacccgttaccgggtttaccgtttttacgttttaccgtaacgggtacgtacggttcgtaccgtttcgtcttacggagttaacgtacgtagttacgtccgggaggtacccggtaaccgggttaccggttccggtcctacccgtcgtcccgtaccgtaccggaccccttacccgaaccgtcgggtacccccg

SEQ ID NO: 210600 - DNA, 752 bp, Homo sapiens
  misc_feature: GYAE6OF01AK5B5.7.78.H01.1.454.CMB.1.raw
  modified_base (208)..(208): a, c, t, g, unknown or other
  misc_feature (208)..(208): n is a, c, g, or t
  modified_base (562)..(562): a, c, t, g, unknown or other
  misc_feature (562)..(562): n is a, c, g, or t
  modified_base (647)..(647): a, c, t, g, unknown or other
  misc_feature (647)..(647): n is a, c, g, or t
  modified_base (703)..(703): a, c, t, g, unknown or other
  misc_feature (703)..(703): n is a, c, g, or t
  modified_base (724)..(724): a, c, t, g, unknown or other
  misc_feature (724)..(724): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccgaggtgcagctggtacagtctgggtctgaattgaggaanccgtggggctcagtgagtcgttgcctgcaagtccttcgtggactacagttcttacgacttacttattctgtctaacgttgggtccgaacgtacggtccccgtagggaccaacgggtcctttacggaaccttacgtaacgttcgggggaattacgggaactaccgaaccgtaacccggaacctacggttaccgggaaaccccctaccgttaactccggacccctacggtcccctttacgacggtacggggtcggttttacgtccgttacctccgtagttcgggtaaccttacccgttcgtacgggtccggggtaacgttcttaggtacctggaacctaggtaaccttaaaccccnctttacgaacccttggaaccccgaataccgtttagtaccggttttttattacgggaacgtaacggtcgtcggtttacgttacgtnttaccggtaggttacgtaagttcgacggtccgtacggggccctacggggttacccngttccaccgtcctaacccgtnacccgttcccaccgtcgaaccggtcccg

SEQ ID NO: 210601 - DNA, 735 bp, Homo sapiens
  misc_feature: GYAE6OF01A94PS.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggctcagtgagtcgttgccgtgacaacgtcccttcgtaggataccattcttacacttactttattcgtgtactaagttcgggtccgacgtacggcccctaggacaaggtccttagactacagtgggatggactacaaccaccgactaccgtaccgggaacccctacgtatccgacctacggtcccttacgacggtacgggttccggttttcgttccttccgtaccgtagtacggtaacttaccgttcgtacgggtccgggtacgttcttacgtcgtcgtacgtaagtaacctaaccgtaaccttaccaaccgtacgaaccgtactacgttcggtttactttttacgtttagtacggtagtacggttccgtacgttcgtacgtacgtaggtcgtaacgttcggtaccgttccgggtaacggggtacccggaaccgggttacccgtacgggttacccctacccggttcctacccggttacccgaccgttaccccctaacccgaaccgggtaccccggtacccccg

SEQ ID NO: 210602 - DNA, 669 bp, Homo sapiens
  misc_feature: GYAE6OF01B86MZ.7.78.H01.1.454.CMB.1.raw
  modified_base (376)..(376): a, c, t, g, unknown or other
  misc_feature (376)..(376): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgattgaggagcgtggggcgtcagtgagtcgttgcctgcaagtccttcgtggatacattcttcacttatttattctgtactaagttcgggtaccgacgacggcccctaggaacgaacggtccttagactacgagtgggatggactaccaacgaccgacaccgtaccgggaacccctactacncgccgacgtcctacacggtacgggtcgtttcgtccttcctcgtagttacggacttaccgtcgtacggtcgggtacgtcttacgtcgtcgactacgtaaactaaccctaacgttaccaacccgtagaaccgtacttaaccgttcgtttacccgtttttaagttttacgaacgtacgtacgttccggttcttcgtgtacgtaggtataacgttctacgtcggtacgggacgtaccggtacctcggtccgaccgttccttccgtacgtcccgacctccgaaccgtaccggtacccg

SEQ ID NO: 210603 - DNA, 717 bp, Homo sapiens
  misc_feature: GYAE6OF01BHVJA.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcgagtgagcgttgcctgacaagccttctggatacatcttcacttacttattctgtcaattgggtaccgacgacggcccctaggacaacggtacttgactacgagtggggatgggactacaacgaccgaacgaccgtacgggaaccccacgtactcgacccgacggtccttcgacgcggggttccgtttacggttcctttcgtcctacgtcggtaacttaccgtcgtacgggtccggggacgtctttactcgtcggactagaaccttaacccaaccttacaacccgtagaaccgactacgtacgtttaccgtttttagttttacggaacgtacgcgtccggttacgttcgttacgttcgtaaggttgtaacgtttcggaaccgttcgggtaccgggggtaaccgtacccggggttaaccctcggggttaacccaccccgtttaccggttaccctaccgacccggtaccccgttacccgaaccggtaacccggggtaccccg

SEQ ID NO: 210604 - DNA, 853 bp, Homo sapiens
  misc_feature: GYAE6OF01A62G2.7.78.H01.1.454.CMB.1.raw
  modified_base (185)..(185): a, c, t, g, unknown or other
  misc_feature (185)..(185): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagatcctcttcttggtgcagtagcaacgaggtcgcccactccgaggtgcagctggtacngtcgtgggtctagaagttggaggacgccgtggggctcagtgagtcgttcgcctgacgaacgtccgttacgtaggtaactactcttacttaccttacttacttacgttcgtagttacgttacggttcggtaccgaccgtaccggtcccgtacggtaccgtaacggttccgtacgtaactacggtaggtcgggagtacggtaacctaaccgaaccgaaccggtaacgtaacccggtacccggtaaccccgtacgttacgtcccggaccggtaaccgtccgtaaccggtaacgggttcggtttacgtttccgttccgttaccgtacgttacggttaccgttaacttacccggttacgggtaccgggttaccggtacgttaccttacgtccggttaacgtaccgttaaaccgttaaccgttaaacccgtaccgttaacccgtaaccgaacggttaaccctaaccggtttcgtttaacggttttaccgttttacgttaccggtaacggtacgtacggttccgtcgttcggtacggttacggttacggtacgttaacggttaccggtacggttaccggggtaaccgggtaacccgtacgggttaccgtacggttcccgtaccttccgtaccgtacccggaaccgtacccgtaccgacccgggtaccggtacccg

SEQ ID NO: 210605 - DNA, 545 bp, Homo sapiens
  misc_feature: GYAE6OF01A6A38.7.78.H01.1.454.CMB.1.raw
  modified_base (532)..(532): a, c, t, g, unknown or other
  misc_feature (532)..(532): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccgacacggcccctggacaaggccttgactacatgggatggatcaacaccgacactacgggaaccccactatcgcccaggccttcacgacgggtcgtttgtcttctccatggactacctgtcgtcgggacgtcttactctgacagactaaccacttccacctgaccacactcgtcgttttatttgacgagtcgctcgtctgtcagtgatgactcggtgggcgtacggtacctggtccaccggtctctcactcccnccacgcggtcccg

SEQ ID NO: 210606 - DNA, 704 bp, Homo sapiens
  misc_feature: GYAE6OF01BXJOK.7.78.H01.1.454.CMB.1.raw
  modified_base (229)..(229): a, c, t, g, unknown or other
  misc_feature (229)..(229): n is a, c, g, or t
  modified_base (381)..(381): a, c, t, g, unknown or other
  misc_feature (381)..(381): n is a, c, g, or t
  modified_base (664)..(664): a, c, t, g, unknown or other
  misc_feature (664)..(664): n is a, c, g, or t
tcagcgtgtctctacacgaccggtgctcgatttagtgtgagtagtttgggtttgggacccaacaaccacacccctcctaagaagaacgcccctagaccacagctccacaccatggactggacctggagatccttcttcttgggtggcagtagcaacgaggtcgcccactcccgaggtgcagctggtacagtctaggtctagtaatggaaggaacgccggtggggccgtnaggtgagtcgttgacctaacacgtccttgtaggactactattccttctaacttacttattctgtactagttcggacacgtaccgcctaggacaggtcctagactacgagtggatggactacgaacaccgactacgaccggaacccctactanccgaccgtacggtcctacgacggtacgggtcgtttcgtcttacgtctaaggtcgtaccttaccggttcgtaggggtacccggtacgttcttacgtgtacgcaaagttaccctaaacctaaccttacaaacggttcgaacctactacgtttcgttaccgttttagtttacgaaccgtggtacctcggttcgttccgtagtaccgtaggtaacgtagttacggtacgtaccgggcgggtaaccgtacccgggtaccttagggccttaccccgtccttacccgacncccgttaccccgagaaccccgtaacgggttcttaccccgg

SEQ ID NO: 210607 - DNA, 872 bp, Homo sapiens
  misc_feature: GYAE6OF01DHNPN.7.78.H01.1.454.CMB.1.raw
  modified_base (792)..(792): a, c, t, g, unknown or other
  misc_feature (792)..(792): n is a, c, g, or t
tcagcgtgtctctacacgaccggtgctcgatttagtgtgagtagtttgggttgggacccaacaaccacacccctcctaagaagaacgcccctagaccacagctccacaccatggactggacctggaggatcctcttcgttggtggcagtagcaacgaggtcgcccacctcccgaggtgacgagtcgtggtactacgtcgtgggtctagaagttggacggacggccggtggggtctcgtagtgagtcgttcgcctaggacagtccttgaggatactagttccttactacttacttattcgtgtacgtagttcgggtaccgacgccggcccgtaggaacgtacgggtccttacgaacctacgtgtagggtagtacgtaactaccgaaccgtaccggaacgtaccggtaacccgggtaaaccccaaccgttacgacccggaccccgtacggtaccccttacggaacggtcggggtttaccgttttcgtaccgtttaccctacgtacgttacggtaccttacccggttcgttaccgggggtcccgggtacggtttacccttacggtccgttagtaccgtaaacggttaaaccctaaacccggtttaaacccttaaccggaacgttacccggtaaaccgttacccgtacgttaccggttttaaccgttttttaaggtttaaccggtaacggtacggttaccgttccggtacgtttccgttacggtcgttaacgggtcggttaacggttaccggtaacgttacggggaccggtacccgggtaaacccggggttacccnccggggtttaccccaaccttccccggtactaccccggtaccgttaacccccaacccggaccccgggtaaccttccccggg

SEQ ID NO: 210608 - DNA, 697 bp, Homo sapiens
  misc_feature: GYAE6OF01BBUTS.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattcctgtctaagttgggtccgacacggcccctggacaaggtccttgactacagtgggatggataccaacgaccgtacacgtacgggaaaccccctaccgtatccgacccgaacggtcccttacgaccggtaggggtcccgttttgtacctttccgtaccctagtcgggtaactaaccccgttcgtacgggtaccgggggacgtacctttagtccttaggcctaaggtacctaaaaccctacccttaccaaaccgtgaaccgtacctacgtttcggtaccgtttttattttacggtaccgtaacggtacgtccgtacgttcgttcgtacgtaggtacggtaattggtaccttacggtggggaccgtacgggtaccctacgggtcctacccgggtctcccgtacacgtacccctccggaacccgtagggtccccc

SEQ ID NO: 210609 - DNA, 805 bp, Homo sapiens
  misc_feature: GYAE6OF01CKJFP.7.78.H01.1.454.CMB.1.raw
  modified_base (251)..(251): a, c, t, g, unknown or other
  misc_feature (251)..(251): n is a, c, g, or t
  modified_base (674)..(674): a, c, t, g, unknown or other
  misc_feature (674)..(674): n is a, c, g, or t
  modified_base (769)..(769): a, c, t, g, unknown or other
  misc_feature (769)..(769): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttctggtggcagtagcaacaggtcgcccactcccaggtgcagctggtacagtctgggtctgaattgaggaagccgtggggcgtcagtgacgcgttgccgtgacgaacgtccttcgnggtaacttaccattccttactaaccttacttttattcctgtactaagttcgggtacccgaacgacggtacccctaggacgaacggtcgttacgaactacaggtgggtaagtcggactaccgaaaccgtacccgaaccgtaccggtaccgggaaaccccctacgtacgtaccgacccgtacggtccccttaacgaccggtacggggtttcccggttttcttcccgtttaccgtacccgtagttaccgggtaacctttaccccgttacgttaccggggttccggggaaccgtttcccgtttaacgtccgttaggtaccgtaaaacccgttaacctttaaaacccccgaaccctttaacccgaacccgttcggtaaaccgaccctacggttccgtttttaaccgtttttaatttaccgggtaacgnggtaaccgtcgttcgttcgtagtagtacggtagttagtccggtactccggggtaacggcgtaacccgggtcttaccggtccttaccgtcccttanacccgtccgacccctaaccgacccggcggtaccccg

SEQ ID NO: 210610 - DNA, 712 bp, Homo sapiens
  misc_feature: GYAE6OF01DRILY.7.78.H01.1.454.CMB.1.raw
  modified_base (248)..(248): a, c, t, g, unknown or other
  misc_feature (248)..(248): n is a, c, g, or t
tcagcgtgtctctacacgaccggtgctcgatttagtgtgagtagtttgggtttgggaccaacaaccacacccctcctaagaagaagcccctagaccacagctccacaccatggactggacctggagatcctcttcttgggtggcagtagcaacaggtgcccactcccaggtgcagctggtacagtcgtgggtctagaattggaggaagccgtggggcgtcagtgagtcgttgcctgcaagtccttcgnggtactactattccttactaaccttactttacttcgtagtacgtaagttcgggtacccgacgacggcccttaggacaacggtccttgaacttacgaggtgggatggactcaacgacccgaacaccgtacgggaacccctacgtactacgcccgacggtccttacgacggtacggggtttcgttttcggtccttactacgtacgtaacggtctttaccggtcgttagggtaccggggtacgttcctttaatccgtagacgtaacgtaaccctaacctaacttacaaccgttacgacctacgtcttacgtttacgttttacgttttagacgtacgtcgtacgtcggttactgtagtacggtagtaacgtcgtacgtacggtccgggtaccaacgggttcccgtcggttacgtacccgtccttacccgtaccgtacgtcccctaacccggtaaccgaccggtccccg

SEQ ID NO: 210611 - DNA, 607 bp, Homo sapiens
  misc_feature: GYAE6OF01CGTLV.7.78.H01.1.454.CMB.1.raw
  modified_base (242)..(242): a, c, t, g, unknown or other
  misc_feature (242)..(242): n is a, c, g, or t
  modified_base (330)..(330): a, c, t, g, unknown or other
  misc_feature (330)..(330): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttcnggatacatcttcactacttattctgtcaattggtccgacacggcccctggacaaggccttggactacagtggatggatcaacaccganactggaaccccactatcgccagccttcacgagggcgttttgcttctccattcggacttaccctcgttggtccgggtacggtcttacgtcttgctagactaaccaaccttcaacctgaccgactacttcgtccgttttattttacgaacgtagacgtcgttccgtcttcgttacgagttggtaaactttgaccttacgtcggggacctaacggggtaaccctcgggtaccacccggttctcccgtactacgcccctaccgaccccgaacgggtacccc

SEQ ID NO: 210612 - DNA, 726 bp, Homo sapiens
  misc_feature: GYAE6OF01BDEYD.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagtcgttgcctgcaacgtccttcgtggactacattcttcacttactttattctcgtactaagttcgggtcccgacgaccggtccccgtaggaacgtaacggtccttacgactacgagttgggatggactacaacaccgacacgtaccgggaaccccactacgtccgccgacggtcccttacgacggtacggggtcgtttcgttccgttctacctagtacggtacttaccgtcgtcgggtaccgggtacgttctttagccgtagaacctaagtaacctaaccctaccttaaccgaaccgtcgaaccgtaccttacgttaccggttttacgttttttaacgtttcgggaacgtggttaccgttccgttcgttcgttacggtacgttaacggtacggttaattccggtaacgttccggggaccggggtaccctacggggttaccctcggtaccctaccggtcctacccgctacccggaccctacccggaaccggtccggtaccccg

SEQ ID NO: 210613 - DNA, 843 bp, Homo sapiens
  misc_feature: GYAE6OF01AN27K.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggactcctcttcttggtggcagtagcaacaggtgcccactcccgaggtcgcagctggtactacggtcgtcgggtactgaagttggaggaacgtccgtggggctcgagtcgagtcgttcgcctcgacgacgtcttcgtaggactactatctactacttacttacttcgtgtactaaggttccggccgacgaccggtccccgtaggaaccgtacggtaccttacgtaacctacggtaggttacggggtacgtcgggtaactaccgaaacccggtacccggacgtaacccgggttacccgggtaaaacccccctcgttacgtacccggacccgtaacggtaccccttacgggaaccggtacggggtttcggttttacgttacccttcccgtacgtaacggtcggttacgttacccttcgggttaccgggtacgggtccgttacgttcgtacgtacgtaccgtaacggttaacctaaacctacccgttaacgacctaacgtaccggtaactaccggttttacgtttaccgtttttaaggttacggtaaccgtaacgggtcgtttaccggtccgtttacggtacggttacgttaggttaacgtccgtaacccgggtgtaaccgggttaccgggtacccgggaaaccgtttcccggtacgtaacccgtcccggttactcccggtatccccggtacccctacgggtcccgaaccggtaccccg

SEQ ID NO: 210614 - DNA, 820 bp, Homo sapiens
  misc_feature: GYAE6OF01C4X6G.7.78.H01.1.454.CMB.1.raw
  modified_base (171)..(171): a, c, t, g, unknown or other
  misc_feature (171)..(171): n is a, c, g, or t
  modified_base (792)..(792): a, c, t, g, unknown or other
  misc_feature (792)..(792): n is a, c, g, or t
tcagcgtgtctctacacgaccggtgctcgatttagtgtgagtagtttgggttgggacccaacaaccacaccctctaagaagaacgccctagaccacagctccacaccatggactggacctggagatcctcttcttggtggcagtagcaacgaggtcgcccactcccaggtncagctggtacagtctgggtctgaagttggaggaacgccgtggggctcgagtgacgtcgttacgcccgtgacctacgtccttacgtaggtaactactacttccttactaacttactttacgttctacgttacgtaacggtttccgggtaccgaacgaccggtaccccgttaggaaccgtaacggtcccttaagaaccgttacgtaggtgggtaattacggaactaaccgaaaccgaccgtaaccgtacccggtaacccgggtaaaccccctaacgtacgtccggtaacccgtacggttaccttaccggaaaccgggttcggggtttccgttttccgtcccgttaccgtacgtaacgttcggtaaccctttccgttaacgggtccggtaaccggggtaccgttcttacggtctacgaacgtaacgttaaacccgtaacctaaccgttaccgaaccgttacgacctaccgttactttaccggttttacgttttaagttccggaacgtcgtaccgttccgttcgtacgttcgtaacgttaggtgttaaacctggtaaaccgtcggggtaaccgggaccgtacggggtaccccttggtacccccgtcttccgacgtacccgaaccnccccgtaaccgggaacccgttcgtcccg

SEQ ID NO: 210615 - DNA, 754 bp, Homo sapiens
  misc_feature: GYAE6OF01DYPRC.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcagtgagcgttgcctgcagccttctaggatacattcttacacttacttattctgtctaagttcgggtaccgacgtacggccccgtaggactaacggtccttagactacagtgggatggactacgaacaccgacaccgtacgggaaccccactatcgcccgaggtccttacggacggggtcgtttcgtccttcgtaccgagtcggtactaccgtcgtggtcgggacgttctttacgtcgtagactaacgtaaacttaaaccctaaccgtttaccgaaaccgttacgaacccgtaaccttaccggttacgtttaccggtttttttaagttttacggaaaccggttaggtacggttaccggtttccgtacgttggtaccgttaacgggtaacggtaacgtttacggaacgtttacgggaccggggtacccggtaaaccggggtaaccccttggggtaccccttaccggttccccgttacccgtaccggtaaccggtcccccctaacccggaaccccgggtaacgggtccccttacccggg

SEQ ID NO: 210616 - DNA, 746 bp, Homo sapiens
  misc_feature: GYAE6OF01AOL3J.7.78.H01.1.454.CMB.1.raw
  modified_base (185)..(185): a, c, t, g, unknown or other
  misc_feature (185)..(185): n is a, c, g, or t
  modified_base (719)..(719): a, c, t, g, unknown or other
  misc_feature (719)..(719): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtcgcccactccaggtgcagctggtacngtctgggtctagaagttgaggagccgtggggcgtcagtgagcgttcgcctgactaacgtccttcgtggaactacactcttccacttacttattcgtcgtacgtagttcgggtaccgacgtaccggtccccgtaggacgtacggtccttacgtaactacgaggtacggagtcggactaccgaaccgaccgacgtaccggtaccgggaacccctaccgtacgtaccgcccgacggtcctacgacgggtcggttaccggtttcgttccgttccgtaccgtagtacggtaccgttacccgtcggttcgggttaccgggtccgttacttacgtcgtacgacgtaacgtaacgtaacccgtaccttaacgtaccgacgtacgtaccgtaccgttacgtttaccgttttagtttacgtaacgtagtaccgttccgttgttctacgttagtaacgtacggtatccgtacggtaccggacgggtaccggtaccgggtaccgtccggttaccgtacccgtccgtaccgtcgtacccgttacccncccggttaaacggaacccggttcccgg

SEQ ID NO: 210617 - DNA, 753 bp, Homo sapiens
  misc_feature: GYAE6OF01D9IOX.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggagccgtggggcgtcagtgagtcgttgcctgcaagtccttcgtggactactattcttacacttactttattctcgtactaagttcgggtccgaacgtacggcccccgtagggaaccgaacgggtccctttagaaccgttaacgacgtggggtagtcgggaataccaaaccgaccgaacaccgtaccgggaacccccactactccgacccgagtcccttacgacgtacggggtcgttttcgtccttcctccgtagtcggtaacttacccgtcgttcggtaccggggacgttcttacgtcgtcgactaacgtaactaaaccccttaacctacgaaccgtacggtaaccaccgtacgttcgtttaccgttttttaatttcggtacggaacgtacggttccgttaccgttgttagtacgtaggtaggtaaccttcgggtacgttaccgggcggggtaccccgtaaggggttaacccctgggtttaccccgaccccgttacgttccccgtacgtacccgtaccccgttacccccgaaccgggtaccggtacccccg

SEQ ID NO: 210618 - DNA, 956 bp, Homo sapiens
  misc_feature: GYAE6OF01DOGKR.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggtgcgtcagtgagcgttgcctgcaagccttcgtggatacacttcttcacttacttattctgtctaagtttcgggtaccgaccgacggccccctagggaaccgtaaacggtccctttacggtaaccgtaacgtaacggttaggggtacgtagggtaactaccgtaaaccgaacccggtaaacccgtaaccggttacccggggaaaaccccccctaaccgttaaccgtaccggacccccgtaaccgggtccctttaccgtaaccggtacgggggtttaccgggttttacgttccgtttacccgtcccgtaacgttcggtaaacctttacccgttaccggttacggggttaccggggtaaccggttaccgttttaaccgttccgtacgtaccggaaacgtaaaccgttaaaacccctaacccgtttacccgtaaacccgttaccggaacccgttaaccgtaaccgttttccggtttaacccgttttttttaagtttttacggaaaccggttacgggttaaccggttaccggttaccggtttaccgtttacggttaccggttaggggtttaacggtaaaacgttttacgggtaaacccgtttacgggggttacccggggggtaaaccccgtaaaccggggggttaaccccctttccggggttaccccgttaaccccgggtttcccgtttaccccgttaaccgtaaccccggtacccccgttaccccgggtaaacccggtaaacccccgggg

SEQ ID NO: 210619 - DNA, 758 bp, Homo sapiens
  misc_feature: GYAE6OF01AQOAF.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtcgcccactcccaggtgcagctggtacagtcgtgggtctgaattggaggaagccgtggggcgtcaggtgagtcgttcgcctgacaagtccttcgtggatacattcttctacttacttattctgtacgtagttcgggtaccgacgaccggtccccgtaggaaccgaacggtccttagactacgaggtaggacgtacggactaccgaaaccgaccgactaccggtaccggaaacccctacgtacgtccgaccgtacgtcctacgacggtacgggttcgtttctccttccgtcgtagtcggtactaccgtcgtcgggtaccgggtacgttcttacgtcgtacgtacgtaacgtaacccttaacccgtaaccgttaactaacccggtacgaacccgttaaccgttacggtttaccgtttttaacccggttttttaagttacccggtaagtaccggtaacggttcggtttaccgttcgttcggttaacgtgttaacggtaacgttaccggtacggtaccggacggggtaacccgtaccggtaccgttcggtacccttaccgtccgtacccgaccgtacgacccctaccgaacggtaccggtcccc

SEQ ID NO: 210620 - DNA, 887 bp, Homo sapiens
  misc_feature: GYAE6OF01AYJ8Z.7.78.H01.1.454.CMB.1.raw
  modified_base (253)..(253): a, c, t, g, unknown or other
  misc_feature (253)..(253): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggctcagtgagcgttgcctgcaagtcccttcgtggatacnttcttcacttactttattcttagtctaagttcgggttaccgacgtacggcccctaggaacgaacggtccttcggacctacgagttggggatacgggacttacgaaaccgtaccgaacaccggttaccggggaaaccccctaccgtagtaccggacccgacggtacctttacccgaacggtccggggttccggttttacggttacccgtttaccgtaccgttaggttacggttaacctttaacccgttcggttaccgggttacccgggggtaacgttccggttttaaacgtccgtttcggaactaaaccgggtaacttaaaccccgtaaccgtttaacccaaccgtaccggaaccgtaccttaacgttaccggtttacccgtttttaagttttacgggtaaccgtaacgggacgttccggttaccgttaccggtttacggttacgttaacgggttacgggttaaaacttttaccgggaaacgttttaccccgggtagggggtaccccggaaaccgggggttttaaaccccggcggtttaacccccgacccggtttttcccgaacccccggttacggtaaaccccgttacccccgtttaaacccgggaaacccgggttcccccggtaaacccccgg

SEQ ID NO: 210621 - DNA, 778 bp, Homo sapiens
  misc_feature: GYAE6OF01CALFF.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtcgcccactccccaggtgcagctggtacagtctgggtctgaattgaggagcctggggcgtcagtgagcgttgcctgacaagtccttcgtggatactatccttcacttactttacttctgtctaagtttcgggtacccgacgacggtcccccgttggaaccgaacggtcccttggaacctacgaaggttggggagtaggactaccgaaacctacccggaaccgacccgtaccggggaaaccccccaaccgtactccggacccgtacggtcccttacgaccggtacggggtcggttttcgttcgttccctaccgtacgttacggtaccttacccttcgtcgggttaccggggtaccgttactttacgtcgtcgtacgacgtaaacctaaccctaaccttaccgtaacctcgaaccgtacctacgttccgtttaccgtttttaagtttacgtaccggtaagtacggttccggttccgttacgttacgtacgtaaggttacggtaagttaccggtaaccgttcgggaccgggggtaccgtaccggggttaaacccctgggtaccctaccccggttccttcccgtacctaccgtacccctacccggaaccggtaccggtacccccg

SEQ ID NO: 210622 - DNA, 744 bp, Homo sapiens
  misc_feature: GYAE6OF01BQ9KF.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcagccttctggatacatcttcacttacttattctgtctaagttcgggtccgacgacggcccctaggacaggtccttgactacagtgggatggactacaacaccgacaccgtacggaaccccactactcgaccctaggcctacgacgacgggtcgtttacgtcttcgtacctagtcggtactacccgtcgtcggtacggggtacgtcgtttactccgtcgactagtaacctaaccctaacccttaccgaaccgttcgaaccgtactaccgttacggtttacccggttttttaattttacgggtaacggtaacggttaccggttccggttacggttaccttgggtaccgttagggttacggttaacgtttcggtaaccgttaccgggtccgggggtaacccgtaaccgggggttaaccccgttcggggttaccccgtaccccggtttcccgtaccccgttaccggacccgtacccccgttacccgtaaacccgggtaaccgggtaccccccg

SEQ ID NO: 210623 - DNA, 700 bp, Homo sapiens
  misc_feature: GYAE6OF01EWFXI.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggctcagtgagcgttgcctgcaagtccttctggatacatcttcacttacttattctgtactaagttggtccgtacacggcccctaggaaccaggtccttgactacagtggggatggactacaaccgaccgacaccggtacgggaaccccctaccgtaatccgacccgaacggtcccttacgaccgtaacggggtccggttttcgtcccgtttacctaccgtagtcgggtaacttacccgtcggttcgggtaccggggtacggtccgttacgttccgtcgtacgaagtaacctaacctaacccgttacctaaccgtacgaccgtactaccgttccgttaccgttttacgttttacgtacgtacgtacgtcgttacgtcttcgtacgtaggtacgtaagttcgtacgtacgtacgggtaccggtacggtaccgtacggtccgacccgtacctcccgtacgtaccgacctcccgaaaaaccgtcggtacccg

SEQ ID NO: 210624 - DNA, 921 bp, Homo sapiens
  misc_feature: GYAE6OF01CD8YU.7.78.H01.1.454.CMB.1.raw
  modified_base (179)..(179): a, c, t, g, unknown or other
  misc_feature (179)..(179): n is a, c, g, or t
  modified_base (235)..(235): a, c, t, g, unknown or other
  misc_feature (235)..(235): n is a, c, g, or t
  modified_base (355)..(355): a, c, t, g, unknown or other
  misc_feature (355)..(355): n is a, c, g, or t
tcagcgtgtctctacacgaccggtgctcgatttagtgtgagtagtttgggttgggacccaacaaccacacccctcctaagaagaacgcccctagaccacagcctccacaccatggactggacctggagactccttcttcttggtggcagtagcaacgaggtcgcccactcccgaggtcncagcgttaggtacagtcgtcggtctagaattagaggaacgcggtgggctacagagngtcgttacgctgactacgtccttcgagactactctacttacgtacttatttcttcgtatacgtacgtcggtaccgaccgcggtacccgtagacgacggtccttagactacgaggtacggntacggtactaaccgaaccgaacccgacgtaaccgggtaacccgaacccctacgtaccgtccgtacccgtaacggtaccgttacggacgggttcggttacggtttctccggtttcctacgtaggttacgtaccgtttaccgtacgggtttaccggtaccggggttccgttacgttaacgttccgtaacggtaacctaaacgttaacccttaaacccgtttaaccgttaacccgtaacccggttaacgaacccggttaacccgtttaccgggttttacccgtttttaacggttttttaaccgttaacccgggtttaaggtaaccgggtttaacccggttacccggttttacgttaacccggtttcgttaacgggttaagggtttaaccggtaacggtttacccggggtttaaacgggtaccccgggttacgggttaaaccccgggggttaaccccggttacccggtttaccgggttccccctttaaccccggggttcccttacccgtaccccggttaaaccccgcccccgtaaacccggtacccccgggaacccggtttaacccccgg

SEQ ID NO: 210625 - DNA, 872 bp, Homo sapiens
  misc_feature: GYAE6OF01EK8YT.7.78.H01.1.454.CMB.1.raw
tcagcgtgtctctacacgaccggtgctcgatttagtgtgagtagtttgggtttgggacccaacaaccacacccctcctaagaagaacgcccctagaccacagcctccacaccatggactggacctggaggatccctcttcttggtggcagtagcaacaggtcgcccactccaggtcgcagctggtacagtcgtggtctgaattggaggacgtccggtggggccgtacgaggtggacgtcggttcgccgtgactaacggtccctttcgtaggaattacctacttcgttactaacgtttactttattcgtattacgtaagttcgggtaccgtaacgccggtaccgtacggacgtaacggtccgttacgtacctacgtacggtaggtacgtcgtaactaaccgtaaccgaaccgtaaccgtacccggtaccgaaaccccctactacgtccgtacccgtacggtccgttacgaaccggtacgggtttccggtttcttaccgttccgtaccgttacgtacggttaacccgttccccgttacgggtaccgggtttaccggggacccggttacttttaaccggtacgtttacgaacttaaaccggttaaaccccttaaaaccgttacccctttaaacccgaacccggttaacccgaaccttaaccgtacccgtttttaccgtttaccgttttttaacgttttaccggaccgtaagttaccgggttccctttagggttaccctttggtaactagggttaccgggtttatacggaccggtttacgggacccggttaccggaacccggttccgtacggttaccccgtccgttacccgaccgtcccgacccgtaacccctcccgggaacgtcccggtaccccg

SEQ ID NO: 210626 - DNA, 858 bp, Homo sapiens
  misc_feature: GYAE6OF01AWG90.7.78.H01.1.454.CMB.1.raw
  modified_base (220)..(220): a, c, t, g, unknown or other
  misc_feature (220)..(220): n is a, c, g, or t
  modified_base (256)..(256): a, c, t, g, unknown or other
  misc_feature (256)..(256): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtcgtggtctagaattgaggacgccgtggggcgtnagtgagtcgttgcctgacaacgtccttgtgatactntcttcacttacttattctgtactaagttcgggtacccgtacgaccggtccccgtaggaaccgtaacggtccttacggaccttacaggtagggtagtaggtacgtaaccaaccgaacccgacgaaccggtaccgggtaaaccccctacccgtactcccggacccgtaacggtccccttaccgaccggttacggggttccgttttacgttcccttccttcccgagttacggtaaccgtttacccgttcgtccgggttacggggtaccgtcctttaagttcgtacggtactaaaccgtaacccttaaacccgttacccgttacccgaacccgttcggaacccgttaccctaacggtttcccgttttaaccggtttttacgtttttaccggtaacggtcggtaacgggttcccgtttaccggtttcgttcggttaaccgttaagggtttacggtaacgtttacggtccgttaaaccgggtcccgggggtaaacccggtaaccgggtaccccgggttcgggttacccccacccggtttcccacccggtttacccgaccccgttaccccccgaaccggtaaaccccggggtccccggttaacccccgg

SEQ ID NO: 210627 - DNA, 873 bp, Homo sapiens
  misc_feature: GYAE6OF01BQ70K.7.78.H01.1.454.CMB.1.raw
tcagcgtgtctctacacgaccggtgctcgatttagtgtgagtagtttgggtttggggacccaacaaccacacccctcctaagaagtaagcccctagaccacagctccacaccatggactggacctggagatcctctcttggtgcagtagcaacaggtgcccatcccaggtgcagctggtacagtctggtctgaattgaggaagccgtggggcgtcaggtgagcgttgcctgcaagccttcgtggatacatccttcgacttacttattctcgtacgtaagttcgggtaccgacgtacggacccccttagggaaccgtaacgggaccctttacggtaaccgttacgaacgttaggggattacgggaattaccgaaaccgaacccgtaacgaaccgttaccggggaaacccccctaacctaacgtaccggtacccgtaacggtcccttacgtacgtaacgggggtttccgttttacgttcccgttttaccgaccctaacggttcggtaaccgttaacccttcggttacgggttaccggggtaaccgttcttaaccgtccgttacgaccgtaaccgtaaacctaaacccgttaaccccgtttacgaacccgtttacggaacccgaccctaagtttcccgtttaccggtttttaacttttaccgggttaaccgtaacggttaccgggttacccgtttaacggttccgtttagggtaccgttaacgggttcggttaaaacgttcccggtaacggtttacccgggtcggggtaaaccccggtaaccgggggtaccccttacggggttaccaacccccgggttcttaccccgtacggacccgttacccccgttacccgaaccccggtaaccgggtaccccg

SEQ ID NO: 210628 - DNA, 718 bp, Homo sapiens
  misc_feature: GYAE6OF01ASPCO.7.78.H01.1.454.CMB.1.raw
  modified_base (371)..(371): a, c, t, g, unknown or other
  misc_feature (371)..(371): n is a, c, g, or t
tcagcgtgtctctacacgaccggtgctcgatttagtgtgagtagtttgggtttggggacccaacaaccacacccctcctaagaagaagcccctagaccacagctccacacaatggactggacctggaggatcctcttcttggtggcagtagcaacaggtgcccactcccaggtgcagctggtacagtctgggtctgattgaggagccgtggggctcagtgagcgttgcctgcaacgtccttcgtggactacattcttcacttacttattctcgtctaagttcgggtccgacgtacggccccgtaggacctaaggtccttagactacgagtggatggactaccaacaccgacacgtacggaaccccactacncgccgacgtcctacgacgtcgggttcgtttgtccttctccgtagtcggtactaccgtcggtcggtaccggggtacgtcttacgtcgtgacctaacgtaaccttaacccgtaacctttaccgaacctacgaaccgtaccgtacgtttccgtttaccgtttttaagtttacggacgtacggtcggttaccgttcgttacgttcggtacgttacggttagtaacgttcgtaacgttccgggtaccggggtaaccgtaccggggttaccttcggtaccccggtacccgttcccgttacccgtacccggtacccgttacccctaaccccggaccggtaacccgggtcccccg

SEQ ID NO: 210629 - DNA, 897 bp, Homo sapiens
  misc_feature: GYAE6OF01DPJXQ.7.78.H01.1.454.CMB.1.raw
  modified_base (132)..(132): a, c, t, g, unknown or other
  misc_feature (132)..(132): n is a, c, g, or t
  modified_base (173)..(173): a, c, t, g, unknown or other
  misc_feature (173)..(173): n is a, c, g, or t
  modified_base (183)..(183): a, c, t, g, unknown or other
  misc_feature (183)..(183): n is a, c, g, or t
tcagcgtgtctctacacgaccggtgctcgatttagtgtgagtagtttgggtttgggacccaacaaccacacccctcctaagaagaagcccctagaccacagctccacaccatgactggacctggagatcctnttcgtggtggcagtagcaacaggtcgcccactcccaggtgnagctggtacngtcgtgggtctgaattggaaggaacgccgtggggactcgagtaggagtcgttgacccttggctaaaggtccccttttgacggtaactaaactaccgtttcctttaccgaaccgtttaaacctttttaattacccggttcggttaccctaaaaggtttttccgggggtaccccaaacggaacccgggtcccccgtagggtaaaccgaaaacggtcctttacgaacctttaagaacgggttggaacgtacggtactaaccgaaaaccgaccgaaactaccggtacccggaaacccctactacgtccgaccccgtagtccttacgaacggtacggggttacgttttcgccgtttaccacgtaacggttacggtaacccgttacccgtttaccgagggggtttaacccgggtacccgggttacctttaaggttccttcggaacctaaacgggttaaaaccctaaaccccgtttaaccgttaaaccgtaaccgttaccggaaccggttaacgacccgttttaccggtttaacccgtttttagttttttaccgaacggttaacggaccgtttaaccggtcccgttacggtaccggttacgtaacggttagggttaaacgttacgtacccgttacggtacgggtaacccggtaacgggtaccgttaccgtacgtaccgtacctaccctacggcaacccgttccaacccggtacggtacccg

SEQ ID NO: 210630 - DNA, 687 bp, Homo sapiens
  misc_feature: GYAE6OF01CMJ2H.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacatcttcacttattattctgtctaattgggtccgacacggcccctggacaaggccttgactacgatgggatggatacaacaccgacacgtacggaaccccactacgtcgcccgaggtccttacgacgacgggtcgtttgtccttctccgtatcggtactaccgtcgtcggtaccggggacgtcttatctgacagtaactaacctaccttacaaccgtacgtaccgaactacgttcgtttaccgtttttaagtttttacgtaacggtacggtaacggtccgtttccggttcgttacggttactaacgggttaggtaaacgtttcggtaacgttaccgggtcggggtacccgaaccggggtaacccgttcgggttaccctacccggttcccttacccgtaccgaccgtaccccttacccgaacccggtaacggtcccccg

SEQ ID NO: 210631 - DNA, 732 bp, Homo sapiens
  misc_feature: GYAE6OF01DE2EZ.7.78.H01.1.454.CMB.1.raw
  modified_base (239)..(239): a, c, t, g, unknown or other
  misc_feature (239)..(239): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggagatcctcttcttggtgcagtagcaacaggtgcccactcccaggtgcagctggacagtctgggtctgaaattgaggagcctggggctcagtgagcgttgcctgcaagcctttcnggatacgatcttcacttattaattctgtctaacgtttcggtaccgaactaccggtccctaggactaacggcctttgacctacgtagtggatggtaatcgaacctaccgactaccgtacgggaacccccacgtacgtcacccgaggtcccttacgaacgtacggggtccggttttacgtccgttaccgtacccaggttcgggtaaccttaacccggttcgtacgggttaccgggggtaccgtaccgtttacgtaccgttacgacgtaaacgtaaccgttaaaccctaaacccggttcctaacccgtacgaacccgtacctaccgttacggtttccgtttaactttttcgggacgtaagtcggttaccgtcgttctcggttactaggtcgtaaacttacggtactaccggttaggggcccgtaacgggtacccgttaggtccctaccggtccttacccgtccgacgttccctaacccgccgtaaccgggtccccg

SEQ ID NO: 210632 - DNA, 785 bp, Homo sapiens
  misc_feature: GYAE6OF01A2X8O.7.78.H01.1.454.CMB.1.raw
  modified_base (263)..(263): a, c, t, g, unknown or other
  misc_feature (263)..(263): n is a, c, g, or t
  modified_base (492)..(492): a, c, t, g, unknown or other
  misc_feature (492)..(492): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcgttggtggcagtagcaacaggtcgcccactcccagggtgcagctggtacagttcgtgggtctgaattgaaggaacgcctggggcgtcagtggagtcgttcgcctgacaagtccttgtaggatacnttcttcacttactttattctgtctagttcgggtccgacgcggccctaggacacggtccttggactacgagtggtatcggataccgaacgaaccggactaaccggtaccgggaaaccccctacttacgtccgacccgacggtccgtacgaccgggtacggggttcggttttcgtccctttctaccgagttccggtaacttcccgtcgtacgggtcgggacttaccgtttncgtgaccgtaagtaacctaacccgtaaaccgttacccaaccgtacgtaaccgtaccgtaacgtttccggttttaacgttttaacgttttacgggtaacggtaggttaccggttccggttacgttcgtacgttaccggtaaggtacggttaacgttaccgtaacggttccggggtaaccgggtccggtaaaccgggttacccggttcgggaccctttaccccggggttccctacccgtaccccgggtccgttaaacccccgcccccggtaaacgggtaaccccgggttcccccg

SEQ ID NO: 210633 - DNA, 801 bp, Homo sapiens
  misc_feature: GYAE6OF01D0E0P.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattgagagccgtggggcgtcagtgagtcgttgcctgcaagtccttctggatacatcttacactacttattctgtactaagttcgggtacccgaacgacggccccctagggaaccgtaacgggtcccctttaggaaccttaccgaaggttcgggggtaattcggggtaactacccgaaaacccgtaacccgtaaccgtaacccggttaccggggaaaacccccccctaaccgttaacgtcccggaccccgtacgggtacccctttacccggaacggtaaccgggggtttccggtttttacggttcccgttttaccctaccgtacgttacgggtaacctttaccccgtttacggttaccgggttaccgggggtaccggttaccgtttacttccggtacgtacgtaacggtaaccttaaaccccgttaaccttacccaacccgtagaacccgtactacgttcgtttaccttttagttttacgacgtacgtacgtcgttcgtcttagtctaggtcgtattcggactacggtcgggaccgtacggtacccggttcgtccctaccgtttcctacccgtacgtaccgtccctacccgaccgacgggtacccc

SEQ ID NO: 210634 - DNA, 775 bp, Homo sapiens
  misc_feature: GYAE6OF01BMFA1.7.78.H01.1.454.CMB.1.raw
  modified_base (255)..(255): a, c, t, g, unknown or other
  misc_feature (255)..(255): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcgttggtggcagtagcaacaggtcgcccactcccaggtgcagctggtacagtcgtgggtctagaagttgaggagccgtggggcgtcgaggtgaggtcgttgcctggacacgtcccttgnggtatactattcttacctacttactttattctgttactaagttcgggtccgaacgacggtccccgtaggaaccgtaacggtccgttagaacttacgagtgggacgtggtactaccgaaaccgaccgaccgaacgtaccgggaacccctacgtacgtcccgaccgacggtcctacgacgtacgggttcgtttcgtcttacgtccgtagtggtactaccgttcgtcgggtaccgggtacgtctttcgtccgtacgacgtacgtaaacccttaaccgtaaccctttaacccgaaccgaacggtaacctaaccgtaccgtttcgttaaccgttttttaacgtttacgggtagtaccggtagggtttcccttcggttaaccgttggttaacgttgggttaagtaaccggttaggtaaccgtaccgggttaccggggaaccgttaccgggtaacccgtccgggtaccttacccggtcctacccgtaccgacccgttaccctaaccggaaccggtcccggtaacccg

SEQ ID NO: 210635 - DNA, 799 bp, Homo sapiens
  misc_feature: GYAE6OF01ER5PE.7.78.H01.1.454.CMB.1.raw
  modified_base (175)..(175): a, c, t, g, unknown or other
  misc_feature (175)..(175): n is a, c, g, or t
  modified_base (749)..(749): a, c, t, g, unknown or other
  misc_feature (749)..(749): n is a, c, g, or t
  modified_base (760)..(760): a, c, t, g, unknown or other
  misc_feature (760)..(760): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacgaggtgcccactcccaggtncagctggtacagtctgggtctgaattgaggagccgtggggctcaggtgagtcgttcgcctgacaacgtccttcgtaggtatacctacttcttaccaacttacttattcgtcgttactaacgttcgggtacccaacgtacggtcccctagggaaccaaacggtccctttaggaacctacgtagttacgggggattacggaactacgtaaaccgaccgtaacgtaccgtaccggtaaacccccaacgttacgccgtaccccgtaggtaccctttacggaaaccgttggggttaaccgttttcgttccgttccgttaacgtacgtacggttaccgttaacccgttggtaccgggtaaccggggtacggtctttaacgcgttagtaacgtaacgtaaacctaaccgtaacccttaactaacccgtaaggtaccgtaacgtccgttacgtttaccgttttaaggtttacgtacgtaacgtacgtcgttaccgttcgtaggtactacggttagttaacgtcgggtaacgttacgtaccggggtacgtaaacccgggtacgtacggttcccaacccggttntacccccggtntaacccgtacccggtaaccgtaccgtaacccgggtaccc

SEQ ID NO: 210636 - DNA, 752 bp, Homo sapiens
  misc_feature: GYAE6OF01EX9US.7.78.H01.1.454.CMB.1.raw
  modified_base (246)..(246): a, c, t, g, unknown or other
  misc_feature (246)..(246): n is a, c, g, or t
  modified_base (682)..(682): a, c, t, g, unknown or other
  misc_feature (682)..(682): n is a, c, g, or t
tcagcgtgtctctacacgaccggtgctcgatttagtgtgagtagtttgggttgggacccaacgaaccacacccctcctaagaagaagcccctagaccacacgctccacaccatggactggacctggagatcctcttctggtgcagtagcaacaggtcgcccactcccaggtgcagctggtacagtctggtctgaattgagacgccgtgggcgtacgagtgacgtcgttcgcctgacacgtccttgngatactatcttacacttacttacttcgtgtactaagttcgggtaccgacgtacggaccctaggtaccgaaggtccttagtactacgtaggtgggagtacggactaaccgaaccgaccgaccgtaccggtaccgggaaccccctacgtacgtccgacccgtacgtaccgttaccgacggtacgggttcggttttacgtcccgttacgaccgtagtcggtactccgtccgtagggttaccggacggttcttagtccgaggactacgtaaactaaccgtaccttacgacgtacggacctacgtcgttaggttaccgttttttatacgggacgtacgtagggtcctttcggttatccggttagaggttaacggtacttacggtaaccgtttcgggaaccggggtttcccaaacgggtttaccccgtggggttaaaccccnccccgggttaccggtacctacccgggtaacgtacccccctaaacccggtaccggtaaccggtacccccgg

SEQ ID NO: 210637 - DNA, 777 bp, Homo sapiens
  misc_feature: GYAE6OF01A4570.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgattgaggagccgtggggtcgtcagtgagtcgttgcctgcaacgtccttcgtggatactattcttacacttacttacttcgtagtactaagttcgggtaccgaccgaccggtccccgtaggaaccaacgggtccctttacggaaccttaccgaagttacggggagttacgggaactaccgaaaccgaacccgaaccgtaaccggtaccggggtaaaccccccaaccgttactccggaccccgtacggtcccttaccgacggtacggggttccggttttacgttcctttccgtaccgtacgtacggtaacttaccccgtacgttcgggtccgggggtaccgttaccttacgtcgtcggacctaacggtaaccctaaacccttaacccgttaacaacccgttcggaacccgtaaaccgtccgttacgtttccgttttttaagtttccgggtaagacggtacgtccgtttccgtacgtcggttacaggttagtacttagtaccgtgggtaccggggaccgtacggggtaaccctgggtaccctcccgtcctaccgcgtaccgtcccaccggtccgacggtccccg

SEQ ID NO: 210638 - DNA, 767 bp, Homo sapiens
  misc_feature: GYAE6OF01A93IW.7.78.H01.1.454.CMB.1.raw
  modified_base (694)..(694): a, c, t, g, unknown or other
  misc_feature (694)..(694): n is a, c, g, or t
tcagcgtgtctctacacgaccggtgctcgatttagtgtgagtagtttgggtttggggacccaacaaccacaccctcctaagaagaagcccctagaccacagctccacaccatggactggacctggagatcctcttctggtgcagtagcaacaggtgcccactcccaggtgcagctggtacagtctgggtctgaattgagagccgtggggctcagtgacgcgttgccgtgacgaagtccttctgggaactactattccttaccaaccttacttacttccgtaggtacttaaacggttcggggtcccgaacgaccggtcccctaggaaccaacggtcttacgactacgacgtgggataggactacgaaccgccgaacaccggtaccggaaaccccacttacgccgccgacgtccctacgacggtaggggtccgtttacgtccttcaccgtagtacggaaccttcccgtgtttacgggacccgggtacggttaccttacgtcggtcgtaccaaacggtaactaaccccgtaacctttacccgaacccgttagaacccgtaccctacggtttaccgtttacgtttttaagtttaccgtaacggtagtccggtacggttaccgtttccgtacggttacgttagggtcgtaagttaccgggtcgtacccggggtcgggaaccccgtaacggggttaaccnccgggttaaccctacccggttccctttaccgccgtacccggtaccccttcccgaaacccgtcggggtaccccc

SEQ ID NO: 210639 - DNA, 810 bp, Homo sapiens
  misc_feature: GYAE6OF01DINOI.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggagatcctcttcttggtggcagtagcaacaggtcgcccactcccgaggtgcagctggtacagtcgtgggtctgaattgaggagccgtggggcgtcagtgagtcgttgcctgacaacgtcctttcgtaggactactattccttacctacttaactttattctagttacgtaacgtttcgggtacccgtaaccaccgggtcccccgtaggaaccgaacggtcccgtttagaaccgttaacgtaggtggggtatggtaactaccgaaacccgaacccggtaaaccgtacccggtaacccgggaaccccctaaccgtactaccgacccgtaccggttccccgttaccgggtaaccgggggttcccggttttacgtttccgtttacccgtacccgtaaggttacggttaacccttaccgtttccggttacgggtaccgggtaaccggttctttaacgtcgtacggtacctaaacgtaaacccttaaacccgttaacccttacgaacccgtacgaccgtacctacgttcgtttaccgtttttatttcggaacgtagtcgtcgttacttcgtcgtataggtgtacttcgacgttacgggccgggtaaccgacgggttaccccgtggtaccctccggtttcctacccgaccgtacccgtacccacccgaaccggtacccgggtccctacccggg

SEQ ID NO: 210640 - DNA, 625 bp, Homo sapiens
  misc_feature: GYAE6OF01BYHKC.7.78.H01.1.454.CMB.1.raw
  modified_base (247)..(247): a, c, t, g, unknown or other
  misc_feature (247)..(247): n is a, c, g, or t
  modified_base (602)..(602): a, c, t, g, unknown or other
  misc_feature (602)..(602): n is a, c, g, or t
  modified_base (607)..(607): a, c, t, g, unknown or other
  misc_feature (607)..(607): n is a, c, g, or t
tcagcgtgtctctacacgaccggtgctcgatttagtgtgagtagtttgggtttggggacccaacaaccacacccctcctaaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgccaagtcccttntggatacattcttacactacttattctgtctattcgggtaccgtacacggcccctggaacaacggtccttgactactagtgggatggatacgacaccgacacgtacgggaaccccacgtactcgacctacggtcctcgacgtacgggtcgtttcgtcttcctcacgtcgacttaccgtcgtcggtccggggacgttcttatcgtcgacaacgtaaccgtaaccctaccttaccaacgtcggacctacctacgtcgttaccgtttttatttagtacgtaagtacgtcgttcgtcgtagtcgtagtcgtattgaccgtgacgggtaccacggtaccgtcgtcactagtcccttaccncaccncctcccgacggtacccgg

SEQ ID NO: 210641 - DNA, 804 bp, Homo sapiens
  misc_feature: GYAE6OF01A9YOP.7.78.H01.1.454.CMB.1.raw
  modified_base (161)..(161): a, c, t, g, unknown or other
  misc_feature (161)..(161): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
tcagcgtgtctctacacgaccggtgctcgatttagtgtgagtagtttgggtttggggacccaacaaccacacccctctaagaagaagcccctagaccacagctccacaccatggactggacctggaggatcctcttcttggtggcagtagcaacgaggtcnccctactcccaggtgcagtctggtacagtcgtggtctagtatggagacgtccgtggggtcgcaggtgacgtcgttcgccgtgacacgtcctttcgagtactactactcttactaacttacttagtttctcgttacgtaagttccggtaccgacgtccggtacccgtagacgtaacgtccttagaaccgtacgnggtagggtancggtaacgtaccaaccgtaccgtacgacccggtaccggaaccccctacgtacgtccaccggtacgtccctaacggacgtacgggtttcggtttccttaccttcgtaccgtacgtttaccggtaaccctttaccggtcgggtttaccggggtaaccgggttaccgtttaccgtttaccgtcgttaaccgggtaaccgtaaacgttaaccccttaaaccctaacccttaaccggtaacctacggtaacccgtaacgtttaccgtttacgttttaccgtttttaacggtttagacggtagtaccggtttccgtacgttacgtggttaacggtattaccgggtaaattccggtagtaaacccggggtggtaaacccggtcggttaacccgtgtaccccgtacgttccgacctacgtcccacccgtacccgaccgcggttacccg

SEQ ID NO: 210642 - DNA, 724 bp, Homo sapiens
  misc_feature: GYAE6OF01ARM4M.7.78.H01.1.454.CMB.1.raw
  modified_base (481)..(481): a, c, t, g, unknown or other
  misc_feature (481)..(481): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatccttcttcgttgggtggcagtagcaacgaggtcgccccacctcccgaggtgcagcgtggtacagtcgtgggtctgtaagttgagggaagccgtggggccgtacaggtcgaggtcgttcgtccgtgaccgaacgttcccttacgtaggtatacctacttccttactaccttactttagttctagtacgtaagttcgggtacccgacgtcggtcccttaggactacggtccttagactacgtagtcgggatggactaccgaactaccgaacgtaccggttaccggaaaccccctacgtacgtccgtcccgaacgttccttaccgaggttacggttcgtttcgtccttctccgngtcgacttctcggtcgtcgggtcgtctttcactgactaactaaccgtaccctaaccgttactaaccgtgaaccgtctaccgttacgtttccgtttttattaccgtacgtagtaccgttccggttacgtttcgacttacgggttagtagtacgttagccgtagggtcccgggtaccgacggttacccgtaggccccttcgtccctaccgttcgacccttcccgaaccgtcggtaacccgtcccg

SEQ ID NO: 210643 - DNA, 852 bp, Homo sapiens
  misc_feature: GYAE6OF01DF48E.7.78.H01.1.454.CMB.1.raw
  modified_base (255)..(255): a, c, t, g, unknown or other
  misc_feature (255)..(255): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggagatcctcttcttggtggcagtagcaacaggtcgcccactcccgaggtgcagctggtacagtcgtgggtctgaattggaggaacgccgtggggcgtcgagtgacgtcgttcgcctgacaacgtccttagnggatactacttcttacacttactttattcgtagttactaacggtttcgggcccgtaacgtaccggtaccccgtaggaacgaaaccgggtcccttttaggaacctaacgaggttacggggagtttacggactaacccgaaaccgtacccggaacgtaaccggtaacccgggaaccccctaccgttaagtcccggaccctaggtccccttagaacgggtcggggttacgttttctccgtttcctaacgtagttacgggtaaccttaccgttcgttaacggggtccgggttaaccgttaccgtttacgtaccgtaggtacccgtaaacgttaaaccctaaaccccgttaacccgttaaccccgtaaccgttacggtaaccccgaacctttacggttaaccggtttttaccgtttttaacggtttttaccgaaccggtagttaccggtcccggttaccggttcgtagtaacgttaggttacgttaacgttacggtacggtaccgggttacggggacccggtaaaccgggttaccgttacggttcccgaccctttcgtacccgtcgaccctaccccggtaacccggaccggtaccggtcccg

SEQ ID NO: 210644 - DNA, 787 bp, Homo sapiens
  misc_feature: GYAE6OF01DM54B.7.78.H01.1.454.CMB.1.raw
  modified_base (162)..(162): a, c, t, g, unknown or other
  misc_feature (162)..(162): n is a, c, g, or t
  modified_base (263)..(263): a, c, t, g, unknown or other
  misc_feature (263)..(263): n is a, c, g, or t
  modified_base (324)..(324): a, c, t, g, unknown or other
  misc_feature (324)..(324): n is a, c, g, or t
  modified_base (398)..(398): a, c, t, g, unknown or other
  misc_feature (398)..(398): n is a, c, g, or t
  modified_base (466)..(466): a, c, t, g, unknown or other
  misc_feature (466)..(466): n is a, c, g, or t
  modified_base (685)..(685): a, c, t, g, unknown or other
  misc_feature (685)..(685): n is a, c, g, or t
tcagcgtgtctctacacgaccggtgctcgatttagtgtgagtagtttgggttgggaccaacaaccacacccctctaagaagaacgcccctagaccacagcctccacaccatggacctggacctggagattcctctttcttggtggcagtagcaacgaggtcnccccactcccgaggttcgcagtaccgtgtataccgtgttcggttgggttctaagtaacttagggaacggtaacgtcccggttggggaccgtacgaggtcgngtcgttcgacctgtacgacgtcttcgaggactactactcttactaacttacttattccgtntaaccgtaggttcggtaccaacgccgtacccgtagaacgaacgttcccgtagtacctaagtaagggcggttacngtaaccacaaacccggtcaaccgtaccggacccggtaaacctacgtacgtccgaccgtccggttaacncgaacggtacgggttcgtttacttcctccgagtggttccaacgtttcgcgggtacggttacggtacgtaccgttagtacgtcaaccgtacctaaacgtaaacccttacccctaaacctacggtaaccggtaccacgtttaccgttacgtttttaccctttaagtttaggttaacgtacgtacggttccgttacgttccgttaacggtagtaacgggttnttacggttaccgttaacggtcggtacggggtaccgtaacgggtaccgttccgtacccggtcacccttcggacctaccggcctaaccccggaagtcccccggg

SEQ ID NO: 210645 - DNA, 933 bp, Homo sapiens
  misc_feature: GYAE6OF01AG1RX.7.78.H01.1.454.CMB.1.raw
tcagcgtgtctctacacgaccggtgctcgatttagtgtgagtagtttgggtttgggacccaacaaccaccacccctcctaagaagaacgcccctagaccacagcctccacaccatggactggacctggaggatcctcttcgttggtggcagtagcaacaggtcgcccactcccgaggtgcagctggtacagtcgtgggtctgaatgaggacgccgtggggctgagtcgagtcgttgcctgacacgtcctcgtaggactactacgttcttacctacgttactttacgttcctagtaccgttaacggttcgggtaccgaccgtaccggccccgtaggaacctacggtacgttacgaactacggtaggtacgggtactacggactaaccctaaacccgacccggaaaccgttacccgggttaaccccgggaaaccccccttaacgttaccggaccccggaccccgttaacccggtaccctttaacccgggaacgggttacgggggtttccgtttttaccgttaccctttccgtaacccgtcgggttaccgttaaaccgttccccggttttacggtaccggggtttaccggggtaccgtttacccgtttaaccgttccgttacgaaccggttaaacccggtaaacccgtttaaaccccgtaccccgttaaacccgttacccggttaaccggtaacccttaacccgtttaccgttttacccggtttttaaccggtttttttaacgttacggttaacccgggtaagttacccggttccggttccgttaccggtagtttaacgtcgggttaatcgttaacgggtaccgttaccgggacgggtacccgggtacccgggttacccgttaacggtccccgtaccggtacccgttacgtacccggtaccgaaccccgtccccgaaacgggtccccgtaacccgg

SEQ ID NO: 210646 - DNA, 822 bp, Homo sapiens
  misc_feature: GYAE6OF01CLPVY.7.78.H01.1.454.CMB.1.raw
  modified_base (646)..(646): a, c, t, g, unknown or other
  misc_feature (646)..(646): n is a, c, g, or t
  modified_base (770)..(770): a, c, t, g, unknown or other
  misc_feature (770)..(770): n is a, c, g, or t
tcagcgtgtctctacacgaccggtgctcgatttagtgtgagtagtttgggtttggggacccaacaaccacaccctctaagaagaacgccctagaccacagctccacaccatggactggacctggagactcctcttcttggtggcagtagacaacgaggtcgcccactccgaggtgcagcgtggtacagtcgtggtctgaagttggaggagccgtggggcgtcaggtgagtcgttcgccgtgactaacgtccttacgtacggtaactacgtacttaccttacctaaccttaacttttacgttcgtaacgttacgttaacggtttcggggtaccgtaaccgtacccggtcccgtagggtaaccgtaacggttcctacggtaacgtaccgtaggtagggtacgtaggtaacctaaccgaaaccgaccggaaccgtaaccggtacccgggtaaacccctaaccgttacgacccggtacccgacggtcccttacggaacgggtcgggttcgtttcgttaccgttcgtacgtagtacgtacctccgttcggtcgggttaccgggtagttccttagcccgtacgacgtaaacgtaaccttaaccgtacccttacgaccgttcggaactacgttcgtttgttttaaccgttttnttaacgacggtattacggtccgtttacgtgttaccgaggtttacgtagggttaaacttcgggaaccgttccgggaccgggtaacccggtaaaccgggtacccttcgggaccttacccccgggtnttaacccgccggtaaccccgacctaaacccggggaccgttccccggtaccgg

SEQ ID NO: 210647 - DNA, 813 bp, Homo sapiens
  misc_feature: GYAE6OF01CTQ1C.7.78.H01.1.454.CMB.1.raw
  modified_base (707)..(707): a, c, t, g, unknown or other
  misc_feature (707)..(707): n is a, c, g, or t
  modified_base (738)..(738): a, c, t, g, unknown or other
  misc_feature (738)..(738): n is a, c, g, or t
  modified_base (778)..(778): a, c, t, g, unknown or other
  misc_feature (778)..(778): n is a, c, g, or t
tcagcgtgtctctacacgaccggtgctcgatttagtgtgagtagtttgggtttggggacccaacaaccacacccctcctaagaagaacgcccctagaccacagctccacaccatggactggacctggaggatcctcttcttggtggcagtagcaacaggtcgcccactcccaggtgcagctggtacagtctgggtctagaagttggaggacggccgtggggcgtcaggtgagtcgttgccgtgacaacgtccttcgtaggactactataccgttactaccttaactttacgttctagtactacggttaccgggtacccgacgtaccggtccccgtaggaccgtaacggtaccccttagaccgttaaccgtaggtagggtacgttacgggactacccgtaaaccgacccggtaaccgaacccggtaaccccgggtaacccccacgttaccgaccggacccctaccggtccccgttaaaccgtacgggtaacccggggtttcggttttaccgtttaccgtcccgttaaccgtacggttaacgggtaccttacgaccgttccgggttcgggtaacccgggggtactttaactttcgtaccgtcgtaaaccgtactaaaccttaaaccctaccgttcccgaaactccgaacgtaccttccggtttacgtttaccgtttttagttaacgcggtaacgcgtttaccgtccgtntaacgggttcaggtacgtagtacgttaccgngggtacccggaaccgtaccggcgttcgccgtacccgttcncccctagggaccctacccgtccggaccggtacccg

SEQ ID NO: 210648 - DNA, 700 bp, Homo sapiens
  misc_feature: GYAE6OF01DKB8O.7.78.H01.1.454.CMB.1.raw
  modified_base (188)..(188): a, c, t, g, unknown or other
  misc_feature (188)..(188): n is a, c, g, or t
  modified_base (267)..(267): a, c, t, g, unknown or other
  misc_feature (267)..(267): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtcngggtctgaattgaggacgccgtggggcgtcagtgagcgttgcctgacaagtcccttgtggatacatcttctactacttnttctgtacgtagttcggtaccgacgtccggcccgtacggacgtacggtccttagtactagtagtggagtagactaccaaccaccgacctaccggtaccgaacccctacgtactcgaccgtagtcctacgacggtacgggttcgtttcgttcctacctcgtagtacgtactaccgtcgtcgggtacgggtacttcttacgtctagactaaccgtaaccttaaaccctaacctaccgtaaccgtacggtaacctaccgttaccgtttaccgttttacgttttacgtttacggtaacgtagtcggttcgttcgttagttacggtcgttagtaggtaacgttccgtacggtaccggtacgggtacccgtaaccggtacccgttcggtacccctacgttcccacgtccgtaccgtccctaacccgtacggcccggtcc

SEQ ID NO: 210649 - DNA, 719 bp, Homo sapiens
  misc_feature: GYAE6OF01B8I8N.7.78.H01.1.454.CMB.1.raw
  modified_base (221)..(221): a, c, t, g, unknown or other
  misc_feature (221)..(221): n is a, c, g, or t
  modified_base (252)..(252): a, c, t, g, unknown or other
  misc_feature (252)..(252): n is a, c, g, or t
tcagcgtgtctctacacgaccggtgctcgatttagtgtgagtagtttgggttgggacccaacaaccacacccctcctaagaagaacgcccctagaccacagcctccacaccatggactggacctggaggatcctcttctggtggcagtagcaacaggtcgcccactccgaggtgcagctggtacagtcgtgggtctagaatggaggacgccggtggggctnagtgagtcgtgctgcagtccttgagactacntcttcaacttacttattcgtgtactaagtcggtaccgacgaccggtcccgtaggacgtaacggtccttaggactacgaggtggatacggataccgaacaccgactaccgtaaccgggtaaccccaacgttacgccgacccgtacggtaccttacggaacggtacgggttccgtttgtaccttcgtacctagtacggtacttaccgtcggtacgggtaccgggtacgtacgttaccgcgtacgacgtaactaaccgtaaccctaaccttacgaaccgtagacctaacgtcttaccggttacttttacgttacgacgtacggtagtcccgtttgtaccgttcgtacggtaaggttagtaacgtcgtaaccggtaccggtacgggtacccgtaacgggttcccgtcggtacccctacccttcccgaccgtacccgacgttaccccaacccgtaaccgggcccgttacccg

SEQ ID NO: 210650 - DNA, 622 bp, Homo sapiens
  misc_feature: GYAE6OF01ECB9G.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggagcctggggctcagtgagcgttgcctgcaagccttctggatacatcttcacttacttattctgtactaattgggtccgacacggcccctggacaaggtccttgactacagtgggatggatcaacaccgacacgtcgaacgaaccccactactcgacccaggtcccttacgacgtacggggtcggtttacgtccttcgtccgagtcggaacttaccttcgtggtccgggacgtcttatctgacagaactaaccgtaccttactaacctacgacctactacgttcgttccgttttaatttcgaacgtagtacgtcgttacgtcttcgtacaggtagtattgacgtacggtcgggaccgtaagggtacccgttggtacccacccgttctacctacgacctccctcccgaacggtaacccggg

SEQ ID NO: 210651 - DNA, 691 bp, Homo sapiens
  misc_feature: GYAE6OF01CVG5V.7.78.H01.1.454.CMB.1.raw
  modified_base (664)..(664): a, c, t, g, unknown or other
  misc_feature (664)..(664): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattggaggagccgtggggcgtcagtgagtcgttgcctgacaacgtccttcgtggatacatcttcacttattattctgtctaagttcggtccgacacggccacgtggacaacggtccttagaactacagtggagtggatacaaccaccgacaccgtacgggaacccccactactccgcccgacggtccttaccgacggtacggggttccggttttcgttccttacccgtccgtagttcggtaacctacccgttcgttcgggtacccgggtaccgtctttacgtccgtagactaacgtaaccttaaaccctaaccgtacctaaaccgtgacccgtacttcgttacggttacctttttagtttacgtacgacggtacgtacgttcgtacgtgtacgtagtaggtaattccgacgtaccggtacgggtcccgaacgggtacccgtgtaacccgtccgttaccgtcccgtacncccggtccctaccgacccggtaaccgg

SEQ ID NO: 210652 - DNA, 814 bp, Homo sapiens
  misc_feature: GYAE6OF01DO56Q.7.78.H01.1.454.CMB.1.raw
  modified_base (246)..(246): a, c, t, g, unknown or other
  misc_feature (246)..(246): n is a, c, g, or t
tcagcgtgtctctacacgaccggtgctcgatttagtgtgagtagtttgggttggggacccaacaaccacacccctcctaagaagaagcccctagaccacagctccacaccatggactggacctggaggatccctcttcttggtggcagtagcaacaggtcgcccactcccaggtgcagctggtacagtctgggtctgaattgaaggaagcctgaggcgtcagtgagtcgttgcctgacagtccttnggatacatcttcaacttactttagttcttagtctaagtttcgggtaccgacacgggtcccccctagggaacctaacggtcccttagaacctacgtaggtggggtactaggactaccaaccgaacccgaccaaccggtaccgggaaaacccccctacgttactaccggacccgacggtccctttacgacggtacggggtcgttttacgtctttaccgccttagtacgtacttaacccgtcgttacgggtccgggtaaccgtcgtttaacgttcgtacggtacaacgggttaaaccttaaaacccgtacccctttaaccaaccgtaccgtaaccgaaccttaccggtttccgggtttaacccgttttttaagtttttccggaaacggttcggtaaccggttcgttcggttacttgttacggaggtttacgtaattcgggaccgttaccggtaccgggggtaaccgtaacccggggttaaccccgttcgggtaccccgttaccccggttaccgttcccgttaaccgacccggtttaacccccgtacccgaacccccggggtaaaccccggg

SEQ ID NO: 210653 - DNA, 774 bp, Homo sapiens
  misc_feature: GYAE6OF01D4U1A.7.78.H01.1.454.CMB.1.raw
  modified_base (246)..(246): a, c, t, g, unknown or other
  misc_feature (246)..(246): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcagtgagcgttgcctgctaacgccttcgnggactacattcttacacttactttattctagttactaagttcgggtaccgaacgacggacccctaggaactaacggtccttagactaacgagtgggagtggatacaacgaccgacacgtacggaacccctactagtcgaccgacggtcctttacgaacggtacggggttacggttttcgttccgtttaccctacgtaacgttacgggtacttaaccccgtcgttacgggttaccgggggaaccgttactttaacgtcgttacgacgtaaacgtaaactaaaccctaaccctttaccgaaccgtacgaacccgaacttaccgttcggttttaacgtttttaacgtttttacggaacggacggttaaccgggttcggttaccggttacttcggttaacgtaagggttacgttaacgttacggtaaccgttcggggttacggggaacccggttaaccggggtaacccgttcgggtaccacccggttactcccgtacgaccgtccccgtaacgaacccgtccggggtacccc

SEQ ID NO: 210654 - DNA, 808 bp, Homo sapiens
  misc_feature: GYAE6OF01BZDHS.7.78.H01.1.454.CMB.1.raw
  modified_base (255)..(255): a, c, t, g, unknown or other
  misc_feature (255)..(255): n is a, c, g, or t
tcagcgtgtctctacacgaccggtgctcgatttagtgtgagtagtttgggtttggggacccaacaaccacacccctcctaagaagaacgccctagaccacacgctccacacatggactggacctggaggatcctcttcttggtgcagtacgcaacaggtgcccactcccgaggtgcagctggtacagtctgggtctgaattgaggaagtccgtggggtcgtcaggtgacgcgttgcctggccaaggtcctttcgnggtaactactacttctttacgacttactttacttcgtagtcctaagttcgggtacccgacgacggccctaggtacaagggtccctaggaactcgagtcggggtatggaacttaccgaaacgtacccgaacgtacgttaccgggaaaccccctacgttacgtacccggcccctaggtaccccttacgaaaccggggtacgggttaccggttttcggttacccttccgtaaccggtacggttacggtaaccttacccgtttcggttacgggttaacccggggggaccggttacctttaaccgttccggtttaacggaccggtaaagttaaacccgtaaacccgttaaaacccttaccgaaacccgtttacggaaacccggtaaccctacggtttaaccgttttacccggtttttaagtttttaacgaaccgggtacgtaacggtcccggtttcgtacgttggtactaggttaggtaacttcggacgttcgtaccgggtacgacggtacccgtgaccgtactcgtaccgctacgaccctccgtaccgacggtcccg

SEQ ID NO: 210655 - DNA, 893 bp, Homo sapiens
  misc_feature: GYAE6OF01BSXZ5.7.78.H01.1.454.CMB.1.raw
  modified_base (222)..(222): a, c, t, g, unknown or other
  misc_feature (222)..(222): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggagatcctcttctggtggcagtagcaacaggtcgcccactcccgaggtgacagtctaggtacagtctgggtctgaagttgaggagccgtgggctacgngtcgagtcgttcgctgactacgtccttcgaggactacacttccttactacttagtttacttcgtgttactacgtttcgggaccacgaccggtcccgtaggaacgtacggtccttacgaacgtaccgtaaggtcgggaactcgggaacttacccgaaacctaacccggtaaccgtacccggtaaccgggtaaacccccctacgtacgcccgtaacccgtaacggtccccttaaccggacgggtacgggttccgttttccgttccgtttaccgaccgtacgtacggttaacccgttacccgttcgggttacgggttacccgggggcgttacccttttaaccgcggtaccgtaagtaacccgttaaaaccttaacccttaaacccgtttccgaacccgttacggtaaaccctaccgtaccggttacgtttttaccctttttaggttaccggtaagtaccgggtaccgttccggttacgttccggtaagttaccgttaagggttacccgttaacggttacgttaaccccggttagggtacccggggtaaaccggtaaacccgggttaaccccgggttccgggtacccgttacccccgttacgttaacccccgttcccgggtaaactttacccccccggaaccgttaacccgggggtccccggttaaacccccggg

SEQ ID NO: 210656 - DNA, 795 bp, Homo sapiens
  misc_feature: GYAE6OF01CYNFA.7.78.H01.1.454.CMB.1.raw
  modified_base (246)..(246): a, c, t, g, unknown or other
  misc_feature (246)..(246): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaatgaggagccgtggggctgagtgagtcgttgcctgctaacgtccttcgnggactacgtattccttactaacttacttattctgtactaagttcgggtaccgacgtaccggccccgtggaaccaacggtccttacgtaactaacgaggtgggtacgtggaactccaaacgacccgaacgtaccgtacccgggaacccctaccgttacgaccgaccccgtacggtccccgttacgggtacgggggttccgttttacgtcccgtttaccgtccgtaagttccgggtaacttacccgttccgttcggggtacgggtaccgttacgttacgtctacggactaacgtaaaccctaaaccctaaccgtttaccgaaccgtacgaaccgtaacgtaccgttcggtttaacccttttttagtttacggtaacgtacgtcgtacccggttcgttacgtggttaccgagggtttaacgtacgtttcggtaaccggttaccgggtaccggggtacccgtacggggtaaccccgttggttacccgtacccgttccggtaccctaccgtcccgtacccttacccgaaaccggtccggtcccttaaccccggg

SEQ ID NO: 210657 - DNA, 805 bp, Homo sapiens
  misc_feature: GYAE6OF01CT2WH.7.78.H01.1.454.CMB.1.raw
  modified_base (159)..(159): a, c, t, g, unknown or other
  misc_feature (159)..(159): n is a, c, g, or t
  modified_base (561)..(561): a, c, t, g, unknown or other
  misc_feature (561)..(561): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggagatcctcttcttggtggcagtagcaacaggtcncccactcccaggtgcagctggtacagtctgggtctagaattgaaggaagccgtggggcgtcaaggtgagtcgttgcctgacaacggtccttcgaggactaacacttcttactaactaacgtttattccggtattacctaaggtttcgggtacccgaacgtaccgggtcccctaagggtaaaccgtaaacggggtcccctttaggaaaccgtttaaccgtaggtaagggggtattcggaaacttacccaaaaccggaacccgaaccgtaaccggtaacccgggaaaccccctaccgtaatccgaccccgaaggtccccttacgaacggtaggggttacccggtttagttacccttcgtaacccgtagttacggacttacccgtgtacgggcgggtaaccggtntttacgtcgtacgacgtaagtaaccttaaaacctaaacccttaccgaacctacgaacctactacgtccgtttaacctttagttttacgaacgaacggtcgttacccgttcgtcgttaggttacaaggttacgttaagtacgttaacgtacggtaccggggcccgtaaacgggtacccgtacggttacccgaaccgtttcccaaccttcgaaccgtaccctacccggaacggaccggtaaccccg

SEQ ID NO: 210658 - DNA, 877 bp, Homo sapiens
  misc_feature: GYAE6OF01ES944.7.78.H01.1.454.CMB.1.raw
tcagcgtgtctctacacgaccggtgctcgatttagtgtgagtagtttgggtttgggacccaacaaccacacccctcctaagaagaagccctagaccacagctccacaccatggactggacctggaggatcctcttcttgggtggcagtagacaacaggtcgcccactcccaggtgcagctggtacagtcgtgggtctgtaagttgaggagccgtggggcgtcagtgagtcgttgcctgacgagtccttcgtaggacttacacttccttacctaactttacgtttactttcgttacgttacttaaacggttcgggttacccggaacgaccggtacccccggttaggaaccgaacggtccttagaactacaggttacggggtaagtacggacttaacccaaaccgtaccgaacgtaacccggtaacccgggtaaacccctaaccgtactaccggacccgtaacggtaccccttcgaaccggtaccgggtttacgggttttacgtccgttcccgtaacgtacggtttacggtaaccttaccgtttacgggttccgggttaccgggggtaaccggttccgttttaacgttcgggttacgtaaccggtaactaaaaccgtttaaccccgttaaacctttaaccccggtaacgtaaccggtaaccgttaaccgtttaccggtttaccggttttaaccggtttttttaacggtttacgttaaccggttaacggttcggttaccggttacgttaccggtttagtacggtaaggttacggttaacgtacgtacgtaccggtaccgggtacggtacccgggttaacgtccggtccgtaccgtcccttccctagaccccgtacgtacccgaacccgtccggtaccccg

SEQ ID NO: 210659 - DNA, 781 bp, Homo sapiens
  misc_feature: GYAE6OF01CA0BK.7.78.H01.1.454.CMB.1.raw
  modified_base (181)..(181): a, c, t, g, unknown or other
  misc_feature (181)..(181): n is a, c, g, or t
  modified_base (197)..(197): a, c, t, g, unknown or other
  misc_feature (197)..(197): n is a, c, g, or t
  modified_base (242)..(242): a, c, t, g, unknown or other
  misc_feature (242)..(242): n is a, c, g, or t
  modified_base (266)..(266): a, c, t, g, unknown or other
  misc_feature (266)..(266): n is a, c, g, or t
  modified_base (298)..(298): a, c, t, g, unknown or other
  misc_feature (298)..(298): n is a, c, g, or t
tcagcgtgtctctacacgaccggtgctcgatttagtgtgagtagtttgggtttgggacccaacaaccacacccctcctaagaagaacgcccctagaccacagcctccacaccatggactggacctggagactcctctttcgttgggtggcagtagcaacaggtcgcccacctcccgaggtnacgagtcctaggtacngttcgtgggtctagtaattggaaggacgtccgtggggctgagtgngtcgtcgctgacgacgtcttacgngtatactcttcctactacttactttattcgtntactacgttcggtaccaacgaccggtcccgtagtacgacggttcctacgaaccgtagtaggtggtagtacggaacctaccaaaccgaacccgtacaaccccgggtaacccggtaaacccctacctaaccgtccccgaaccggacccgttaccgttaccgacggggttacggggtttcccgttttacgttcctttaccgtccgtaacggtccgttaccgttaccgtacggtttcgggtaaccgggttacgttacttacgttccgaataaccgtaaaccgtaaccctaaaccctaacttaccgtaccgtaccgtactaaccttacgtttacgtttaccgttttagtttaccggagtcgtacgttcgttaactcggtatcgtaaggttatacggtacgtccgacgggtccggaaccggtacggttacccgtccgtcccgtaccgttcctaccgtacgtacccgctaaaccccggaccgtaccgtcc

SEQ ID NO: 210660 - DNA, 862 bp, Homo sapiens
  misc_feature: GYAE6OF01CB7Z6.7.78.H01.1.454.CMB.1.raw
  modified_base (132)..(132): a, c, t, g, unknown or other
  misc_feature (132)..(132): n is a, c, g, or t
  modified_base (152)..(152): a, c, t, g, unknown or other
  misc_feature (152)..(152): n is a, c, g, or t
tcagcgtgtctctacacgaccggtgctcgatttagtgtgagtagtttgggttgggacccaacaaccacacccctctaagaagaacgcccctagaccacagctccacaccatggactggacctggagatcctnttctggtgcagtagaccaanaggtcaccactccgagtgcagtctggtacagtcgtagggtcctaggtaattacgggaaggaacgtccggtggggactagtaggtgtaacggtcgttcgccgttagacggtaaccgtccgtttacgaggtaaaccttaacgcgtttaacctttacctaaaccgtttaccttttagttaccgttacggttaaccgtaaagggtttaccgggttaccgaaccgtacccggtacccggtacggaaaccggtaacggttaccgttacgtaaccgtaacgtggtaaccgggtagtacggttaaccaaccgaaaaccgtaaccgaaccgtacccggttaacccgggaacccctaacggttaccgacgtaccgtaaccgtcctaacgagggttacggtcgtttctctcgtactacgtcgtactccgtaggttacggccggtaagtcctagtcgtaggtacaaacgttaaccttaaccgtaaacctacgtaccgtaacgtaacgtactaacccgtttcgtttaaacggtttacgtttaacggtaaccgtaacggttaacgtcccggtttaagttcttaacggtaaggtaacggttacgtaacggtaccgttacggtaacccggggttaacggacccggttaaccggtaaccggttcctacggtaacccttcgaacctcccgtaaacgacccgtaaccccgacggtaccgtaaccccggg

SEQ ID NO: 210661 - DNA, 883 bp, Homo sapiens
  misc_feature: GYAE6OF01AL8KL.7.78.H01.1.454.CMB.1.raw
  modified_base (174)..(174): a, c, t, g, unknown or other
  misc_feature (174)..(174): n is a, c, g, or t
  modified_base (254)..(254): a, c, t, g, unknown or other
  misc_feature (254)..(254): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtncagtctggtacagtctgggtctgaattgaggaagccgtggggcgtcagtgagcgttgcctgcaagcccttgtggatacgnttcgttcaccttagttattctgtactaagttcggtaccgaccgtaggtccccctaggacgtaaccggtcctttcggaacctaccgtaagtggggacttagggacttaccaaaccgacccggtacgtaaccggtaccccggggtaaaacccctaccggttactacccggaccgtaaccgggttacccttaccgtaacccgggtaacggggttccgggttttaccggttcctttacccggtacccgtaaggtttacggggtaaccttaaacccggtttccggtaccgggtttaacccggggggtcccggggtttaaacccgttttaccgggtaccgttttcggggaaccccgttaaacgggttaaaccctttaaaacccccggtaaacccttttaaccccggaaaccccggttttaacgggaacccccggttaaacccgttaacgtttcccggtttaaccccggtttttttaagttttacggtaacccggtaacgggtaccgtttcccgggttacgtttaccggtacgttaccggtagtacggtacttcgtaacgtcggtacgggtacgaccgggttaccgtcggtcccgtacgtccgttaccgacgtcgaccctaccgcggaccgtcccg

SEQ ID NO: 210662 - DNA, 827 bp, Homo sapiens
  misc_feature: GYAE6OF01CS0XE.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatccttcttcttggtggcagtagcaacgaggtcgcccactcccgaggtcgcagcgtggtacagtcgtgggtctgattgaggacgtccgtggggctcgagtgagtcgttcgcctgacgtacgtccttcgtaggtactactacttcttacctacttaactttacttcgttgtactaacggttccggtaccgtaccggaccggtcccgtacgggaaccgtacgggtaccttacgtacctacgtaggttagggtaggtcggtaactaccgaaaccgacccgtaaacgtaccgtaacccgggaacccctacgtaccgcgtacccacggtacctaccgtacggtacgggttccgtttcggttccttcgtaccgagttacgtacgtttaccgtcggtacgggttcgggtaaccgtttcgttacgtcgtcgaaccgtaacgtaaccttaaacccgtaccgttacgtaaccggtacgaccgtacttaccgtttcgttttaaccgttttaagtttcgggaacgtaggtaccgttcgttacgttccgttacgtacgttaagggttccgttaaacggttcggttaacccggtccgggggtaacgggacccggttaacccgggttaccggttcccggtaacccttaccccggttcccaccgtttacccggccccgtaccccgttaacccggaaccgttacccgggttccccg

SEQ ID NO: 210663 - DNA, 732 bp, Homo sapiens
  misc_feature: GYAE6OF01AEEDY.7.78.H01.1.454.CMB.1.raw
  modified_base (248)..(248): a, c, t, g, unknown or other
  misc_feature (248)..(248): n is a, c, g, or t
  modified_base (386)..(386): a, c, t, g, unknown or other
  misc_feature (386)..(386): n is a, c, g, or t
  modified_base (567)..(567): a, c, t, g, unknown or other
  misc_feature (567)..(567): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtcgcccactcccaggtgcagctggtacagtctgggtctgaattgaggagccgtggggctcaggtgagtcgttcgcctgacagtccttcgnggactactatccttactacttacttattctgtactaaggttcggtaccgaccgtaccggtcccgtaggaaccgacggtcctacgactacgtagtggataggactacgaacaccgactaccgaccggaacccacgtacnccgaccgcggtacctacggacggtcgggttccgtttcgtacctttccgactacgtcggtaccttccgtcggtacgggtaccgggacttctactcgtacgactaaacgtaacctaacccgtaacttaccgaaccgtgaaccgtaccgtcgtttacggtttaccttttagttaccgaacggtnttaccgggtcgtttccgtacgttagtacgtagttacggtaacgttcggaaaccggttccgggaagggttccccgggaaaccggtccccgttagtcccccgtaccgttcccttacgaccccggtacctaccccgttaacccggaacccgggtccggtaccccccgg

SEQ ID NO: 210664 - DNA, 875 bp, Homo sapiens
  misc_feature: GYAE6OF01BQE1U.7.78.H01.1.454.CMB.1.raw
  modified_base (262)..(262): a, c, t, g, unknown or other
  misc_feature (262)..(262): n is a, c, g, or t
tcagcgtgtctctacacgaccggtgctcgatttagtgtgagtagtttgggtttggggacccaacaaccacacccctcctaagaagaacgcccctagaccacagcctccacaccatggactggacctggagatcctcttcgttggtgcagtagcaacaggtcgcccactcccgaggtgcagcgtggtacacggtctgggtctagtaagttgaaggagccgtggggcgtcaggtgagtcgttcgcctgacgtaacgtccctttntacgggaatacctctttaccttactacttactttacttctagttactaagtttcgggacccgtaacgtaccggaccccggttacggacctaaaccgggtccgttacggtaacctaccgtaaggttaggggacgttacggggtaacctaacgaaacccgtaacccggaaccgtaacccggtaacccgggaaacccccctaacggttacgtacccggaccccggtaacggttacccttacgacccgggttaacggggttcggttttcgttaccgtttccgtaccgtaggtacggttacctaacccgtccggttacgggtaccggggtaccggttacttacgtttccgtaggacctaaccggtaaaccttaaccccgtaaaccctttccgaaaccttcgggtaaaccctccgttaaccgttcgtttaacccgttttttggttaacggtaacggtaagtaccgggttactttccgggtaacttcgtacggttaaggtacggttaagttaccggaaccgtttccgggaacggggtcccgtaacccggggtacttcgggtaaccctacggttccctacccggactaccccgtaccacccggtaccgtaaccgggtcccg

SEQ ID NO: 210665 - DNA, 994 bp, Homo sapiens
  misc_feature: GYAE6OF01CSBDX.7.78.H01.1.454.CMB.1.raw
  modified_base (177)..(177): a, c, t, g, unknown or other
  misc_feature (177)..(177): n is a, c, g, or t
tcagcgtgtctctacacgaccggtgctcgatttagtgtgagtagtttgggtttgggaccaacaaccacacccctcctaagaagaagccctagaccacagctccacaccatggactggacctggagactccttcttcgttggtggcagtagcaacgaggtcgacccactcccgaggtncgagctaggtacagtcgtgggtacttgtaattggaacggacggtccgtggggtcgtacaggtagacggtcgttcgccgtcgacgtaacgtcccttagtaggaccttaactcttaccgttaccttaaccttaacttttacgttacgtacgttaccgtaagggtttccggggtacccgaaccgacccggggtaccccgttaacgggaaaccgtaccggtcccgttacgaaccttaaccggtagggtaccggggttaagtacgggtaacctaacccgtaaacccgaccccggtaaccgtaacccggttaaaccccgggtaaaccccctaaccgtttaaccgtccggaaccccgtacggttccgttaacgtacggttaccggggttccgtttttctacccgtttcccgtacgtaggttccggtaaccctttacccgtttcgggtaccgggttaccggggttaaccgtccgttttacgtccgtaggaccccgttaaagtaaacccctttaaaccccggttaacctttacccgaaaccggttccgaaaccgttaacccgtttacgttttccggttttaaacccgttttttagttttaccggaacgggttaaacgtacccgtttaccggtttcggttacgttcggttagggtaaacggttttcgggtaaggttacctaacccggggttaaccggggtacggggtaccccgtttaaaacgggggtcccctttcgggaaaccccgtttcccccgggttccctttaccgggtacccaaacccccgggtttcccaaccccgggtaaacccggtccgggtaaccccccg

SEQ ID NO: 210666 - DNA, 846 bp, Homo sapiens
  misc_feature: GYAE6OF01BKB54.7.78.H01.1.454.CMB.1.raw
  modified_base (209)..(209): a, c, t, g, unknown or other
  misc_feature (209)..(209): n is a, c, g, or t
  modified_base (251)..(251): a, c, t, g, unknown or other
  misc_feature (251)..(251): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaaacgaggtgcccactcccgaggtgcagctaggactagtctggtctagattgaggacnccgtgggctcagtgagtcgttgcctagcgaacgtcccttcgnggtaactactattccgtttactaaccgttactttattccgttacgttacgtaaacggtttccgggtacccgaacgtacccgggtccccgttagggaacccgtaaaccgggttccccgttacggtaaacccgttaccggtaggtttacggggggtaaacttaccggggttaacctaaccgtaaaacccggtaacccggtaacccgttaacccgggtttaaccccggggaaaccccctaccggtttaacgtacccggacccgtaacggtaccccgttaacgtaccgggtacgggttcgtttcgtaccgtttaccgaccgtagtacgtaacttcccgtcgttcgggtaccgggacgttaccttacgtcgtcggaaccgttaacgtaaacccgttaaacccgtaccgtttaaccgaccgttacgaacccgttactaccgttccggttttacgttttattacggcgtacgtacgttcgtcgttacgtcgacgttacgtagtaccgtgtcgtaccggtacgggtacctaccgggttaacctcggtacccgtacccgttcttaccggctaaccccggtccctaacggccgtaccggtccccg

SEQ ID NO: 210667 - DNA, 695 bp, Homo sapiens
  misc_feature: GYAE6OF01BBBC9.7.78.H01.1.454.CMB.1.raw
  modified_base (664)..(664): a, c, t, g, unknown or other
  misc_feature (664)..(664): n is a, c, g, or t
tcagcgtgtctctacacgaccggtgctcgatttagtgtgagtagtttgggttgggacccaacaaccacacccctcctaagaagaagcccctagaccacagctccacaccatggactggacctgggaggactcctcttcttgggtggcaggtagcaaacgaggtcgcccacctcccaggtgcagctggtacagtcgtggtctgaattgaggaagccgtggggcgtcaggtgagtcgttgcctgcaagtccttgtggatactatcttcacttacttattctgtactaagttcggtaccgacgacggcccgtaggaccgtaacggtccttagacgtaacgagtagggatcgggtactacgaaccgtaccgacgaccgtaccgggaaaccccacgtacgccgaccgtacgtcctacgacggtacgggtcgtttcgtcttcacgtagtcgtactccgtaggtcggtacggacgtacttactcgttacgactaacgtaactaacccttacttaccgaacctggaacctaccttacgttacggtttaacgtttttacgttacggaagtacgtcggttccttacgtcgttggtaccgtaggttacgtaacgttaggaccgtacggtcgggtaccggtacgggtacccgtcggtccctccgtactcccgtacncccgtacctacccgtaacccggaccggtccc

SEQ ID NO: 210668 - DNA, 655 bp, Homo sapiens
  misc_feature: GYAE6OF01BMFS6.7.78.H01.1.454.CMB.1.raw
  modified_base (186)..(186): a, c, t, g, unknown or other
  misc_feature (186)..(186): n is a, c, g, or t
  modified_base (240)..(240): a, c, t, g, unknown or other
  misc_feature (240)..(240): n is a, c, g, or t
tcagcgtgtctctacacgaccggtgctcgatttagtgtgagtagtttgggtttggggacccaacaaccacacccctcctaagaagaacgcccctagaccacagcctccacaccatggactggacctggaggatcctcttcttggtgcagtagcaacaggtgcccactcccaggtgcagctggtacngtctggtctgaattgaggacgcctgggctcagtgagcgttgcctgcaagccttnggatacatcttcactacttattctgtctaagttcggtccgacaggcccctggactaaggccttgactacgagtgggactggatccaacgaccgtacacgtcggaacccctaccgtaagtcgccacggccttcgaccgtagggtcgtttcgtccttctcctagtcgactacctcgtcggtacgggacgtcttactcgtcgacgtaagtaacttaacccaaaccttccaaccgttacgaaccgtactacgttacgttacccgttttagttttacgaacgaagtacgtccggtacgttacgttgttaccgaggttgtaacgttcgacgttacgtggggtaccgaacgggtaacccgttcggtacctaccgtccttacccgtcgtaccgacccgttaccacccggtaaaccggtccccg

SEQ ID NO: 210669 - DNA, 855 bp, Homo sapiens
  misc_feature: GYAE6OF01CDI2K.7.78.H01.1.454.CMB.1.raw
  modified_base (154)..(154): a, c, t, g, unknown or other
  misc_feature (154)..(154): n is a, c, g, or t
  modified_base (185)..(185): a, c, t, g, unknown or other
  misc_feature (185)..(185): n is a, c, g, or t
tcagcgtgtctctacacgaccggtgctcgatttagtgtgagtagtttgggttgggacccaacaaccacacccctcctaagaagaacgcccctagaccacagctccacaccatggactggacctggaggatcctcttcttggtgcagtagcaacnggtcgcccactcccgaggtgcagctggtacngtcgtggtctgaatgaggaagccgtgggctcagtgacgtcgttcgcctgacgtaacgtccttcgtaggaacttacctaacttccttacctaaccgttacttttaacgtttccgtgttaaccgtaaggtttccggggttacccgaaccgtaccgggtcccccgtaaggaccgtaacgggtcctttacggaacctaccgtaaggtcgggtaatacggtaactaccgaaccgacccgtaaccgtaccggtaccgggaaaccccctacgtacgtaccgtacccgacggtcccttacggaaccgggtacgggttccgtttcggtccttaccgtacgtacgtacgtaacttacccgtcgtcgggttacgggaccgttcgttaacgtccgtacgacgtaacgtaaaccgttaaccctaccgttacgaaccgttacggtaaccgtaaccttaccggtttacgttaacccggtttttagtttaacgtaaccgggtgtaaccggttccgttaccgttcggttaacgtcggtttaacgggtacgttaaacgttccgtaaccggtccggttaccggggaacccggttaacggtaccccgttacggtaccccggtaccgttaccccgttaccgtaacccgtcccggttaacccccgttcgaaccccgggttacggtacccccg

SEQ ID NO: 210670 - DNA, 884 bp, Homo sapiens
  misc_feature: GYAE6OF01EPK6J.7.78.H01.1.454.CMB.1.raw
tcagcgtgtctctacacgaccggtgctcgatttagtgtgagtagtttgggtttgggacccaacaaccacacccctcctaagaagaacgcccctagaccacagctccacaccatggactggacctggaggatcctcttcttggtggcagtagacaacaggtcgcccactcccagggtcgcgagcgtggtactaggttccgtaggggtctaggtaaatttggaagggaacgtccggtggggggtcgttacgaagggtggacggtcggttacgtccgtacgacgtaacgttcccgtttacgtagggtaactacctacttacctttacctaaccttttaaccttttaactttcgttcggttaacttaacggtttaccggggttacccggaacccggaccgggtcccccgtaaggggtaacccgtaacgggttacccgtttacggaacgtttaacgacggttcgggggttaagtacgggtactaaccaaacccgaaccggtaaccgtaacccggtaaccgggaaaccccctacgtaacgtacccgaccggtacgtccgttacgacgggtacgggtcggtttcgttccttcctcgtacgtcgtaacttacccgtcgttgggaccgggtacgttccttactgtcgactaacgtaaacctaaccttacctaccaacgtcgactaccgttacgtacgttttcgttttaacgtttcgacgttacgaacgttccgttaggttaccgtcgtaaccggttaggtacgttaacgtacgggttacccgttacgggacccgggttaccgggtaaccggttaaccccggtttcggtcccttaacccggtcctttacccaccggttacccgccctaacccggtaacccggaacgttcccccg

SEQ ID NO: 210671 - DNA, 703 bp, Homo sapiens
  misc_feature: GYAE6OF01CIIKY.7.78.H01.1.454.CMB.1.raw
  modified_base (225)..(225): a, c, t, g, unknown or other
  misc_feature (225)..(225): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (277)..(277): a, c, t, g, unknown or other
  misc_feature (277)..(277): n is a, c, g, or t
  modified_base (597)..(597): a, c, t, g, unknown or other
  misc_feature (597)..(597): n is a, c, g, or t
tcagcgtgtctctacacgaccggtgctcgatttagtgtgagtagtttgggtttggggacccaacaaccacacccctcctaagaagaagcccctagaccacagctccacaccatggacctggacctggagatcctcttcttggtggcagtagcaacaggtcgcccactcccgaggtgcagctggtacagtctgggtctagaattggaaggacgccgtggggctacnggtgagtcgttgcctgacacgtcttgngtatcntctcacttacttattcgtntacgtaacgttcggtacccgacgtaccggccccgtaggaacgaacggtccgtagacctacgtacggttgggaatcgtaactaccgaaaccggtaccgaacgaccgtaccgggaaaccccctacgtaactccgtaccccgacggtacccttaaccgacgggtacggttcgtttacgttcccttcgtacgtacgtcggtaactcccggttacgtcgggccgggtacggtccgttactcgtgaccgaagtacctaacctacgttaccacgtacgtacacctacgttagttccgttttagttacgtacgtagacgttaccggtnttcgttcgcgttagtgtagtacgtacgtacgtacgggtacgaccggttacgacggtccaccgttcctaccggtcacccgtacccctcggtaccgaacccggtcccg

SEQ ID NO: 210672 - DNA, 778 bp, Homo sapiens
  misc_feature: GYAE6OF01DNZ0Y.7.78.H01.1.454.CMB.1.raw
  modified_base (162)..(162): a, c, t, g, unknown or other
  misc_feature (162)..(162): n is a, c, g, or t
  modified_base (732)..(732): a, c, t, g, unknown or other
  misc_feature (732)..(732): n is a, c, g, or t
tcagcgtgtctctacacgaccggtgctcgatttagtgtgagtagtttgggtttgggacccaacaaccacacccctcctaagaagaacgcccctagaccacagctccacaccatggactggacctggagactcctcttcttggtggcagtagcaacgaggtcncccactcccgaggtgcagctggtacagtcgtgggtctgaattggaggacgccgtggggctacgagtgagtcgttcgcctgacacgtccttgtgtactacacttctactacttactttagttcctagttacgtaaggttcgggtaccgacgtaccggcccgtaggaaccgtacggtccttagaacctacgtaggtaggggtactacggtactaacgaaaccgtacccgtaacgtaccggtaaccccggtaaacccctacgttacgtacccgacccgtaacggtcccgttacgacggtcgggtttacgtttacgtccttaccgtcgtagttacggtaccttaccgtccggtacgggtaccggtacgtttaccttacgtccgttaacggaccgttaaagtaaacccctaaccgttaacccttacccgaaacggtttaccgaacccgtacttaccggttacgttttacccgtttttagttaccgaacgtggtacgttcgttactcgtaggttactaggggacttacgtggtaacgtccgggtacgggaccgttaccggtaacgttcggtacccnccgttctaccctcggaaccctcccaacccgtaacggcccggttccc

SEQ ID NO: 210673 - DNA, 1017 bp, Homo sapiens
  misc_feature: GYAE6OF01D4ZLS.7.78.H01.1.454.CMB.1.raw
  modified_base (191)..(191): a, c, t, g, unknown or other
  misc_feature (191)..(191): n is a, c, g, or t
tcagcgtgtctctacacgaccggtgctcgatttagtgtgagtagtttgggtttggggacccaacaaccacacccctcctaagaagaacgcccctagaccacagctccacaccatggactggacctggaggactcctcttcttggtggcagtagcaacgaggtcgacccactcccaggtgacagcgtggacngtactgggtctgaatgaggacgccgtggggacgtcgaggtcggacgtcggttcgccgtgacaacgtcccttgtaggactactacttccttactactttaacctttattcgttacgtacgtaacggttcggggtacccgtaacaccggggtacccctagggtaaacccgtaacgggttcccgtttacgggtaaccttaacgtagggttagggggtaccgttagggtaaccctaaccgaaacccggtaaccccggtaaacgtaacccgggttaacccggggtaaacccccctaacggttaaccgtcccggacccggggttaccgtaccccgggtttaaccggggacccgggggtttcgggttttacctcccggtttacccgaccggtaacgttaccggtaccgttacccgttacgggttacgggtaccgggtacgttacccgtttattcccggtaaagtaccgtaaacgtaaccccgttaaacccgtaacccgttaaccgtaaacccgtttaaccgtaacccgggtaacctttaaccgggtttaccccgttttaacggttttttaaacggtttacggtaaacccgggttacggtacccgggttaccggtttaccggttttaacccggtggtttaacccggttaggtaaccgggtttaattaccgggttaaccgttacccgggggtaacgggggttaaccccgtaaccgggggttaaccctacggggttaaccccgtcccggtttaacccggttccccgtaacccggggttcccctaaccccgggttaccccgaaaccccgggttaccccgggtacccgtttacccggg

SEQ ID NO: 210674 - DNA, 663 bp, Homo sapiens
  misc_feature: GYAE6OF01AY3EH.7.78.H01.1.454.CMB.1.raw
  modified_base (486)..(486): a, c, t, g, unknown or other
  misc_feature (486)..(486): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcaggtgagcgttgcctgcaagtccttctggatacatcttcacttacttattctgtctaagttcgggtccgacgtacggcccctaggaaccaaacgggtccttaggaaccttaaccgagttgggggaattgggaacttaccaaaccgtacccgtaacaccgttacgggaaaccccccactaacgtcgccccgaggtacccttaccgacgtacggggtcggtttgtccttcctccgtatcggactacctcgtcgggtccgggacgtcttanctcgacagtaactaacctaaccttacaaccgtgactaacacgttcgtccgttttattttacgacgagtacgtcgttcgtctgtcagtagtaattcgacgtacggtcggggacctacggggtaccctgggtcccaccgttcctcctacacgtaccccaccgtaccggaccggtccccg

SEQ ID NO: 210675 - DNA, 749 bp, Homo sapiens
  misc_feature: GYAE6OF01DLOPO.7.78.H01.1.454.CMB.1.raw
  modified_base (159)..(159): a, c, t, g, unknown or other
  misc_feature (159)..(159): n is a, c, g, or t
  modified_base (227)..(227): a, c, t, g, unknown or other
  misc_feature (227)..(227): n is a, c, g, or t
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (462)..(462): a, c, t, g, unknown or other
  misc_feature (462)..(462): n is a, c, g, or t
  modified_base (562)..(562): a, c, t, g, unknown or other
  misc_feature (562)..(562): n is a, c, g, or t
tcagcgtgtctctacacgaccggtgctcgatttagtgtgagtagtttgggttggggacccaacaaccacacccctctaagaagaacgccctagaccacagctccacaccagtggactggacctggaggatcctcttcgtggtggcagtagcaacaggtnccctactaccgaggtcgcacgctggtacgagtcgtagggtctagtaatgaggaacgccgtggggactnagtgagtcgttggacctgacaagccttcgnggatacgntccttagaacttacttatacgtagtactaagtttcgggaccaacgacgggttaccccagggtaacgaaacgtccgttaagaaccgttacgaaggttgggtaacctaggaacttaaccaaaccggtaacctaacgaacccggtacgggaaaacccctaccgtataccggaaccccgtaggtacccttaccgaaacggnggggttcggtttacttacctcgtaaccgtaagtcgggacttaccgtccggtaggacggtacgttacctatgacgacctaaagtaacctaataccccttanaacccgtagaacgatactgtttaaccgttttgttaccgaagaccgggtatcccgttagtcgtaagtctaacggtggttaaactcggtaacttaccggggaaggttaccccgggaaacggtaccttagggttcccccaagggttccctcgtaaacaccgacctacccgtaaagtacccgggacccccg

SEQ ID NO: 210676 - DNA, 644 bp, Homo sapiens
  misc_feature: GYAE6OF01DNH0D.7.78.H01.1.454.CMB.1.raw
  modified_base (271)..(271): a, c, t, g, unknown or other
  misc_feature (271)..(271): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatccctcttcttggtggcagtagcaacaggtcgcccactcccaggtgcagctggtacagtctgggtctgaattgaggagccgtggggcgtcagtgagcgttgcctgcaagccttctggatacatcttcactactttattctntcaagttgggtaccgactacggccccgtaggaacaaggtccttgaactacgatggggatggatacgaacaccgacacgtacggaacccccactatcgacccaggccttacacgacggggtcggtttcgtccttcctccagtcggacttaccgtcgtggtaccgggacggttcttatcctgacacgtaactaaaccctaaccttaccaacctgacctacaccttcgtttccgttttatttcgtacgagtcgtccgttcgtctggttcaggttagtaacgttcgtacgttaccggtggggtacccaacggggtacccttcggtaccgtacccgtcttacccgtcgactccccgaaccgcccgaacgggtaccccg

SEQ ID NO: 210677 - DNA, 777 bp, Homo sapiens
  misc_feature: GYAE6OF01DYGC0.7.78.H01.1.454.CMB.1.raw
tcagcgtgtctctacacgaccggtgctcgatttagtgtgagtagtttgggtttgggacccaacaaccacacccctcctaagaagaagcctctagaccacagctccacaccatggactggacctggaggatcctcttcttggtggcagtagcaacaggtcgcccactcccaggtgcagctggtacagtcgtgggtctgaattgaggaagccgtggggcgtcgagtgagtcgttgcctgcaacgtcccttcgtaggatactacttcttacctacttactttattctagttactaagttcgggtacccgacgtaccggtccccgtaggaaccgtaacggtcccgttacgaacctacgaggtaggggtatagggactaccaaccgtacccgaacgtaccgtaccgggaaaccccctacctacgtccgacccgtaccggtacccttaccgacggtacggggttaccggtttcgtcccgtttaccgtacccgtacgttaggtaccttaccgtaccgttcggggtaccgggtaccggttacttacttccgtcggactaacgtaacctaaacccgtaacccttaccgtaaaccgtccgaccgaccgtacgttcgtttaccgttttagtttacgaccggtaggtaccgtcgttacgtcgttcgtaccgaggttacgtaacgtgtaccgtacggtcggggtacccgtaaccgggtaccgttccgggtaccgtaccccgttccgttacccgtaccgaacccggtcccctacgaaaccccggtacccgg

SEQ ID NO: 210678 - DNA, 871 bp, Homo sapiens
  misc_feature: GYAE6OF01B5HDD.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggagatcctcttcttggtggcagtagcaacaggtcgcccactcccaggtgcagcgtggtacagtcgtgggtctgtaagttggagaacggccgtggggcgtcgtagtggaggtcgtttcgcctgacgaacgtcccgttacgtaggaattacctactttctttaccgtaactttacgttttactttacgtacgttacttaacggtttccggggtaaccgtaccgaccggtccccgtaggtaacgacggtccttagacctaacgagttggagtggacaccgaacaccgacgtacgtaccggtaaaccccacgtacgtacgcccgtacggtcctacgacgtacggggttcgtttaccgtccttaccgtacgtaggtcgtaaccgtttcgtaccggtttacgggtacccgggtacggtactttacgttacgtacgtacgtaaacgtaacccttaacccgtaaacccgttaccgtaacccgtacggaaacccgtaccgttaaccgttaccggtttttaaccggtttttaacgtttcggtaaaccggggacgtttaccgggttaccggtttacgttaccggtttacggtaccggttacgttaagggtttaaccgttacgggttaaccgggtaccgggtaacgggtaaccccggggtaacggttacccggttaccggttaccccggtcctaacccccggtttcgaccccgtttaccggaccccgtaccccggaaaccgggccccgggtttaacccg

SEQ ID NO: 210679 - DNA, 757 bp, Homo sapiens
  misc_feature: GYAE6OF01C8DBZ.7.78.H01.1.454.CMB.1.raw
  modified_base (176)..(176): a, c, t, g, unknown or other
  misc_feature (176)..(176): n is a, c, g, or t
  modified_base (578)..(578): a, c, t, g, unknown or other
  misc_feature (578)..(578): n is a, c, g, or t
  modified_base (715)..(715): a, c, t, g, unknown or other
  misc_feature (715)..(715): n is a, c, g, or t
  modified_base (723)..(723): a, c, t, g, unknown or other
  misc_feature (723)..(723): n is a, c, g, or t
tcagcgtgtctctacacgaccggtgctcgatttagtgtgagtagtttgggttggggacccaacaaccacacccctctaagaagaacgccctagaccacagctccacaccatggactggacctggaggatccttcttcttgggtcgcagtagcaacaggtcaccctactccgaggtncacgctcggtacagtcgtcggtctgtaacttggaggaacgcgtggggctcagtgacgtcgttcgcctgacaacgtcttcgtaggtactacacttccttactacttaacgtttacgttctacgtctaaggttccgggtaccgacgtacggcccgtaggaactacggtccttgtaactacagtacgggtatacggtaacctacgtaaacgaccgtaacgtaacggtacccgggaaacccctacctacgtaccggaccctacggtccttaccggaaacgggtacggggtttccgtttacgttccgtactaccgtacgtacgttactaccgttcgacggggttaccggccttacttacgtccgtagaacgttaacgtaaccttaaaccggtaccttcaaaccgggntaaccgtaccgtcgtttacgtttacttttagttaccgacggtaacgttcgttacccggtagttcacggttacgtaaggttacggtaattccgacgttaaacgggtccggaacggtaccgggaacttcggttaacccnccgttacncgtactaaccgcccttacggaaccgtccggtacc

SEQ ID NO: 210680 - DNA, 839 bp, Homo sapiens
  misc_feature: GYAE6OF01EN299.7.78.H01.1.454.CMB.1.raw
  modified_base (160)..(160): a, c, t, g, unknown or other
  misc_feature (160)..(160): n is a, c, g, or t
tcagcgtgtctctacacgaccggtgctcgatttagtgtgagtagtttgggtttggggacccaacaaccacgacccctcctaagaagaacgccctagaccacagctccacaccatggactggacctggaggactcctcttcttggtggcagtagcaaacgnggtcgcccactcccgaggtgcgtagctaggtactaggtccgtgggtctagaagttggaggacgccgtaggggctcaggtgagtcgttgcctgacacgtcctgtaggactactacttcttacctaacttacttacttcgtcgtacgtaacgttcgggtacccgacgaccggtcccgtaggaacctacggtccttagaacctacgacggtagggtactaggaaccttaccgaaaccgtaccggtaacctaccggtaacccgggaaccccctaacgttacgcccgtaaccggtacggtaccttaccggacggttacgggtacgtttcgtaccgttactacccgtagtcgtactaccgttcggtcgggtaccgggtacttacttacgtccgtacgtaaccggtaacctaaaccgttaacccttaaacccgttaccgtaaccggttacggaaacccgttaacccgttaacggtttcccggtttttaaccggttttttaacggttacgggtaacccggtgggttaaccccgttacggttcgttccgttaaggtaacggtacgtaggggtttaactcggtaaccgtttggggaacccgggtaaccggtaccgggtacccgttacggtacccgtcccgttccgtaccgtacgaccccgaccctaacccggaacggtaccgttacccg

SEQ ID NO: 210681 - DNA, 848 bp, Homo sapiens
  misc_feature: GYAE6OF01ENX2J.7.78.H01.1.454.CMB.1.raw
tcagcgtgtctctacacgaccggtgctcgatttagtgtgagtagtttgggttgggacccaacaaccacaccctcctaagaagaagcccctagaccacagctccacaccatggactggacctggaggatcctcttcttggtggcagtagcaacaggtcgccactccaggtgcagctggtacagtctgggtctagaattgagagccgtggggctcagtgagtcgttcgctggcaagtccttactggactacgtatcttcacttacttattctgtactaagttcggtaccgacaccggtccctaggtaacacgggtcccttagacctaacgtagtacgggtattacggaattaccgaaaccacccggtaacgaaccggttaccgggaaaccccctaacccgttagtacccggccctaacggttacccctttacgaacccgggttaagggggttcccggttttaccgtttaccggttacccttccgtaaaacgggttccggttaaccggttaaccccgttcgggtaccgggttacccgggggtaaacggttccttttaccgcggtacggtaacgtacccgtaaaccgttaaaccctaccttaacccgtaacgtaccgggtaacctaacccgtaggtttaccgtttacccgttttttacgtttacgggaacgtcggttaaccgtccgggttaccgtttacggacgtttaacgtaacggggttagtaaaccggtttcggtaaaccccgttggggtaaccccggtaaccggtaaccgggttaaccccgttccggtaccgtaccgttcccacccgtgtaccccgtaccgttacccgaaccggtcccggttaacccg

SEQ ID NO: 210682 - DNA, 633 bp, Homo sapiens
  misc_feature: GYAE6OF01EJ2EB.7.78.H01.1.454.CMB.1.raw
  modified_base (249)..(249): a, c, t, g, unknown or other
  misc_feature (249)..(249): n is a, c, g, or t
  modified_base (382)..(382): a, c, t, g, unknown or other
  misc_feature (382)..(382): n is a, c, g, or t
  modified_base (500)..(500): a, c, t, g, unknown or other
  misc_feature (500)..(500): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggactcctcttcttggtggcagtagcaacaggtgcccactcccaggtgcagctggtacagtctgggtctgaattgaggaagcctggggcgtcagtgagtccgtttgcctgacaagtcccttntggatacatccttacacttacttattctgtcaagttcggtccacacggccctaggacaaggcttgactacgagttgggataggactacgaacaccgacacgtacgggacccacgtatcgccgtagccttcacncggggtcgttttcgtccttcgtcgacgtcgactacctcgtcgggtacgggacgtcttagtcgtcgacgtagtaactaaccctaacgttacaaccgtcgacgactagtcttacgttttntttacgacgtaagtcggtacgttcgtcttacgtcgtagtacggtactacgtacgtaccgtgggtaccgacgggtaacccttcggtcctacccgtcttcccgtacaccgcccgttaccacccgacgggtacccc

SEQ ID NO: 210683 - DNA, 759 bp, Homo sapiens
  misc_feature: GYAE6OF01BFQYT.7.78.H01.1.454.CMB.1.raw
tcagcgtgtctctacacgaccggtgctcgatttagtgtgagtagtttgggttgggacccaacaaccacaccctcctaagaagaagcccctagaccacagctccacaccatggactggacctggaggactcctcttcgttggtggcagttagcaacgaggtcgcccactccgaggtcgcagtcgtggtactaggtcgtgggtctagtaattggaacggacgcggtcggggtcctgtaggtaggacggtcgttcgccgttagacgtacgtccgttagtacggtaactacctaattccttaactacctttaacttagttcgtactacgtagttcgggtacccgaacgtaaccggtcccgtaagggtaaccgtaaacgtcccgttaagaacctacgtaggtcgggtaagtcgaataaccaaccgtaaccgacctacggaaccccggtaaccctacgtcgtaccaccgtagtccctacgaggtacggttcgttcgtacctacgacgtacgtcggtacctaccgtggtcggtacggacgttcttggcttgacgtaacctaaacttaacccgtaaacgttccgaacgttcggaacctagttacccgttgtttaacgttttcgtagaaccgtgtaccgtcgttacgttgacgttagagttacgtaactggtacccgcggggtaccgaccgtaacggttaccccgttagtcccgtaccgttccgaccctccgtaccggttaccccaacgttaccggggaccccctcgg

SEQ ID NO: 210684 - DNA, 759 bp, Homo sapiens
  misc_feature: GYAE6OF01ALSIS.7.78.H01.1.454.CMB.1.raw
  modified_base (108)..(108): a, c, t, g, unknown or other
  misc_feature (108)..(108): n is a, c, g, or t
  modified_base (125)..(125): a, c, t, g, unknown or other
  misc_feature (125)..(125): n is a, c, g, or t
  modified_base (198)..(198): a, c, t, g, unknown or other
  misc_feature (198)..(198): n is a, c, g, or t
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
tcagcgtgtctctacacgaccggtgctcgatttagtgtgagtagtttgggtttggggacccaacaaccacacccctcctaagaagaagccctagaccacagctccacncatgactggctggaggntcctcttcgttggtcggcagtgacaacgaggtcgccctactccaggtcgcagctggtacagttcgtgggtctntaagtcggaggtacgcggtgggcgtcgaggtnacggtgttcgaccgngaacgtacgtcttcgaggactactatccgttactaagttacttcgttacgtacgttacttaacggtacgtaccgacggtaccggtcccgtaggaaccgtacggtcgtactacgtacgtaggtaggtacgagactacgtaaccgactacgtccgtaccgtacctacgcgaccgtaccgtacgtacgtacggacgtcggttcgttacgttcgtcgttacggacgttacgtaccgtaccgtacggttccgggttacggtacggttacgttacgtacggtaccgtacgtaaccgttaaccgttaaccttaccgtaacgtacgtacgtaccgtaccgttaccgtttacgtttacgtttacgttacgttaacgtacgtacgtacgttacgttacgtacgttacgtagttacgttaacggttacgtaccggtacggtacggtacggtaccgtaccgtacggtccgaccgttccgtaccgtaccgtacccgtacccgtaacccggtaccgtacccggtacgg

SEQ ID NO: 210685 - DNA, 929 bp, Homo sapiens
  misc_feature: GYAE6OF01BR4PY.7.78.H01.1.454.CMB.1.raw
  modified_base (186)..(186): a, c, t, g, unknown or other
  misc_feature (186)..(186): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtcgcccactcccgaggtgcagctggtacngtcgtggtctgtaattgaggaagccgtggggcgtcgagtgagtcgttgcctgacgtaagtccttcgtaggatactacttcttctaacttactttattacgttgtacgtaagtttcgggtccgtaaccgacggtccccgtaggaaccgtaacgggtaccgttacgtaaccgtaacgtaggttgggacgtaggtaacgtaccaaacccgaacccgtaaccgtaacccggtaacccgggtaaaccccctacctttacgtacccgtaccccgtaccggttaccccgttaccggaacccgggtaccggggttaccggttttaccgtttcccgtttaccgttacccgtaacggttaccgggttaaccgtttaacccgttccgggttacgggttacccgggttaccggtccgtttacgttaccgtcggaacgtaacggttaaaacccttaaaccccgttaaacccgtttaaccgtaacccgtaggtaaaccccgttccgttaaacgggtttcccggtttttaacccgttttttaaggttttaccggtaacggtaacggttacggttccgttaccgttacgttcgggttaacgtacggttagtaaccgttaacgttaaccggttaccgggtacgggtacccgggtaaccgggttacccggacccggtttacccgggtacccgtttcccggttacccgtaccgtaaccccggtccccggtttaaacccgacccggggtaaaccccggtcccg

SEQ ID NO: 210686 - DNA, 989 bp, Homo sapiens
  misc_feature: GYAE6OF01DTPR5.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggactcctcttcgttggtggcagtagcgaacaggtcgcccactcccaggtgacagctggtacagtcgtgggtctgtaattggaggacgccggtggggcgtacgaggtggagtcggttgccctgtaccgaagtccttacgtggataactcttccttactaccttactttacttcgtgttactaacgttcgggttacccgacgtaccggtaccccgtggaaccgtaacgggtcccttaggaaccttaccgaggttacggggacgtacgggtactaaccgtaaccgaccgtaacgaccggttaccggaaaccccctaccgttactacccggtacccggtaccggtacccgttcgaaaccgggttcggggttaccggtttttacgtccgtttctaccgtacgtttacggtaaccgttacccggttgttaccgggtaccggggtacgttacctttaacgtcccgtaacgggtactaaccggttaacctaaaccccgttaacccgttacccgtaacccgggttaccgtaaccgtaacccggttacccggttttaaccggttttacccgtttttttaagttttaaccggggtttaacccggtaggggtaacccggtttccccggggtttaccgtttaaccccggtttacgggtttaaccccgggtaaggtttaacgggggtttaaactttacccgggtttaaccggtttccggggtaaacccgggggggttaccccgtaaaacccggggggtttcccccttaaccgggggtttcccgtaacccccgggttttccgtaacccccggttacgaaccccgggtttaccccccgttaccccggaaacccggggtaacccccggttacccccgg

SEQ ID NO: 210687 - DNA, 653 bp, Homo sapiens
  misc_feature: GYAE6OF01B0M3O.7.78.H01.1.454.CMB.1.raw
  modified_base (463)..(463): a, c, t, g, unknown or other
  misc_feature (463)..(463): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtcgcccactccaggtgcagctgtacagtcgtggtctagatggaggacgtccgtggggcgtcagtgagtcgttgccgtgacaacgtccttcgtggactactacttcttccacttactttattctgtactagttcgggtccgaaccgtacggtcccgtaggacgtaacggtctcgactacgaggtacggatgactacaacgaccgtacaaccgtacccggaacccaacgtcgtcgacccggtagtccctagacggtgggtccgtttatccttcacgtgtcgtacttccgttcgtcgggtcgggtactnttacgtctagactagtaacctaacctacgtaccacgtcgaaccctgtacgttcgtttaccttttaggttacgacggttaacgtcgttccgttgtcttcgagttacgagttactcggtacgtcggtccgggacgtccggtaccgtcggtccacgtctacctaccgctaccccgtcaaacccgtcggtcccg

SEQ ID NO: 210688 - DNA, 864 bp, Homo sapiens
  misc_feature: GYAE6OF01EWVBI.7.78.H01.1.454.CMB.1.raw
  modified_base (224)..(224): a, c, t, g, unknown or other
  misc_feature (224)..(224): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattggaggagccgtgggcgtcaggtgngtcgttcgcctgactaacgccttcgaggtatactacttcttcctaacttacttttattccgttcgtactaacggtttacggggttcccgaaccgaaccgggtcccctagggaaccgtacggtcctttacggacctaacgtaggtaggggtagtaggtaacgtaccaaacccgtaccggtaacaccggttaaccgggaaacccccacgttacgtcccgacccgtacggtccgttaccgacggttacgggtccggttttagtcccgtttacctcgtacgtacggtacgtacccgttcggtacgggttacgggtcgtacctttagtccgtactacgtaacgaaaccgtaaccttaacccgtactaaccccgtagggtaaccctaaccggttacgttaccggttttaaccgttttttacggtttaacgttaacggtaccggtaacgttcccgggtttaccgtacggtttaacgtttcggtaacggttacgggtaactttacggaaccggtttcgggtaaccgggggtaccccgggttaccggggttaaaccccgtcggggtttaccccctaccgggtttcccctaccccgtcggtaaccccggttaccctaaacccgggacccccggttaacccgggtccccgg

SEQ ID NO: 210689 - DNA, 529 bp, Homo sapiens
  misc_feature: GYAE6OF02GOXY7.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacaggcgtttgtcttctccatggatacctctgtcgggacggcttatctgcagataaccaaccttcaacctgaacgacactgccgtttattttgtacgagagcgtgtctgtcagtgaattgactatgggccagggaaccctggtcaccgtctcctcagcctcaccaggccc

SEQ ID NO: 210690 - DNA, 542 bp, Homo sapiens
  misc_feature: GYAE6OF02HWW2V.7.78.H01.1.454.CMB.1.raw
  modified_base (519)..(519): a, c, t, g, unknown or other
  misc_feature (519)..(519): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaaggccttgactacatgggatggatcaacaccgacactgggaaccccactatgccaggccttcacagggcgtttgcttctccatggatacctctgtcgggacggcttatctgcagataaaccaaccttcaaacctgacgacactgccgttttattttgtacgagtagcgtcgtctgttcagtggaattgactactggggtccaagggaaccctggtccaccggtntcctcagccctcaccaagggccc

SEQ ID NO: 210691 - DNA, 539 bp, Homo sapiens
  misc_feature: GYAE6OF02HU6DD.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatggggatggatcaacaccgacactgggaaccccacctatgcccaggccttcacagggcggttttgtcttctccatggatacctctgtcgggacggcttatctgcagataaccaaccttcaacctgacacactgtccgtttattttgtacgagtagcgtcgtctgtcagtgaattgactacgtgggccagggaccctggtccaccgtctcctcacgcctccaccaggccc

SEQ ID NO: 210692 - DNA, 536 bp, Homo sapiens
  misc_feature: GYAE6OF02GE5QZ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtgaattgactactgggccagggaaccctggtccaccgtctcctcagcctccaccagggccc

SEQ ID NO: 210693 - DNA, 556 bp, Homo sapiens
  misc_feature: GYAE6OF02GOVRR.7.78.H01.1.454.CMB.1.raw
tcagcgtgtctctacacgaccggtgctcgatttagtgtgagtagtttgggtttgggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatggatggatcaacaccgacactgggaaccccactactgcccaggccttcacagggcgtttgtcttctccatggatacctctcgtcgggacgtcttactctgcagtactaaccaacttcaacctgacgacactgtccgttttattttcgtacgtagagtcgtcgtctgtcagtgaagttgactcgtgggccgagggtaacccttggccaccggtctacctcgacgtccctccgaccgacggtcccg

SEQ ID NO: 210694 - DNA, 536 bp, Homo sapiens
  misc_feature: GYAE6OF02F8SPL.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactgggccagggaaccctggtcaccgtctcctcacgcctccaccaggccc

SEQ ID NO: 210695 - DNA, 563 bp, Homo sapiens
  misc_feature: GYAE6OF02FWL0C.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccactatcgcccaggcccttcacgagggtcggttttgtcttctccatggactacctctgtcgggacgtcttatctgcagactaaccaccttcaacctgacacactgccgttttattttcgtacgagagtcgtcgtctgtctagtggtaattcgacttacgtggggaccaagggtaaccctggtccaccgttctcctcacgtccctaccgaccgacggtcccc

SEQ ID NO: 210696 - DNA, 549 bp, Homo sapiens
  misc_feature: GYAE6OF02GQH4E.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcggtttgtcttctccatggatacctctgtcgggacggcttatctgcagataaccaaccttcaacctgacgacactgtccgtttatttttcgtacgtagagtcgtcgtctgtcagtggaattgactatgggccacgggtaccctggtccaccgtctcctcgacgccctccgaccgaaggtccccg

SEQ ID NO: 210697 - DNA, 538 bp, Homo sapiens
  misc_feature: GYAE6OF02HSJW7.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacgcttatctgcagataaccaacttcaacctgacgacactgcctttattttgtacgagagcgtcgtctgtcagtgaattgactacgtgggccagggaccctggtccaccgtctcctcgacgtccctaccaccaggtccc

SEQ ID NO: 210698 - DNA, 543 bp, Homo sapiens
  misc_feature: GYAE6OF02GMFF8.7.78.H01.1.454.CMB.1.raw
  modified_base (283)..(283): a, c, t, g, unknown or other
  misc_feature (283)..(283): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccganaggcccctggacaaggccttgactacatgggatggatcaacaccgacactgggaacccccactatgcccaggccttcacagggcgtttgcttctccatggatacctctgtcgggacggcttatctgcagataaccaaccttcaacctgacgacactgtcctttatttttgtacgtagagtcgtcgtctgtcagtggaattgactacgtgggcgacgggacctggtccaccgtctcctcgacgcctaccaccgaggtcccg

SEQ ID NO: 210699 - DNA, 771 bp, Homo sapiens
  misc_feature: GYAE6OF02J0UTO.7.78.H01.1.454.CMB.1.raw
  modified_base (258)..(258): a, c, t, g, unknown or other
  misc_feature (258)..(258): n is a, c, g, or t
tcagcgtgtctctacacgaccggtgctcgatttagtgtgagtagtttgggtttggggtacccgaacaaccacacccctcctaacgaagaagaccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttnactacttattctgtcaattgggtccgacaggcccctggacaaggccttgactacatgggatggatacaacacgacactacgggaaccccactatcgcccacggtcccttacacgacgggtccggttttcgtctttacctccagttcggacttacccgttcgtcggttacgggggtaccggtcgtttaacgttcgttcggactacggtaacttaaaccctaaacccgttttaccaaaccgttacggaaccggttaacccaaccgttaccgttaacccggtttttatttttttacgggtaaacggttacggtaaccgttacgggtttaccggtttcgttcggtttaccgtaacggttcgggtaaacgttttacgaaccgtttacgggtacggggtacccgggtaacgggggtaaaccccgtttcggggttaacccttacccgggtttacccgttacccgtttaccggaaccggttcccccgtttaccccgacccgggtaaacccggggtcccccg

SEQ ID NO: 210700 - DNA, 562 bp, Homo sapiens
  misc_feature: GYAE6OF02H6I9A.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatcgcccaggcccttcacaggggcggttttcgtcttctccatggactacctctggtcgggacgcttagtctgcagataaccaaccttcaacctgaaccgacactcgtccgtttattttagtacgtagagtcgtcgtctgttcagtggtaattgactacgtggggccagggaaccctggtccaccggtctccgtcacgccctaccacccgaaggtccc

SEQ ID NO: 210701 - DNA, 549 bp, Homo sapiens
  misc_feature: GYAE6OF02HKQXS.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatcgcccaggccttcacagggcgtttgtcttctccatcggatacctctgtcgggacgcttatctgcagataaccaaccttcaacctgacgacactgccgttttattttgtacgagtagtcgtcgtctgtcagtggaattgactcgtgggccagggaaccctggtaccaccggttctccctcacgtccctaccaccgaggtcccc

SEQ ID NO: 210702 - DNA, 562 bp, Homo sapiens
  misc_feature: GYAE6OF02IOAFG.7.78.H01.1.454.CMB.1.raw
  modified_base (375)..(375): a, c, t, g, unknown or other
  misc_feature (375)..(375): n is a, c, g, or t
  modified_base (388)..(388): a, c, t, g, unknown or other
  misc_feature (388)..(388): n is a, c, g, or t
  modified_base (403)..(403): a, c, t, g, unknown or other
  misc_feature (403)..(403): n is a, c, g, or t
  modified_base (432)..(432): a, c, t, g, unknown or other
  misc_feature (432)..(432): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacaccgacactgggaaccccactatgcccaggcccttcacaggcgtttgcttcnccatggatacctntgtcgggacgcttanctgcagataaccaacttcaacctgacganactgtcgtttattttgacgagagccgttacgtctgtctagtggaattgaactcgtgggccaagggtaacccctgggtaccacccggttctacccgtcgacgtaccccgttaccacccgtaagggaccccc

SEQ ID NO: 210703 - DNA, 541 bp, Homo sapiens
  misc_feature: GYAE6OF02GWKHD.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgcttctccatggatacctctgtcgggacgcttatctgcagataaccaacttcaacctgacgacactgtccgtttattttgtacgagtagcgtcgtctgtcagtgaattgactacgtgggccagggaccctggtccaccgtctccgtcacgcctaccgaccgaggtcccc

SEQ ID NO: 210704 - DNA, 554 bp, Homo sapiens
  misc_feature: GYAE6OF02IYWH0.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaaggccttgactacatgggatggatcaacaccgacactgggaaccccacctactgcccaggccttcacggggcggtttgtcttctccatggatacctctgtcgggacggcttatctgcagactaaccaaccttacaacctcgacgacactcgtccgtttattttgtacgagagcgttcgtctgtctagtggtaattgactacgtgggccagggaccctggtcaccgtctccgtcacgtcctaccaccgacggcccctacg

SEQ ID NO: 210705 - DNA, 547 bp, Homo sapiens
  misc_feature: GYAE6OF02IUO74.7.78.H01.1.454.CMB.1.raw
  modified_base (419)..(419): a, c, t, g, unknown or other
  misc_feature (419)..(419): n is a, c, g, or t
  modified_base (530)..(530): a, c, t, g, unknown or other
  misc_feature (530)..(530): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacaccgacacgtacgggaaccccactatcgcccaggcccttcacgagggtcggtttgtctctccatggatacctctggtcgggacgtcttatctgcanactaacctaacctcaacctgacgtacactgtccgttttatttcgacgtagacgtccgtcgtctgtcagtgaattgactcgtgggcagggaaccctggtcaccgtctcctcngccctcaccgacggacc

SEQ ID NO: 210706 - DNA, 575 bp, Homo sapiens
  misc_feature: GYAE6OF02HKJAR.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacacgtcgggaaccccactatcgcccaggccttcgacggggtcgtttgtcttctccagtggactacctctggtcgggacggtcttatctgcagactaaccacttcaactgacacactgtccgttttattttcgacgtagacgtcgttcgtctgtcgtagtggtaattcgactacgtgggaccgtacgggaaccctggtacctacccgttcctcctcgacgtccctacccgaccgacgggccctacgg

SEQ ID NO: 210707 - DNA, 577 bp, Homo sapiens
  misc_feature: GYAE6OF02I8MGG.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtcgacaggcccctggacaaggccttgactacatgggatggatcaacaccgacactgggaaccccactatcgcccaggccttcacgagggtcggtttcgtctttctccatggactacctctgtcgggacggtcttatctgcagataaccaacttcaactcgaacgacacttcgtcctttattttacgtacgagtagtcgtcgttctgttcaggttggaattcgactacgtcgggaccgtacgggaaccctggtactacccggtcgtccctacgaccgtccgtacccaccgtacgggacccc

SEQ ID NO: 210708 - DNA, 551 bp, Homo sapiens
  misc_feature: GYAE6OF02I967V.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaaggccttgactacatgggatggatcaacaccgacactgggaaccccacctatgcccaggccttcacagggcggtttgtcttctccatggatacctctcgtcgggacggcttatctgcagataaccaaccttcaacctgacgacactgccgtttattttgtacgtagacgtcgtcgtcttgtcagtgtaattgacttacgtgggccgacgggaaccctggtccaccgtctccgtcacgccctaccaccacgggtccc

SEQ ID NO: 210709 - DNA, 538 bp, Homo sapiens
  misc_feature: GYAE6OF02GYPIC.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatcgcccaggccttcacagggcgtttgtcttctccatggatacctctgtcgggacgcttatctgcagataaccaaccttcaacctgacgacactgtccgtttattttgacgagagcgtcgtctgtcagtgaattgactcgtgggccagggaaccctggtccaccgtctcctcacgccctccaccgacggtccc

SEQ ID NO: 210710 - DNA, 580 bp, Homo sapiens
  misc_feature: GYAE6OF02FK0SV.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccgacaggcccctggacaaggccttgactacatgggatggatcaacaccgacactgggaaccccactatcgcccaggcccttcgacagggccggtttgcttctccatcggataccctctgtcgggacggtcttatctgcagataaccaacttcaacctgacgacactgtccgtttattttgacgtagacgtcgtcgtctgtcagtggaattcgacgttacgtggggtacccaaggggtaacccttgggtcctaccggttccgttccgtaccgtacgtcccgtaccgacccgtaaggggtcccc

SEQ ID NO: 210711 - DNA, 534 bp, Homo sapiens
  misc_feature: GYAE6OF02I3UK7.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcgtttgtcttctccatggatacctctgtcgggacgcttatctgcagataaccaaccttcaacctgacgacactgccgtttattttgtacgtagagtcgtcgtctgtcagtgaattgactacgtgggccagggaacctggtcaccgtctctcagcctccaccgaggtccc

SEQ ID NO: 210712 - DNA, 549 bp, Homo sapiens
  misc_feature: GYAE6OF02GQ7IS.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcgtttgtcttctccatggactacctctgtcgggacgcttatctgcagactaaccaaccttcaacctgacgacactgccgtttattttcgtacgtagagcgtcgtctgtcagtgaattgactacgtgggccagggtaaccctggtcctaccgtctcctcacgccctcccgaccgaacggtcccc

SEQ ID NO: 210713 - DNA, 559 bp, Homo sapiens
  misc_feature: GYAE6OF02H6Y54.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtaccaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgccaggccttcacagggcgtttgtcttctccatggatacctctgtcgggacggcttatctgcagataaccaaccttcaacctgacacactgccgtttattttgtacgtagagtcgttacgtcttgtcagtggaattgactactggggccagggaacccttgggtaccaccggtctccctcgacgcccttaccgacccaacgggccctaacgg

SEQ ID NO: 210714 - DNA, 546 bp, Homo sapiens
  misc_feature: GYAE6OF02F0MMT.7.78.H01.1.454.CMB.1.raw
  modified_base (527)..(527): a, c, t, g, unknown or other
  misc_feature (527)..(527): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatcgcccaggccttcacagggcggtttgtcttctccatggatacctctgtcgggacgcttatctgcagataaccaccttcaacctgacgacactgtccgttttattttcgtacgtagagcgtcgtctgttcagtgattgacttacgtgggccagggtaccctgggtcctaccgtctcctcncgcctccaccgacggtccc

SEQ ID NO: 210715 - DNA, 536 bp, Homo sapiens
  misc_feature: GYAE6OF02JG9HP.7.78.H01.1.454.CMB.1.raw
  modified_base (412)..(412): a, c, t, g, unknown or other
  misc_feature (412)..(412): n is a, c, g, or t
tcagcgtgtctctacacgaccggtgctcgatttagtgtgagtagtttgggtttggggacccaacaaccacacccctcctaagaagaagcccctagaccacagctccacaccatgaactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacaccgacactgggaaccccacctaatcgcccaggcccttcacagggtcggtttgtcttctccatcggactaccgtctgtcggacgcttanctgcagataaccactcaacctgacgacactgtctttatttcgacgtagagcgtacgtctgtcagtgaattgactgtggaccgtaggacctggtccacgtctcctcacgccctcaccgaggtccc

SEQ ID NO: 210716 - DNA, 542 bp, Homo sapiens
  misc_feature: GYAE6OF02HK7KO.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggcccttcacagggcggtttgtctttctccatggatacctctgtcgggacggtcttatctgcagataaccaaccttcaacctgaccgacactcgtccgtttattttgtacgagtagcgtcgtctgtcagtgaattgactagtgggccagggaccctggtccacgtctcctcacgccctccaccgaggccc

SEQ ID NO: 210717 - DNA, 548 bp, Homo sapiens
  misc_feature: GYAE6OF02GYMWM.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacggggcgtttgtcttctccatggatacctctgtcggacggcttatctgcagataaccaaccttcaacctgacgacactgtccgtttattttgtacgagagtcgtcgtctgtcagtggattgactacgtgggccagggtaaccctggtacaccgtcgtcctcacgtcctcccgacgacgggccctacg

SEQ ID NO: 210718 - DNA, 607 bp, Homo sapiens
  misc_feature: GYAE6OF02IQU34.7.78.H01.1.454.CMB.1.raw
  modified_base (246)..(246): a, c, t, g, unknown or other
  misc_feature (246)..(246): n is a, c, g, or t
tcagcgtgtctctacacgaccggtgctcgatttagtgtgagtagtttgggtttggggacccaacgaaccacaccctcctaagaagaagccctagaccacagctccacaccgactggactggacctggaggatcctcttcttggtggcagtagcaacaggtgcccactccaggtgcagctggtacagtctggtctgaattgagagcctggggctcagtgagcgttgcctgcaggccttctggatacntcttcacttacttattctgtacaaagttgggtccgacaggcccctggacaggccttgactacatgggatggatccaacaccgacacgtcgggaaccccacgtatcgcccgaggcccttacgacgacgggtcgttttcgtcctttctccgagtcggactacccgtctggtcgggacgtcttaagtcctgtctagactaacccaaccttcaacctgaaccactactcgtaccgttttatttcgtacgagtacgcgtcgtctgtactaggtagaattcgactacggtcgggaccctaacgggaacccttgggtacctacccgttcttccctccgtaccgtccctaccgtacccgaagggtcccc

SEQ ID NO: 210719 - DNA, 579 bp, Homo sapiens
  misc_feature: GYAE6OF02GWBGR.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacaccgacacgtgggaacccccactatcgcccaggcccttcacagggcgtttgcttctccatggactacctcgtgtccgggacgtctttatctgctagactaaccaacttccaacctgaccgacactgtaccttttattttcgtacgtagtacgtcgttcgtctagttctaggtgtaattgactacgtgggacctaggggtaaccctggtcctacccggttctccgtcgaccgtccctaccgtaccgacggttccccg

SEQ ID NO: 210720 - DNA, 544 bp, Homo sapiens
  misc_feature: GYAE6OF02ILGE1.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatcgcccaggccttcacagggcgtttgtcttctccatgatacctctgtcgggacgtcttatctgcagataaccaaccttcaacctgacacactgtccgttttattttgacgagtagcgttctctgtcaggtgaattgacttagtgggccagggaccctgggtccaccggtctccgtcacgccctaccaccgacggccc

SEQ ID NO: 210721 - DNA, 538 bp, Homo sapiens
  misc_feature: GYAE6OF02FTFEF.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacgctatctgcagataaccaaccttcaacctgacgacactgccgttttattttgacgtagagcgtcgtctgtcagtgaattgactacgtgggccagggaccctggtccaccgtctcctcacgccctccgaccaggtccc

SEQ ID NO: 210722 - DNA, 555 bp, Homo sapiens
  misc_feature: GYAE6OF02H402L.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctcatggatacctctggtcggacggcttatctgcagataaccaacctcaactgacgacactgtcgtttatttgtacgagagtcgtcgtctgtcgagtggtaattgaactacgtaggggccgaacgggtaaccctggtacctaccgtctcctcgaccgtcctacctaccgaacggtccc

SEQ ID NO: 210723 - DNA, 549 bp, Homo sapiens
  misc_feature: GYAE6OF02IR4ZA.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcggtttgtcttctccatggatacctctgtcgggacgtcttatctgcagactaaccaaccttcaacctgacacactgtccgtttattttgacgagtagcgttcgtcttgtctagtggtaattgactacgtggggtccgaagggtaaccctggtccaccgttctcctcacgcctaccaccgaggccc

SEQ ID NO: 210724 - DNA, 549 bp, Homo sapiens
  misc_feature: GYAE6OF02GPK0Y.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattggtccgacaggcccctggacaaggccttgactacatgggatggatcaacaccgacactgggaaccccactatcgcccaggcccttcacgagggcggtttgtcttctcctatggatacctctgtcgggacgtcttatctgcagactaaccaccttacacctgacacactgtccgtttattttgtacgagagtcgtcgtctgtcagtgaattgactacgtgggccgtagggaaccctggtaccaccgttctcctcgacgtccctcgaccgaggtcccc

SEQ ID NO: 210725 - DNA, 549 bp, Homo sapiens
  misc_feature: GYAE6OF02GADEI.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccactatcgcccaggccttcacagggcgtttgtcttctcctatggactacctctgtcgggacgtcttatctgcagactaaccaaccttcaacctgacgacactcgtacgtttattttgacgagacgtcgtcgtctgtctagtgtattgactacgtgggccagggaccctggtccaccgtctccgtcacgcctacccaccgacggtccc

SEQ ID NO: 210726 - DNA, 647 bp, Homo sapiens
  misc_feature: GYAE6OF02JU1WM.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacagtggatggatccaacaccgacacgtacgggaaccccacgtaactcgacccacggtcccttcgacgacgggtccggtttagtccttactaccgtagtacggactaccctcgtcggtcgggacgtcttatcgtgacgagtactaacctaaccttacaaccgtgaaccgtacacgttcgttaccgtttattttacggacgtacgtacgtacggttcgtcgttacgtcgtaggtacggtaattacgacgtacggtcgggacccgtaacggggtacccttagggtaccctaccggttccgtaccgtaccgtaccgaccctacccgtaaccgaccggtaccccg

SEQ ID NO: 210727 - DNA, 616 bp, Homo sapiens
  misc_feature: GYAE6OF02IYK43.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacaccgacacgtcgggaaccccactatcgacccaggcccttacacgaggggtcggttttgtcttctcctatcggactaccctctggtcggggacgtcttatctgcagactaaccaaccttcaacctgaaccgactactgtcccgttttattttcgacgtagtacgtccgttcgtcttagtcctaggttcggaaatttcgaaccttacggtcggggaccctaacggggtaccccttgggtaccctacccggttccttcccgtacgaccggtccctacccgacccgaacgggtcccc

SEQ ID NO: 210728 - DNA, 710 bp, Homo sapiens
  misc_feature: GYAE6OF02G1ICY.7.78.H01.1.454.CMB.1.raw
  modified_base (200)..(200): a, c, t, g, unknown or other
  misc_feature (200)..(200): n is a, c, g, or t
tcagcgtgtctctacacgaccggtgctcgatttagtgtgagtagtttgggtttggggtaccgaacgaaccacaccctcctaagaagaacgtccctacgaccgacacgacgtccctacacctagtggactggacctggaggatcctcttcttggtcgcagtagacaacgagtgccactccgtaggttgtcagcttggtacngtctgggtctgaattgagaagccgtggggcttcaggtgaggcgttggcctgccaaggcttactcggatacatcttcactacttattctgtcaagttggtccactaggccccttggacaaggccttgacctacgactcgggatcggactacggaaacggccgacgacgttcgggaaccccgacctaactacgaccccaaggtaccttacggaaacggggtacggtttaacgtctttacgtccgtaacgttcggtattaccgtacgtcggtacgggtaccggtaccttaactccgttcgacgtacggaactaaaccgaaccttacaaaccgtcgaacgtactaacttcgtaccgtttaattttacgtacgaagtacgtaccgttcgtacttggtaccgagggtacgaacgttcgacgttacgtcgggacctacggggtaaccctcgggttacaacccggttccttacccgtacgtacgtccctttacccgaccgttacgggcccttaaccgg

SEQ ID NO: 210729 - DNA, 533 bp, Homo sapiens
  misc_feature: GYAE6OF02FE3MM.7.78.H01.1.454.CMB.1.raw
  modified_base (377)..(377): a, c, t, g, unknown or other
  misc_feature (377)..(377): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttatctgtcaattgggtccgacaggcccctggacaaggccttgactacatgggatggatcaacaccgacactgggaaccccacctatgcccaggccttcacagggcgtttgtcttcnccatggatacctctgtcgggacgctatctgcagataaccaaccttcaacctgacgacactgcgtttattttgtacgtagagcgtcgtctgtcagtggaattgactactgggccagggaccctggtcaccgtctcctcacgcctccaccgaggtccc

SEQ ID NO: 210730 - DNA, 555 bp, Homo sapiens
  misc_feature: GYAE6OF02GG3WJ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccacctatgcccaggccttcacaggcgtttgcttctccatggactacctctgtcgggacggtcttatctgcagactaaccaacttcaacctgacacactgccgtttattttgacgtagagtcgtagtctgtcagtggaattgacttacgcggggctaacggggaacccttgggtccacccgttgtccctcacgtccctccgaccgaagggtccc

SEQ ID NO: 210731 - DNA, 804 bp, Homo sapiens
  misc_feature: GYAE6OF02IF3NY.7.78.H01.1.454.CMB.1.raw
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (229)..(229): a, c, t, g, unknown or other
  misc_feature (229)..(229): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtcatagtgagacgtcggtggtctgngtagngtcgtcncgtgacgacgttcctgagtactactcttctactacttactttacttcgtgtaacttaggttccggtaccacggacccggtcccgtacggaacgaccggttccgttacgtaacctaacgtacggggtaggtaggtaggtactaaaccgaaccgtaaccgaaccgtaccgggaaccccggtaaacccctaacttacgcccgaccggtaccgttccctacgacgggtacggggtttcgtttacgttcttaccctacgtaggtacggtacccttccgttcggttcggggtaccgggtacgtttactttacgtcgtacgaacgtaagtaaaccctaaacccgttaacccttaccgtaaccgtacggaaccaaccttcggttaccgttttacgtttttttacgtaccggaagtacggtaccggttccgttccgttcgttcgtaagtacgggtaagttagttaaccgtaccgttacggggccgggtaaccggtaaccgggtacccggttacgtaacccggttacccgtttccgtccgtaacggtcccgttaccccgaacccgtaaccggggacccgtacccg

SEQ ID NO: 210732 - DNA, 717 bp, Homo sapiens
  misc_feature: GYAE6OF02FYDNU.7.78.H01.1.454.CMB.1.raw
  modified_base (159)..(159): a, c, t, g, unknown or other
  misc_feature (159)..(159): n is a, c, g, or t
  modified_base (171)..(171): a, c, t, g, unknown or other
  misc_feature (171)..(171): n is a, c, g, or t
  modified_base (258)..(258): a, c, t, g, unknown or other
  misc_feature (258)..(258): n is a, c, g, or t
tcagcgtgtctctacacgaccggtgctcgatttagtgtgagtagtttgggtttggggggaccaacgaaccaccaccctcctaagaaggaagtcccctaggacctaccagtcgtccacaccatggactggacctggaggatcctctctggtggctagtancaacagggttcnccactccaggtagtcaggctggtacagtctgggtctgattagaggtagcctggggcgtcgagtgtagcgttgcctggcagccttcgnggactacactcgttcacctacttagttctcgtcaagttcgggtaccgacacggtcccctaggtacgaacgggtccgttcggacctacgactcggggaagtagggagtccgaacgaccggacacgtacggggtaaaccccttacgtagtcggacccaggtcctttcgaacgtaggggtaccgtttcgtcgttcgtaccgagtacggtactaccgtctcggtcgggacggtctttacttctgacaagtaactaacctaaccgttccaaccttagaaacgtacgtaacttcgtacccgtttttagttttacgggaccgaaggtaacgtccggttccgttacttgttacgtaggtcgtaagttcgacgttacggtggggtacccgtaaggggtacccgttgggtaccgtaccggttacctaccgtcgtaccggcccgtaccgggaccgtaacggggtaccccc

SEQ ID NO: 210733 - DNA, 581 bp, Homo sapiens
  misc_feature: GYAE6OF02FQ1A2.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcggtttgtcttctccatggactacctctgtcgggacgtcttatctgcagactaaccaccttcacctgacgacactcgtccgttttattttcgtacgagtagtcgttcgtctcgttcagtggtaattgacttacgtcggggaccgtaacggggaacccttgggtaccctaccgttcctcccgtcgacgtccctacccgacccgtaacgggtaccccc

SEQ ID NO: 210734 - DNA, 730 bp, Homo sapiens
  misc_feature: GYAE6OF02JSFE4.7.78.H01.1.454.CMB.1.raw
  modified_base (243)..(243): a, c, t, g, unknown or other
  misc_feature (243)..(243): n is a, c, g, or t
  modified_base (269)..(269): a, c, t, g, unknown or other
  misc_feature (269)..(269): n is a, c, g, or t
  modified_base (700)..(700): a, c, t, g, unknown or other
  misc_feature (700)..(700): n is a, c, g, or t
tcagcgtgtctctacacgaccggtgctcgatttagtgtgagtagtttgggtttggggtacccgaacaaccacacccctcctaacgaagaagccctagaccacagctccacaccatggactggacctggaggatcctcttcttggtggcagtagcaacaggtgcccactcccaggtgcagctggtacagtctgggtctgaattgaggagccgtggggcgtcagtgagcgttgcctgcagccttnggatacatctcactacttattctgtnaattcgggtaccgacaggcccctggacgaggccttgactacgagtgggatggatacaaccgaccgactacgtacgggaaacccctaccgtaagtccgacccgaacggtcccttacgacgacggggtcgttttacggtccttcttaccgaacgttcggtaacttacccgtcgtttcggtaccgggggtaccgttctttaacgttccgtaggacctaacggtaactaaaccctacccttaactaccgtacggtaacgaccttacgtccgttaccgtttttagttttacggtaacgaggttacgtccgggtttcttacgttacggttaccgtagggttacggtaagtttcgaaccgtttccgggtacggggtacccggtaacgggtaaccccgttggtccccgtacccggttactttcccgtaccggttacccncccggttaccccgaccggaacgggtccccg

SEQ ID NO: 210735 - DNA, 553 bp, Homo sapiens
  misc_feature: GYAE6OF02G86A1.7.78.H01.1.454.CMB.1.raw
  modified_base (498)..(498): a, c, t, g, unknown or other
  misc_feature (498)..(498): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacaccgacactgggaaccccacctatcgcccaggcccttcacagggcggtttgtcttctccatggatacctctgtcgggacggtcttatctgcagataaccaaccttcaacctgaacgacactcgccgttttattttgtacgtagacgtcgtcgtctgtcagtggaattgactacgngggaccgaagggaccctggtccaccgtctcctcagccctccgaccgacggtaccc

SEQ ID NO: 210736 - DNA, 551 bp, Homo sapiens
  misc_feature: GYAE6OF02HDNEH.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatcgcccaggccttcacagggtcgtttgtcttctccatggatacctctggtcgggacgtcttatctgcagataaacccaaccttcaacctgaacgacactgtcctttattttcgacgagagcgtcgtctgtcagtgaattgactacgtgggccacgggtaaccctggtaccaccgtcctcctcaccgcctcccgaccgacggtccc

SEQ ID NO: 210737 - DNA, 544 bp, Homo sapiens
  misc_feature: GYAE6OF02G9HKV.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacgcttatctgcagataacaccttcaacctgacgacactgccgtttattttgacgtagagcgtcgtctcgtcagtggaattgactacgtgggccagggaaccctggtccacgtctccgtcgacgtccctccaccgaaggtccccg

SEQ ID NO: 210738 - DNA, 547 bp, Homo sapiens
  misc_feature: GYAE6OF02F2BNI.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatcgcccaggccttcacagggcggtttgtcttctccatggactacctctgtcgggacggcttatctgcagactaaccaaccttcaacctgacgacactcgtcctttattttgtacgagagtcgtcgtctgtcagtggtaattgactacgtgggccgaggaccctggtccaccgtctcctcacgccctaccaccgacggtcc

SEQ ID NO: 210739 - DNA, 542 bp, Homo sapiens
  misc_feature: GYAE6OF02FM8CI.7.78.H01.1.454.CMB.1.raw
  modified_base (525)..(525): a, c, t, g, unknown or other
  misc_feature (525)..(525): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccacctatcgcccaggccttcacagggtcggtttgtcttctccatggatacctctgtcgggacgcttatctgcagataaccaaccttcaacctgacgacactgtccgttttattttcgtacgagagcgtcgtctgtcagtgattgactacgtgggccagggaccctggtcctaccgtctcctcncgcctccaccgaggccc

SEQ ID NO: 210740 - DNA, 764 bp, Homo sapiens
  misc_feature: GYAE6OF02HXEJA.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctagtaattggaaggacgccggtggggctcgagtgagtcgttgcctgacaacgtccttgtaggactacattcttaccacttactttacttctgtactaagttcgggtccgacgaccggccccgtaggacaacggtccttagacctacgagtgggagtggactaccaacgacccgactaccggtaccgggaaccccctactacgtcgacccgtaacggtcccttacgacggtacggggttccggttttacgttcctttacctaccgtagttacggtacttacccttcggtcgggtaccggggtacggttctttacgtccgtacgacgtaacgtaaccttaaacccttaaccttaccgtaaaccgtcggaaaccgtactaccgttccgtttaaccgttttttagttttacggtaacgtaggacggtccggttccgttcgttcgtacgttaggtaggtaagtttcgaccgttacggtcggggaacccgtaacggggttacccgttgggtacccgtacccgttccgttacccgtacggtacccgtacccctacccgaacccggaaccggtccccg

SEQ ID NO: 210741 - DNA, 553 bp, Homo sapiens
  misc_feature: GYAE6OF02GLPKC.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccacctatcgcccaggcccttcacagggcggtttgtcttctccatggactacctctgtcgggacgtcttatctgcagactaaccaaccttcaacctgacgacactcgtccgtttattttgtacgtagacgtcgtcgtcgtgtctagtgaattgatacgtgggccgagggaaccctggtcctaccgtctcctcacgtcctccaccgacggccc

SEQ ID NO: 210742 - DNA, 541 bp, Homo sapiens
  misc_feature: GYAE6OF02GV0Q1.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacggggcggtttgtcttctccatggatacctctgtcgggacggcttatctgcagataaccaaccttcaacctgacgacactgccgtttattttgtacgagagcgtcgtctgtcagtgattgactactgggccagggaaccctggtccaccgtctcctcacgtcctccaccagggccctacg

SEQ ID NO: 210743 - DNA, 544 bp, Homo sapiens
  misc_feature: GYAE6OF02IX2N6.7.78.H01.1.454.CMB.1.raw
  modified_base (382)..(382): a, c, t, g, unknown or other
  misc_feature (382)..(382): n is a, c, g, or t
  modified_base (417)..(417): a, c, t, g, unknown or other
  misc_feature (417)..(417): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccacctatcgcccaggccttcacgagggcggtttgtcttcnccatggactacctctgtcgggacgcttatctgcanataaccaacctcaacctgacacactgtctttatttgacagagtcgtcgtctgtctagtgtaattcgatacgtgggccgaaggtaaccctggtacctaccgtctcctcacgccctccaccgacgcccg

SEQ ID NO: 210744 - DNA, 571 bp, Homo sapiens
  misc_feature: GYAE6OF02IZWR9.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaaggccttgactacatgggatggatcaacaccgacacgtcgggaaccccactatcgcccaggccttcacgagggtcggttttgtcttctccatggactacctctggtcgggacgtcttatctgcagaactaaccaaccttcaacctgacacactgtcctttattttgacgtagagtcgttcgtcttgtctagtggaattgacttacgtcggggacctaacgggaccctggtccaccggttctccctccgacgtcccctaccgaccggacggtccccg

SEQ ID NO: 210745 - DNA, 553 bp, Homo sapiens
  misc_feature: GYAE6OF02I3O74.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggcccctggacaaggccttgactacatgggatggatcaacaccgacacgtcgggaaccccactatcgcccaggcccttcacgagggtcggtttgtcttctccatggactacctcgtgtcgggacgtcttatctgcagactaaccaccttcaactgacacactgtccttttatttcgacgagtacgcgtcgtctgtcagtgtaattgactcgtgggaccgagggtaccctggtccaccgtctccgtcgacgtcctccgaccgaggtccc

SEQ ID NO: 210746 - DNA, 554 bp, Homo sapiens
  misc_feature: GYAE6OF02GOK79.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacaccgacactgggaaccccactatcgcccaggccttcacagggcggtttgtcttctcatggatacctctgtcgggacgcttatctgcagactaacctaaccttcaacctgacgacactgtccttttatttgtacgtagagtcgtcgtctgtcagtgaattgactacgtgggacctacgggaacctcggtaccaccgtctcccgtcacgtccctccgaccgtacggtaccccg

SEQ ID NO: 210747 - DNA, 814 bp, Homo sapiens
  misc_feature: GYAE6OF02HQEUW.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtgtcagtagcaacaggtgcccactcccaggtgcagctggtacagtctgggtctgaattgaggaagcctggggcgtcagtgagcgttgcctgcaagccttcgtggatacatcttcacttacttattctgtctaattgggtccgacaggcccctggacaaggccttgactacatgggatggatcaacaccgacacgtcgggaaacccccacgttacgtcgacccacggtcccttacgaccgtacggggtcggttttacgtcctttcctacccgtagttcgggtaacttacccgttcgtcggtaccgggggtacgtactttagtcgtcgacgtaaggtaaaccttaaacccgaaccgtttaccgaaaccgttcggaaaccgtaccgtaaccgtttcggttaacccgttttttaacgtttttacggtaaccggtaaacggtacggtttacccgttaccggttaccgttacggtttaccgtaacgggttttaggtaaacgttttacgggtaacccggtttaccgggttccgggggggttaacccgtaaacccggggggttaaacccccgtttcggggtaccccgttaaacccccgggttttcccgttaccccggttaccggtaaacccggttccccccgttaaccccgaaccccggggtaaccgggttaccccccgg

SEQ ID NO: 210748 - DNA, 600 bp, Homo sapiens
  misc_feature: GYAE6OF02JUL1X.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaaggccttgactacatgggatggatcaacaccgacactcgggaaccccacctactcgcccacggccttcgacacgggtcggtttcgtccttcctccgtattcggactacctctggtcgggacgtcttatcgtgactagaactaaccaaccttccaacctgacgacactcgtaccgtttattttcgtaacgtagtacgtcgtcgtctcgtctaggtacgtaatttgaccttacgtcgggtaccgtaacgggtaacctgggtacctaccggttcctaccgtcgacgtcccgtacctaccgacggtccc

SEQ ID NO: 210749 - DNA, 541 bp, Homo sapiens
  misc_feature: GYAE6OF02JC03E.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcgtttgtcttctccatggatacctctgtcgggacgcttatctgcagataaccaccttcaacctgacgacactgccgttttattttgacgagtagtcgtcgtctgtcagtggtaattgactacgtgggccagggaaccctggtccaccgtctcctcgacgcctccgaccaagggccc

SEQ ID NO: 210750 - DNA, 580 bp, Homo sapiens
  misc_feature: GYAE6OF02JKISV.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactactgcccaggccttcacgagggtcgtttgacttctccatcggatacctctgtcgggacgcttatctgcagataaccaaccttcaacctgaccgactactgtccgttttaatttgtacgtagtacgtacgtcgttactgtacagtaggaacttgtactacgttcggggaccctaacgggaacccttgggtacctacccgtacgtcccgtcacgtccctccgaccgaacgggtcccc

SEQ ID NO: 210751 - DNA, 570 bp, Homo sapiens
  misc_feature: GYAE6OF02G8MK6.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggcctttactacatgggatggatcaacaccgacactgggaaccccactatcgcccaggcccttcgaccgggggtcgtttcgtctttcgtccatggatacctctggtcgggacgtcttatctgcagactaacctaaccttcaacctgacgacactgtccgtttattttgtacgagtcgcgtcgtcgtgtcagttgaattgactacgtggggaccagggtaaccctggtacctaccgtctccctcgacgtcctaccaccgacggccctagtcccgg

SEQ ID NO: 210752 - DNA, 679 bp, Homo sapiens
  misc_feature: GYAE6OF02JMDXH.7.78.H01.1.454.CMB.1.raw
  modified_base (377)..(377): a, c, t, g, unknown or other
  misc_feature (377)..(377): n is a, c, g, or t
tcagcgtgtctctacacgaccggtgctcgatttagtgtgagtagtttgggtttggggtaccgaacaaccacacccctcctaacgaagaagaccctagaccacagctccacaccatggactggacctggaggatcctcttcttggtggcagtagcaacaggtgcccactcccaggtgcagctggtacagtctgggtctgaattgaggaagcctggggctcagtgagcgttgcctggcaagccttctggatacattcttcacttacttattctgtcaattgggtccacaggcccctggacaaggccttgactcatgggatggatcaacgccacactcgggaaccccactatcgccaggccttacacgagggtcggtttntcttctaccagtggactacctcgtgtcggggacgtcttatcgtgcgtagataaccctaacgttccaaccgttgaccgtacgacttcggttacccgtttttagttttcgtaaccgagtacggttaccgttcgttaccgttggttaacctagggttacggttaacgtttacgtaaccgtttaccggacgggggtacccggttaaaacgggtccccggtttacgggtccccgtaaacccggtttcgttaccccgttaccggtaccgtaccccggtttaacccccacgggtaccgggttacccccg

SEQ ID NO: 210753 - DNA, 594 bp, Homo sapiens
  misc_feature: GYAE6OF02IEVGT.7.78.H01.1.454.CMB.1.raw
  modified_base (400)..(400): a, c, t, g, unknown or other
  misc_feature (400)..(400): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtcaattgggtccacaggcccctggacaaggccttgactacatgggatggactcaacaccgacacgtacgggaaccccactatcgcccaggcccttcacgagggtcgtttgtcttcgtccaatcggatcctntcgtcgggacgtcttactctgcagactaacctaccttcaacctgacgacactcgtcgtttattttacgacgtagtacgtcgtctctgtctagtgaattgacttacgtcggggaccgaacgggtaacccgttggtaccgtacccgtaccgttcccgtacgaccggtacccttacccgaacccgacgggtaccccg

SEQ ID NO: 210754 - DNA, 538 bp, Homo sapiens
  misc_feature: GYAE6OF02FQ3KZ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcgtttgtcttctccatggatacctctgtcgggacgcttatctgcagataaccaaccttcaacctgacgacactgccgttttattttgtacgtagagtcgtcgtctgtcagtggaattgactacgtgggccagggaaccctggtcaccgtctcctcacgcctccaccgaggccc

SEQ ID NO: 210755 - DNA, 572 bp, Homo sapiens
  misc_feature: GYAE6OF02GSK1G.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaaggccttgactacatgggatggatcaacaccgacactcgggaaccccacctatcgcccaggccttcacgacgggtcggtttgtcttcctccatggactacctctggtcgggacgtcttatctgcagactaaccaaccttcacctgacgacactcgtccgttttattttcgacgtagtagtccgtcgtcgtgtccgtagttacggaattcgactacgtcgggccgtacgggacccttggtcctaccgtctccgtcacgtccctaccaccgacggtccc

SEQ ID NO: 210756 - DNA, 545 bp, Homo sapiens
  misc_feature: GYAE6OF02FSKU0.7.78.H01.1.454.CMB.1.raw
  modified_base (347)..(347): a, c, t, g, unknown or other
  misc_feature (347)..(347): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagtatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactangcccaggccttcacagggcggtttgtcttctccatggatacctctgtcgggacggcttatctgcagactaaccaaccttcaacctgacgacactgtccgttttattttgtacgagtagcgtcgtctgtcagtgtaattgactacgtgggccgagggaccctggtcaccgtctcctcgacgccctccaccgacggtccc

SEQ ID NO: 210757 - DNA, 543 bp, Homo sapiens
  misc_feature: GYAE6OF02GCL41.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccactatcgcccaggtccttcacagggtcgtttgtcttctccatggatacctctgtcgggacgtcttatctgcagactaaccaaccttcaacctgacgacactcgtccgtttattttgacgtagagtcgtcgtctgtcagtgattgactcgtgggacagggaccctggtcctaccgtctcctcacgcctccaccgaggtccc

SEQ ID NO: 210758 - DNA, 571 bp, Homo sapiens
  misc_feature: GYAE6OF02I51TX.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacacggcccctggacaaggccttgactacagtgggatggatcaacaccgacactacgggaaccccactatcgcccaggccttcgacgagggtcgtttgtcttctcatggactacctcgtggtcgggacgtcttatctgctagactaaccaacttcaacctgactacactcgtaccgttttattttgaacgtagtacgcgttcgtctgtctaggtgtaattgacttacgtgggaccgtacgggtaccctggtcctaccgtctccgtcgacgtccctccgacccgtaggcccg

SEQ ID NO: 210759 - DNA, 574 bp, Homo sapiens
  misc_feature: GYAE6OF02F0ZQM.7.78.H01.1.454.CMB.1.raw
  modified_base (509)..(509): a, c, t, g, unknown or other
  misc_feature (509)..(509): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaacggccttgactacatgggatggatcaacaccgacactcgggaaccccacctatcgcccaggccttcacagggcggtttgtcttctccatggactacctcgtgtcggacgtcttatctgcagactaacctaaccttcaacctgacgactacgtcgtccgttttattttcggtacgtagacgtcgttcgtctgtctagtggtaattcgactcgngggccgtaacgggaccctggtacctaccgtctaccgtcgacgccctaccgaccgtacggtacccc

SEQ ID NO: 210760 - DNA, 567 bp, Homo sapiens
  misc_feature: GYAE6OF02FJOT6.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacacgtcgggaaccccacctatcgcccaggccttcacagggtcggtttgtcttctccatcggattaccctctggtcgggacggtcttatctgcagactaaccaaccttcaacctgacgacactgccgttttattttcgtacgagagtcgtcgtctgtcagtgtaattgactacgtggggaccacgggaccctgggtaccaccgttctacctcgacgtccctaccgaccgaacgggtccc

SEQ ID NO: 210761 - DNA, 550 bp, Homo sapiens
  misc_feature: GYAE6OF02GV6ZT.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatggatggatcaacaccgacactgggaaccccacctatcgcccaggccttcacaggggtcggtttgtcttctccatggatacctctgtcgggacgtcttatctgcagactaacctaacttacacctgacgactactgtccgtttattttgtacgagagtcgtctctgtcagtgaattgactacgtgggccagggtaaccctggtaccaccgttctcctcacgtcctacccacgacggtccc

SEQ ID NO: 210762 - DNA, 602 bp, Homo sapiens
  misc_feature: GYAE6OF02IQCVK.7.78.H01.1.454.CMB.1.raw
  modified_base (548)..(548): a, c, t, g, unknown or other
  misc_feature (548)..(548): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatccttcactacttattctgtcaattggtccacaggcccctggacaaggccttgactacatgggatggatcaacaccgacacctgggaacccccactatcgaccccaggcccttcacgacggggtcggttttcgtctttcctccagtggacttacccgttctcgggttaccggggtacgggtcctttaatccgtgaccagtaactaacccgaaaccttccaacctgaaccgacacttagttccgtttttattttacgacgtacgtagtcgtcgttctgtctaggtgtaattgactacgngggacgacgggtacctgggtctaccgtctcctcgacgtccaccaccgaggcccc

SEQ ID NO: 210763 - DNA, 602 bp, Homo sapiens
  misc_feature: GYAE6OF02JY25F.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtctaaattgggtaccgacaggcccctggacaaggccttgactacatgggatggatcaacaccgacacgtacgggaaccccactatcgaccacggccttcacgagggtcgtttgtcttctcagtggactacctctggtcggacggtcttatctcgacagtaactaacctactacaactgacgtacactcgtcttttatttggactagtacgtcgtcgtctgtcaggtcgtaattcgtacttacggtcgggtaccgaacggggtaaccccttggtacccgtaccgttaccgttcccgtcgaaccgtccctacccggtacccgaaccggggtacccc

SEQ ID NO: 210764 - DNA, 645 bp, Homo sapiens
  misc_feature: GYAE6OF02H0U5X.7.78.H01.1.454.CMB.1.raw
  modified_base (241)..(241): a, c, t, g, unknown or other
  misc_feature (241)..(241): n is a, c, g, or t
  modified_base (624)..(624): a, c, t, g, unknown or other
  misc_feature (624)..(624): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgctgcaagccttntggatacatcttcacttacttattctgtcaagttgggtccgacacggtcccctggacaaggtcccttggaccttacatgggatggatacaacaccgacacgtacgggaaccccactagtcgcccgacggcccttacgacgaggggtcggttttgtcctttacctcctaagttcggtaacttacccttcgtcgggttaccggggtacggtcctttagtccgttgactaaggtaacttaaaccctaaccttcaaaccgttggaaccgaactacgtcgttacgtttttagttttacgtaacgtagtacgtccgttcgttcgtcgttcgaggttagaatttcgacgtacgtcgggaccgaacggtaccctcgtcctaccgtctctcncgtaccctcaccgtacggccc

SEQ ID NO: 210765 - DNA, 576 bp, Homo sapiens
  misc_feature: GYAE6OF02FYYEX.7.78.H01.1.454.CMB.1.raw
  modified_base (506)..(506): a, c, t, g, unknown or other
  misc_feature (506)..(506): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccactatcgcccaggcccttcacgagggtcggtttgtcttctccatggatacctctgtcgggacgtcttatctgcagactaaccacttccacctgacgaccactcgtcgttttattttggtacgagtacgtcgtcgttctgttcaggttgaacgttgacttacgnggggacctaggggaaccctcgggtcctaaccgtctcccgtactaccgcccgtaccaccgtacggtacccg

SEQ ID NO: 210766 - DNA, 541 bp, Homo sapiens
  misc_feature: GYAE6OF02G85F2.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacaccgacactgggaaccccacctatgcccaggccttcacagggcgtttgcttctcatggatctctgtcggacgcttatctgcagataaccaaccttcaacctgacacactcgtccgtttattttggacgagtagcgtcgtctgtctagtggaattgactacgtgggccagggaaccctggtccaccgttcctccgtcacgtccctaccaccgacggccc

SEQ ID NO: 210767 - DNA, 563 bp, Homo sapiens
  misc_feature: GYAE6OF02ITEF6.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaaggccttgactacatgggatggatcaacaccgacactgggaaccccactatcgccaggccttcacagggcgtttgtcttctccatggatacctcgtgtcgggacggtcttatctgcagactaacctaaccttcaacctgacgacacgtgtccgtttattttcgtacgagtagtcgtcgtctgtctaggtgaattgacttacgtgggcctaaggggaccccttggtcctaccgtctacccgtcaccgtcctcccgaccgacgggtcccc

SEQ ID NO: 210768 - DNA, 579 bp, Homo sapiens
  misc_feature: GYAE6OF02GUP0K.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacacggcccctggacaaggccttgactacatgggatggatcaacaccgacacgtggaaccccactatcgccaggtcctacacgagggtcggtttcgtcttctccatcggatacctcgtcgtcgggacgtcttatcgtgcagaactaaccaacttcaacctgacgacactcgtccgttttatttcgtacgtacgtacgtccgttcgtcgtgtactggtagtaattcggactacggtcggggccaacgggtaccctgggtccaccgtctcctcgccgtccctaccgtaccgaggtaccccg

SEQ ID NO: 210769 - DNA, 569 bp, Homo sapiens
  misc_feature: GYAE6OF02F2U4X.7.78.H01.1.454.CMB.1.raw
  modified_base (393)..(393): a, c, t, g, unknown or other
  misc_feature (393)..(393): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatcgcccaggccttcacgagggtcgtttgtcttctccatggatacctntgtcgggacgtcttatctgcagactaacccaaccttccaacctgaccgacacgtgtccgttttattttgaacgtagaggtcgtcgtctgtcgagtaggtaattcgactacgtggggccaggggtaaccctggtcctaccgttctccctcgacgtccctaccgaccgtacggtcccc

SEQ ID NO: 210770 - DNA, 547 bp, Homo sapiens
  misc_feature: GYAE6OF02GPA2G.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacaccgacactgggaaccccactatgcccaggccttcacagggcggtttgtcttctccatggatacctctgtcgggacggcttatctgcagataaccaaccttcaacctgacgacactgccgtttattttgtacgtagagtcgtcgtctgtcagtgaattgactacgtgggccagggaaccctggtacctaccggtcctcctcacgtccctccaccgacggtcccc

SEQ ID NO: 210771 - DNA, 613 bp, Homo sapiens
  misc_feature: GYAE6OF02I3AIO.7.78.H01.1.454.CMB.1.raw
  modified_base (283)..(283): a, c, t, g, unknown or other
  misc_feature (283)..(283): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccganaggcccctggacaaggccttgactacatggatggatcaacaccgacactgggaaccccactactgcccaggccttcacagggcgtttgtcttctcatgatacctctgtcgggacgtcttatctgcagactaaccaacttcaacctgacactactgtaccgtttttatttcgacgtagtacgccgtttcgtcttacgttctaaggttcggtaaattcggtaaccttcgtcgggggaccctaacggggtaaccccttgggtaaccctaacccggtttccgtaccccgttcgaacccgggtccccttacccgaacccggtaaggggtaccccc

SEQ ID NO: 210772 - DNA, 653 bp, Homo sapiens
  misc_feature: GYAE6OF02IEDDA.7.78.H01.1.454.CMB.1.raw
  modified_base (322)..(322): a, c, t, g, unknown or other
  misc_feature (322)..(322): n is a, c, g, or t
  modified_base (342)..(342): a, c, t, g, unknown or other
  misc_feature (342)..(342): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagcttctggatacatcttcactacttattctgttcaatttgggccacacggcccctggacaaggccttgactacatggatgatcaacncgacactggaaccccactancgccaggccttcacgagggcggtttgtctctaccatcggataccctcgtcggtacggggacggtacttactccgtggccaaggtaaacttaaacccgtaaaccttttccggaaaacccttggaacccggtaactaccgtaccgtttacccgtttttagtttttacgaacggtaacggtaagtcccggtttcgtccgttacgttacgacggtaggtaaacgttacgacgttacgtcggggtaccgaacgggaaccctttcgggacctaccgttcgtccctaccgacgtaccccgtcaacccggagggtcccc

SEQ ID NO: 210773 - DNA, 555 bp, Homo sapiens
  misc_feature: GYAE6OF02IVCBP.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatcgcccaggcccttcaccagggcggtttgtcttctccatcggatacctctcgtcgggacggcttatctgcagactaaccaaccttcaacctgaccgacactgtcctttatttcgtacgagagtcgtcgtctgtcgagtggaattgactacgtgggccgagggaccctggtcctaccgtctcctcgacgtcctaccgaccgaggtcccc

SEQ ID NO: 210774 - DNA, 548 bp, Homo sapiens
  misc_feature: GYAE6OF02HW9CW.7.78.H01.1.454.CMB.1.raw
  modified_base (329)..(329): a, c, t, g, unknown or other
  misc_feature (329)..(329): n is a, c, g, or t
  modified_base (435)..(435): a, c, t, g, unknown or other
  misc_feature (435)..(435): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagtgttgcctgcaagccttctggatacatcttcactacttattctgtcaattgggtccgacaggcccctggacaaggccttgactacatgggatggatcaacaccganactgggaaccccactatcgccaggccttcacagggcgtttgcttctcatcggatacctgtggtcgggacgtcttatctgcagactaaccaaccttcaactgacacnctcgtctttatttcgacgagagtcgtcgtctgtcaggtgaattgactacgtgggccaacgggtaccctgggtcctaccgtctcctcgacgtccctacgacccgaagggtcccc

SEQ ID NO: 210775 - DNA, 612 bp, Homo sapiens
  misc_feature: GYAE6OF02JXIM9.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctagtctaaattgggtccgacacggcccctggacaaggccttgactacatggatggatcaacaccgacactgggaaccccactatcgcccaggccttcgaccagggtacggtttgactttctaccagtggataccctcgtagtccggggacggtctttacgtcgtcgtcaggaactaaacctaaccgttacaaccttagacgtacaacttcgtacctttacgtttttggaacgtacggtagcgttcgtcgtacgttcgtaacggtcgtaattacgtactacgtcggggaccaggggtaaccctcgggtactaccgtactccgtcacgcctaccgtaccgaggtcccg

SEQ ID NO: 210776 - DNA, 563 bp, Homo sapiens
  misc_feature: GYAE6OF02H8RZ1.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtcaattgggtccgacaggcccctggacaaggccttgactacatgggatggatcaacaccgacactcgggaaccccacctatcgcccacggccttcacagggtcggtttgtcttctccatggatacctctcggtcgggacggcttatctgcagtataacctaaccttcaacctgacacactcgtcctttattttcgtacgtagagcgtcgtctgtcagtgaattgactacgtgggccgacgggtaaccctggtaccctacgtcctccgtcacggccctccgacccgaggtccccg

SEQ ID NO: 210777 - DNA, 665 bp, Homo sapiens
  misc_feature: GYAE6OF02HUSJF.7.78.H01.1.454.CMB.1.raw
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
  modified_base (369)..(369): a, c, t, g, unknown or other
  misc_feature (369)..(369): n is a, c, g, or t
tcagcgtgtctctacacgaccggtgctcgatttagtgtgagtagtttgggtttggggacccgaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcaggtgagcgttgcctgcaagccttcgtggatacatcttcacttacttattctgtacaattgggtcgacaggcccctggacaaggccttgactacatgggatggatcgaacaccganactgggaaaccccactagngccccaagcccttnacgaggggcggttttgcttcgtcccaatgggtactactctggtcggggtacgctttacgtacctgtacgagtaactaaacctaaaccttcaaaccgtagaaccgaacgacttaggtcccgtttttaatttttcgaaaccgtagtacgtaccgggttcgttacgtccgttagtaggtaagtaaagtttcgaaacttaccggtcgggggtacgaaccggggtaacccgtacgggtaccgtaacccggtccttcccgtaccgtacggttacccccacctaacccggaaccggtaccccg

SEQ ID NO: 210778 - DNA, 559 bp, Homo sapiens
  misc_feature: GYAE6OF02GBANX.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatcgcccaggccttcacgagggcggtttgcttctccatggactacctctgtccgggacgtcttatctgcagactaacctaccttcaacctgacgactactgtaccgtttagtttttcgtacgtagagtcgtcgtctgttcagtgaagttgactacgtgggccgtacgggaccctggtcaccgtcctccgtcacgccctaccacccgaggaccc

SEQ ID NO: 210779 - DNA, 560 bp, Homo sapiens
  misc_feature: GYAE6OF02JMPED.7.78.H01.1.454.CMB.1.raw
  modified_base (216)..(216): a, c, t, g, unknown or other
  misc_feature (216)..(216): n is a, c, g, or t
  modified_base (242)..(242): a, c, t, g, unknown or other
  misc_feature (242)..(242): n is a, c, g, or t
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
  modified_base (413)..(413): a, c, t, g, unknown or other
  misc_feature (413)..(413): n is a, c, g, or t
  modified_base (432)..(432): a, c, t, g, unknown or other
  misc_feature (432)..(432): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccatcccaggtgcagctggtacagtctgggtctgaattgaggaagcctggggctnagtgagcgttgcctgcaagcctttcnggatacatcttcactacttatctgtcaaattgggtccacagtcccctggacaaggccttggacctanatgggatggatcaancccgacatgggaaccccactatcgcccaaggcccttcacaggggtcgtttggtcttctcgattgggaatccgtctggcggacggtctanctgcagactactaaccttnaacctgaacgacactcgtccgttttatttcgtacgagtagcgtacgtctgtccagtcggaattgactacgtgggaccagggtaaccctggtcctacggtctccgtcacgcctaccgtacgagggtccc

SEQ ID NO: 210780 - DNA, 672 bp, Homo sapiens
  misc_feature: GYAE6OF02IYW3K.7.78.H01.1.454.CMB.1.raw
  modified_base (224)..(224): a, c, t, g, unknown or other
  misc_feature (224)..(224): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctgggcgtcagtgagngttgcctgcaagccttctggatacatcttcactacttattctgtcaattggtccgacaggcccctggacaaggccttgactacgagtggatggatacaacaccgacacgtcgggaaaccccacctaagtcgacccaaggccctttacgaacgacggggtcggttttggtcctttacgtccctaagtcggtacttacctcgtacggtaccggggacggtctttactcgttcgacgtacgaacttaaacccgtaaccctttaccgaacctcgtaaaccgaacctaccttacggttacccgtttatttttacgacgtaaggtaacgtcggtttacgtcgttcgttctacgtaggtaattacgtacgttagtcggggaccgtaacgggtaacccttcggtacctaccgtaccgtcccttacgaccgttcctacccgaccgtacggtaccccg

SEQ ID NO: 210781 - DNA, 541 bp, Homo sapiens
  misc_feature: GYAE6OF02GX0NA.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcggtttgtcttctccatggatacctctggtcgggacggtcttatctgcagataaccacttcaacctgacacactgaccgtttatttgtacgagagcgtcgtctgtcagtgaattgactacgtgggacctagggaccctggtccaccgtctcctcacgccctccaccgacggtcccg

SEQ ID NO: 210782 - DNA, 544 bp, Homo sapiens
  misc_feature: GYAE6OF02FUJQT.7.78.H01.1.454.CMB.1.raw
  modified_base (323)..(323): a, c, t, g, unknown or other
  misc_feature (323)..(323): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccacaggcccctggacaaggccttgactacatgggatggatcaacnccgacactgggaaccccactatgcccaggccttcacagggcgtttgcttctccatggatacctctggtcgggacgtcttatctgcagactaaccaaccttcaacctgacgacactgccgtttattttgtacgagagtcgtcgtctgtcagtgaattgactacgtgggccacgggaaccctggtccaccgttctcctcgacgcctcccaccgacgggtcccc

SEQ ID NO: 210783 - DNA, 599 bp, Homo sapiens
  misc_feature: GYAE6OF02JTNNI.7.78.H01.1.454.CMB.1.raw
  modified_base (482)..(482): a, c, t, g, unknown or other
  misc_feature (482)..(482): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatggatggatcaacaccgacactgggaaccccactatcgccacggccttacacgagggcggttttgtccttctccatcggactacctcgtcgtcggggacgtcttactcgtgcagactaaccacttcaacctgaccactactgtccgttttatttcgtacgtagacgtcgttcncgttgtcagttacggaattcgacgtacgtcggggacctaacgggtaacccttgggtacccgtaccgttccgttaccgttccgaaccgtccctttacccgaccggtaacgggtccccg

SEQ ID NO: 210784 - DNA, 555 bp, Homo sapiens
  misc_feature: GYAE6OF02FP69G.7.78.H01.1.454.CMB.1.raw
  modified_base (486)..(486): a, c, t, g, unknown or other
  misc_feature (486)..(486): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacagtgggatggatcaacaccgacactcgggaaccccactatcgcccaggccttcacgagggtcggtttcgtcttctccagtggactacctcgtgtcgggacgtcttatctgcagactaaccaaccttcaacctgacgacactgtccgtttattttgtacgtagtagcgtcgtctgtcngtgattgactacgtgggccgtaggaccctggtccaccgtcgtcctctaccgcctccaccgacggtcccg

SEQ ID NO: 210785 - DNA, 579 bp, Homo sapiens
  misc_feature: GYAE6OF02JVBP1.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttctggatacatcttcacttacttattctgtcaattgggtccgacgacgcccctggactaaggccttgactaccagtcgggatggatcaacaccgacacgtcgggaaccccaccgtatcgccaggccttcacgagggcgtttgtcttctcgatcggacttacctctcggtcgggacggtcttactcgtgctagactaaccaaccttcacgtacgacgacacgttcgtcgttttattttcgtacgtagtagtcgtcgttctgtctagtggtaattgacttcgtgggaccgagggtaccctggtccaccgtcttcctacgacgtcctaccgaccgacggtccc

SEQ ID NO: 210786 - DNA, 673 bp, Homo sapiens
  misc_feature: GYAE6OF02JK879.7.78.H01.1.454.CMB.1.raw
  modified_base (324)..(324): a, c, t, g, unknown or other
  misc_feature (324)..(324): n is a, c, g, or t
  modified_base (345)..(345): a, c, t, g, unknown or other
  misc_feature (345)..(345): n is a, c, g, or t
  modified_base (367)..(367): a, c, t, g, unknown or other
  misc_feature (367)..(367): n is a, c, g, or t
  modified_base (386)..(386): a, c, t, g, unknown or other
  misc_feature (386)..(386): n is a, c, g, or t
tcagcgtgtctctacacgaccggtgctcgatttagtgtgagtagtttgggtttggggtacccgaacaaccacacccctcctaacgaagaagaccctacgaccacagctccacaccatggactggacctggaggatcctcttcttggtggcagtagcaacaggtgcccactcccaggtgcagctggtacagtctgggtctgaattggaggagccgtggggcgtcgagtgagcgttgcctgcaagtcctgtggatcatcttcacttacttattctgtctaagttcggggtccacgtacggcccctggacaagggtcccttgactanagtggatggatcaacaccganaccgtacggaaccccacgtacncgccacggtccttcgacgngggtacgtttgtcttctccagtcgactacgtcgtggtaccggggactcttagtccttaggctaagctaaaccgtaaccttccaaccgtgaaccgtaccctacgtcgtttaccgttttagttttcggtaacgaggttaccgtccggtttaccgttctacggttacgtaacgggtttagaaagtttccgaaacggtttcgaccgggggtaccgtaacggggtaccccgttggtcccgtaaccgtcccgtttacccgcggtaccttccccgacccgtacgaccgggtccc

SEQ ID NO: 210787 - DNA, 611 bp, Homo sapiens
  misc_feature: GYAE6OF02FQRN6.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccactatcgcccaggtccttcacgaggggtcggttttcgtcttctccagtcggactacctctgtcgggacggtcttagtctgcagactaacctaaccttcaacctcgacgactacgtcgtaccgttttattttcgtaacgtagtagccgttcgtctgttacgtagtacggtaagttgacgttaccgtcggggaccgtaacggggaacccttgggtacctacccggttcccttccgtccgtacgcccgtaccccaccgaaccggggtcccc

SEQ ID NO: 210788 - DNA, 562 bp, Homo sapiens
  misc_feature: GYAE6OF02GOSQW.7.78.H01.1.454.CMB.1.raw
  modified_base (243)..(243): a, c, t, g, unknown or other
  misc_feature (243)..(243): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacatcttcactacttattctgtcaattgggtccgacaggcccctggacaaggccttgactacatgggatggatcaacaccgacactgggaacccccactactgcccaggcccttcacagggcggtttgtcttctccatggatacctctgtcgggacggcttatctgcagactaaccaaccttcaacctgacgacactgtccgtttattttgtacgtagagtcgtcgttctgtcagtggaattgactagtggggtaccagggaaccctggtaccacccgttctcccgtcgacgccctaccacccgacgggtacccc

SEQ ID NO: 210789 - DNA, 558 bp, Homo sapiens
  misc_feature: GYAE6OF02F17DR.7.78.H01.1.454.CMB.1.raw
  modified_base (384)..(384): a, c, t, g, unknown or other
  misc_feature (384)..(384): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacacgtcgggaaccccactatcgcccaggcccttcacgagggcggtttgtctttcnccatggactacctcgtgtcgggacggtcttatctgcagataaccaaccttcaacctgaacacactgtccgtttattttgtacgagagtcgtcgtctgtcagtgattgacttacgcgggaccgtagggaaccctggtccaccgtcctcctcaccgtccctcccaccgacggtccc

SEQ ID NO: 210790 - DNA, 606 bp, Homo sapiens
  misc_feature: GYAE6OF02ICM5N.7.78.H01.1.454.CMB.1.raw
  modified_base (583)..(583): a, c, t, g, unknown or other
  misc_feature (583)..(583): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtcgacaggcccctggacaaggccttgactacatgggatggatcaacaccgacacgtcgggaacccccactactcgacccgacggcccttcgaccgtaggggtccgtttagttccttctcccaatcgggtacttaccctcgttcggtccgggggtacggtctttactccttggaccaagtaactaaccctaaccttaccaacctcgaccgaccactcgttccttttattttcgtacgtacgagtcgtcgtctgtcaggtgaattgactacgtcgggccacgggaaccctggtaccgtacgtcctccncgacgccctccaccgacggcccg

SEQ ID NO: 210791 - DNA, 611 bp, Homo sapiens
  misc_feature: GYAE6OF02JQEDP.7.78.H01.1.454.CMB.1.raw
  modified_base (241)..(241): a, c, t, g, unknown or other
  misc_feature (241)..(241): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggctcagtgagcgttgcctgcaagccttcnggatacatcttcacttacttattctgtcaattgggtccgacaggcccctggacaaaggccttgactacagtgggatggatcgaaacaccgaacaccgtgggaaccccacctatcgcccaagggcccttacacgacggggtcggttttcgactttcctccattcggactaccgtctggtcgggacgtctactctgctagactaacctaacctcaacctcgacgaccacgtacgtcgtttattttacgtacgagtagcgttacgtctcgtactaggtgtaacttgtaacctacgtacgggccgtaacgggtaaccgtcgggtaccacccgttaccgtcctaccgacgtccctaccgaccgtaacggtccccg

SEQ ID NO: 210792 - DNA, 581 bp, Homo sapiens
  misc_feature: GYAE6OF02F5AA3.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggcccctggacaacggccttgactacagtgggatggatcaaacaccgacacgtcgggaaccccactatcgcccaggtccttcacgagggtcggtttgtcttctccatcggactacctcgtggtcggggacgtcttatctgcagactaaccaaccttcaacctgacgactactcgtcgttttatttcgtacgagtacgcgttcgtctgtcagtgtaattcgactagtcgggaccgaacgggtaaccctggtcctaccgttccttccgtcgacgtccctacccgaccgacgggtcccc

SEQ ID NO: 210793 - DNA, 574 bp, Homo sapiens
  misc_feature: GYAE6OF02HAFI3.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgtccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacacgtcgggaaccccactatcgccaggccttcacgacgggtcgtttgtcttctccagttcggacttacctcgtcggtcgggtacggtctttatctgctagactaaccaaccttacaaccgtgaccgactacgtcgttaccgttttattttcgaacgagtagtccgtctctgtctaggtgaacttgactacgtgggccgaagggtacctggtacaccgtctcctcacgtcctaccgacacggtccc

SEQ ID NO: 210794 - DNA, 547 bp, Homo sapiens
  misc_feature: GYAE6OF02F9ZHQ.7.78.H01.1.454.CMB.1.raw
  modified_base (497)..(497): a, c, t, g, unknown or other
  misc_feature (497)..(497): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagtatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatcgcccaggccttcacgaggggtcggtttgtctttctccagtggactacctctgtcggggacgtcttatctgcagataaccaaccttcaacctgacgacactcgtccgttttattttcgacgagagcgtcgtctgtcagtgattgactcgngggccagggacctggtctaccgtctcctcacgccctccaccgacggtccc

SEQ ID NO: 210795 - DNA, 562 bp, Homo sapiens
  misc_feature: GYAE6OF02FJDI7.7.78.H01.1.454.CMB.1.raw
  modified_base (243)..(243): a, c, t, g, unknown or other
  misc_feature (243)..(243): n is a, c, g, or t
  modified_base (417)..(417): a, c, t, g, unknown or other
  misc_feature (417)..(417): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacatcttcactacttattctgtcaattgggccacacggcccctggaccaaggccttgactacatggatggatcaacaccgacactcgggaaccccactatcgcccaggccttcgacgacgggtcggtttgtcttctccagtggactacctctgtccgggacgtcttatcngcagactaacccaccttcaacctgaccacactgtccgttttattttgacgtagacgtcgttcgtctgtcagttggaattgactagcgggccaacgggaccctgggtccaccggttctcctcacgccctaccgaccgacggtcccc

SEQ ID NO: 210796 - DNA, 614 bp, Homo sapiens
  misc_feature: GYAE6OF02HWQE6.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacaccgacactgggaaccccactatcgcccaggccttcacgaggtcgtttgtcttctccatggacttacctcgtgtcgggacgtcttatctgcagtactaaccaccttcaacttgaccgactactcgttaccgttttattttcgtaacgtacgtagtcgtccgtacttcgtactaggtagaacgtttcgaacgttacggtcggggtacccaacggggtaacccttggggtacccacccggttccgttacccgtaccgacggtcccccttaccgaaccccgtaggggtaccccc

SEQ ID NO: 210797 - DNA, 640 bp, Homo sapiens
  misc_feature: GYAE6OF02G55C6.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggcccctggacaaggtccttgactacagtgggatggatcaacaccgacacgtcgggaaccccactactcgcccaggccttcacgagggtcgtttgtcttctccagtcggacttaccctcgtcggtcggggacggtctttagtcgtggactaaggtaactaaacccgtaaacctttccaaacccgttaggaaccgtacctaccgttcgttaccgtttttaatttttcggacgtagtacgtcgttcgtcgttgttcgtagttggtaattcgacttacggtcggggtaccgtaacggggtacccttgggtacctaccggttccgtcctcgaccgtccctacccgaccgtaccggtccc

SEQ ID NO: 210798 - DNA, 594 bp, Homo sapiens
  misc_feature: GYAE6OF02GYUZ6.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatcgccagccttcgacggggtcgtttgtcttctcctagtggtactacctctcggtacgggtacgtcttatctgcagactaaccaacttcaacctgacacactcgtctttattttgacgagtacgtcgtcgtcgttgtactaggtaggtaattgacttacggtcggggaccacggggtaaccctgggtaccgtacccgttctacccgtccgacggtccccttaccgaacccgtacgggacccctaaccgg

SEQ ID NO: 210799 - DNA, 580 bp, Homo sapiens
  misc_feature: GYAE6OF02I6DK3.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccgacacggcccctggacaaggccttagactacatgggatggatcaacacgacacgtcggaaccccactatcgccaggccttacacgagggcgtttgcttctccagtacggactacctcgtgtcgggacgtcttatctgcagtactaacctaacttcaactgacactactcgtctttattcgacgagacgtcgtcttctgtcgtagtggtaattcgacttacggcgggccgtaacgggtacccttgggtaccctacccgttctaccgttcgacgtcccctaccgtaaccggtaccgggtcccc

SEQ ID NO: 210800 - DNA, 653 bp, Homo sapiens
  misc_feature: GYAE6OF02HA0BU.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtcaattcgggtccgacaggcccctggacaaggccttgactacgatcgggatggatcgaacaccgtacactcgggaaccccacgtatcgcccaacggcccttcgacacggggtccggtttcgtccgtttctacccgatcggaattacccgtctcggtcgggacggtcttactcgtcgacgagtactaacccaaccttaccaaacctgaaccgactaccgtcgtaccgttttattttgtacgtagtacgtcgtacgttcgtgttccgtaagtggtaaattcgaacgttacgtcgggtaccgtaacgggtaacccgttagggtcccgtaacccgttccgttacccgtcgtaacccgtcccgtacccggacccgaaccgggtaccccg

SEQ ID NO: 210801 - DNA, 587 bp, Homo sapiens
  misc_feature: GYAE6OF02GEBUU.7.78.H01.1.454.CMB.1.raw
  modified_base (422)..(422): a, c, t, g, unknown or other
  misc_feature (422)..(422): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggccccctggacaaggtccttgactacagtgggatggatacaacaccgacacgtacgggaaccccactatcgcccaggtccttcacgagggtcgtttgtcttctcatcggactacctctcggtcgggacgtcttatcngcagtactaaccaaccttacaacctgacgactactacgtccttttagtttagtacgagtacgtcgtcgttctgtcgtagtgtaagttcgacttacggcgggtaccgacgggtaacccgttggtcctaccgtcctcctcgaccgtccctaccgaccgacggtaccc

SEQ ID NO: 210802 - DNA, 547 bp, Homo sapiens
  misc_feature: GYAE6OF02HWSWS.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacacccgacacgtcgggaaccccactatcgcccaggcccttcacgagggcgtttgtcttctccatggactacctctcgtcgggacgtcttatctgcagactaaccaccttcactgacgacactgtcgtttattttgtacgagagtcgtcgtctgtctagtgattgactagtcgggcgacgggtaccctggtcctaccgtctcctcacgtcctccgacgacggtccc

SEQ ID NO: 210803 - DNA, 633 bp, Homo sapiens
  misc_feature: GYAE6OF02I9DYR.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccactatcgcccaggccttcacagggcggtttgtcttctccagtcgatacctctcggtcgggacggtcttatctgctagaactaacctaaccttcaactgaccgacactcgtacgttttattttcggacgtagtacgtcgtcgtcgtcgtactaggttagtaaacgtttgaaccgttacggtcgggggaccctaacggggggtaaccccttggggtaacctaccccggttcgttacccccgtacgtaccggtccccctttaccccggaacccggtaaccggggtaccccccg

SEQ ID NO: 210804 - DNA, 545 bp, Homo sapiens
  misc_feature: GYAE6OF02HH8D0.7.78.H01.1.454.CMB.1.raw
  modified_base (409)..(409): a, c, t, g, unknown or other
  misc_feature (409)..(409): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatggggatggatcaacaccgacactcgggaaccccacctatgcccaggccttcacaggcggtttgtcttctcatggatacctctgtcgggacgtcttatntgcagtataaccaaccttacacctgatcgacactgtcctttattttgacgtagacgtcgtcgtctgtcgagtgtaattgactacgtgggccacgggtacctggtccgacgtctcctcacgcctccgactaaccggg

SEQ ID NO: 210805 - DNA, 600 bp, Homo sapiens
  misc_feature: GYAE6OF02ILVHD.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatggggatggatcaacaccgacactcgggaaccccactatcgcccaggccttcacagggcgtttgtcttctccagtggactacctcgtgtcgggacggtcttatctgcagactaaccaccttacaacctgaacgtacacgtacgttccgttttattttacgtacgtagagtccgttcgtccttggtcctaaggtggtaactttgacctacggtacggggcccgtaagggtaacccctgggtccaacccggttcctacccgttcaccgtccctacacccgtacgggtacccc

SEQ ID NO: 210806 - DNA, 694 bp, Homo sapiens
  misc_feature: GYAE6OF02IPMUA.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacagtgggatggatcaacaccgacactgggaaaccccactatcgacccaggcccttacacgagggtccggttttacgtctttcctccaagttcggacttacccgttcgttcggtaccgggggtaccggtctttaatccgttggacgtaaggtaacttaaaacccgtaaacccttttaccaaaacccgttcggaaaccgtaaccgaccttacggttacccgtttttaagttttttacgtaacgggtaggtaacgtaccggttcgttacgttggtacctaggttaggtaattacgtaccgttacggtacggggaccgtaacggggtaccccttagggtaccctaccggttccttcccgtcaccgtccctaccgaccgtaacggtaccccg

SEQ ID NO: 210807 - DNA, 564 bp, Homo sapiens
  misc_feature: GYAE6OF02FSL2R.7.78.H01.1.454.CMB.1.raw
  modified_base (404)..(404): a, c, t, g, unknown or other
  misc_feature (404)..(404): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacaccgacactgggaaccccactatgcccaggccttcgacggggcgtttgcttctccatgatacctctgtcgggacgtcttanctgcagactaaccaaccttcaacctgacacacttcgccttttattttcgacgagtacgcgtcgtctgtcagttggaattgacttacgtcggggcctaagggtaaccctggtaccacccggttctccgcacgccctaccgaccgtaacgggcccctaacgg

SEQ ID NO: 210808 - DNA, 564 bp, Homo sapiens
  misc_feature: GYAE6OF02F21I3.7.78.H01.1.454.CMB.1.raw
  modified_base (456)..(456): a, c, t, g, unknown or other
  misc_feature (456)..(456): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacaggcggtttgtcttctccatggatacctctgtcgggacgcttatctgcagataaccaaccttcaacctgacacactcgtcgtttattttgtacgngagcgttcgtctgtcgtagtggaattgacttacgtggggaccgtacgggaacccttgggtcccaccgttcctcccgtcgtacgcccctccgtacccacgggtaccccg

SEQ ID NO: 210809 - DNA, 589 bp, Homo sapiens
  misc_feature: GYAE6OF02GEX8F.7.78.H01.1.454.CMB.1.raw
  modified_base (527)..(527): a, c, t, g, unknown or other
  misc_feature (527)..(527): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacagtgggatggatcaacaccgacacgtcgggaaccccacctatcgcccaggtcccttacgacgacgggtcgtttgtcttctccatggactacctcgtggtcgggacgtcttactctgacagtactaaacctaaccttaccaaccgtgaaccgactacttcgtaccgttttagttttcgaacgtagagtccgtcgttctgtctaggtgtaattgactcgngggaccgaacgggtacccgtcggtcctaccgtcctcgccacgtcctcccaccgacggtcccg

SEQ ID NO: 210810 - DNA, 598 bp, Homo sapiens
  misc_feature: GYAE6OF02IE6NQ.7.78.H01.1.454.CMB.1.raw
  modified_base (400)..(400): a, c, t, g, unknown or other
  misc_feature (400)..(400): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgctgcagccttctggatacatcttcacttacttattctgtcaattgggtccacaggcccctggacaaggccttgactacatgggatggatcaacaccgacacgtcgggaaccccacctatcgcccagtcccttcacagggtcgtttgtcttctcccaatcggtactacccttntcggtacggggacgtctttatcgtcgcagaactaaccaaccttccgaaccttgactaacactccgtcgttttatttcgtaacgtacgtacgtcgtctcgttgtctagtggtaattgactacgtcgggtaccaacgggtacccttggacctaccggtccgttacctcgtaccgtcccgtaccacccggacggtaccccg

SEQ ID NO: 210811 - DNA, 649 bp, Homo sapiens
  misc_feature: GYAE6OF02JWZF3.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgagaagcctggggcgtcagtgagcgttgcctgcaagccttctggatacatcttcactacttattctgtcaattggtccgacaggcccctggacaaggccttgactacatcgggatggatcgaacaccgacactcgggaaccccactatcgcccaggcccttacgacgacgggtcgtttcgtacttctaccgtatcggtacttacccgtcgtcggttccggggacggtctttacgtccgttcgacgtagtaactaacccgtaacctttacaacccgtagtaccgaactaccgttacggtccgtttttattttcgtaacgtaggtacgtcgttacgttcgtacgttacgtaggtcgtaattacggacttaccgtcgggtaccgtacgggtaacccttgggtaccctaccgttccgtaccgtcgaccgtccctcccgaccgacggtaccccg

SEQ ID NO: 210812 - DNA, 550 bp, Homo sapiens
  misc_feature: GYAE6OF02GL3HL.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatcgcccaggccttcacgagggtcggtttgtcttctccatggactacctctgtcgggacggcttatctgcagactaaccaccttcaacctgacacactgtccgtttattttgacgtagacgtcgtcgtctgtctagtgtaattgactacgtgggccgagggtaccctggtccaccgttctcctcgacgcctccaccgacggtccc

SEQ ID NO: 210813 - DNA, 658 bp, Homo sapiens
  misc_feature: GYAE6OF02IOYS8.7.78.H01.1.454.CMB.1.raw
  modified_base (243)..(243): a, c, t, g, unknown or other
  misc_feature (243)..(243): n is a, c, g, or t
tcagcgtgtctctacacgaccggtgctcgatttagtgtgagtagtttgggtttgggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttntggatacatcttcactacttattctgtcaattgggccacacggcccctggacaaggccttgactacagtgggatggatcaacacgacacgtcggaacccactactcgcccaggtccttacacgtacgggtcgtttgtcttctctagtgtactacctcgtcggtcggacggtctttactcgtgacagtaacctaacctaccttaccaaccgtgaaccgtaactaccgttcgttaccgtttttattttacggacgtaggtacgtccgtttacgttcgtagtaccgtaaggttaggtaaacttcggaacgttacggtcgggggtaccccaacggggtaacccgttcgggtaacccgtaccggttacccttacccgttaccgaccgttacccctacccgaacccggtaccggtaccccg

SEQ ID NO: 210814 - DNA, 664 bp, Homo sapiens
  misc_feature: GYAE6OF02JA53Q.7.78.H01.1.454.CMB.1.raw
  modified_base (393)..(393): a, c, t, g, unknown or other
  misc_feature (393)..(393): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcgtggatacatcttcactacttattctgtcaattgggtccgacaggccccctggacaaggccttgactacagtgggatgggatcaacaccgacacgtcgggaaccccacctatcgcccaggcccttcacgacggggcggttttgtcctttcncctagtcgtactaccttcgtcggtacggggtacggtctttactccgtgcctaaggtaacctaaaccctaacccttcaaacccgtacgaaccgtaacctacgttcgttacccgtttttattttcggtaacgtaggtacgtcggttcgttcgttacgttccgtaaggtaggttaactacgtacgtacggtcggggtaccgtaacggggtaccctcgggtaccgtaccgttcccgtccgtccgtacgcccgtcccgaaccgaccgggtaccccg

SEQ ID NO: 210815 - DNA, 620 bp, Homo sapiens
  misc_feature: GYAE6OF02HNVP7.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggcccctggacaaggccttgactacatgggatggatcaacaccgacactcgggaaccccacctatcgacccaggcccttcaccgaggggtcggttttcgtcttcctcctatggacttaccgtcgtacggtccggggacgtcgtttatcgtagctagacttaacccaccttaccaacctgaaccgactacgttcgtccgttttagttttcgtaacgtgtacggtacgtcgtcttggtactaggtagtaagttcgacgtacggtgggacccgaagggtaccctgggtcctacccgttcctcccgtcgaccgtccctaccgaccggtaaccggtcccg

SEQ ID NO: 210816 - DNA, 600 bp, Homo sapiens
  misc_feature: GYAE6OF02INYSQ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacaccgacactcgggaaccccacctatcgcccaggcccttcacgacgggtcggtttgtcttcctcctatggtactacctcgtggtcgggacgtcttagtctgcagtactaaacctaaccttcaacctgaacgtacactgtaccgtttattttacgtacgtagtagtcgtcgtcgtagtcgtagtagtaattcgtactacgtcgggtaccgaacgggtaacccgttggtacctaccgtccttcccgtacgtaccgcccgtaccacccggacggtaccccg

SEQ ID NO: 210817 - DNA, 605 bp, Homo sapiens
  misc_feature: GYAE6OF02F6MIM.7.78.H01.1.454.CMB.1.raw
  modified_base (489)..(489): a, c, t, g, unknown or other
  misc_feature (489)..(489): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacaccgacacctgggaaccccacctagtcgacccaggcccttcgacggggtcgtttgtcttctccagttggactacctctcggtcgggacggtcttatctgcagataaccaaccttcaacctcgacgacactgtcctttattttgtacgtagtacgtcgtcgtctgtntacccgtgtaacttcgacgttacgtggggacccgagggtaaccccgtgggtccgtaccggttcccttccgtaccgtaccgtcccgttacccgaacccggtaccgggccctacccgg

SEQ ID NO: 210818 - DNA, 563 bp, Homo sapiens
  misc_feature: GYAE6OF02G7E70.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcccgcaagccttctggatacatcttcactacttattctgtcaattgggtccgacaggcccctggacaaggccttgactacatgggatggatcaacaccgacactgggaaccccactactgcccaggccttcacgagggcgtttgtcttctcatggatacctctgtcgggacgcttatctgcagactaaccaccttacaacctgacgacactcgccgtttattttcgtacgtagtagtcgtcgtctgtcagttggaattgactacgtcggggaccacgggaacccttggtaccaccgttcgtccctcacgcctaccgacccgtacgggccctacgg

SEQ ID NO: 210819 - DNA, 578 bp, Homo sapiens
  misc_feature: GYAE6OF02FSUOC.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccgacaggcccctggacaaggccttgactacatgggatggatcaacaccgacactcgggaacccccactatcgcccaggcccttcacgagggtcgtttgtcttctccagtcggactaccctctggtcgggacggtcttatctgcagactaaacccaccttcaaccttgaccgacacttcgtaccgttttattttcgacgtagagtcgtcgtctgtcagtcggtaattcgactcgtgggcctaacgggtacccttggtcctaccgttcctcctcaccgtccctcccgaccgacgggtacccc

SEQ ID NO: 210820 - DNA, 676 bp, Homo sapiens
  misc_feature: GYAE6OF02GG616.7.78.H01.1.454.CMB.1.raw
  modified_base (284)..(284): a, c, t, g, unknown or other
  misc_feature (284)..(284): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcacttacttattctgtcaattgggtccgacncggcccctggacaaggccttgactacagtgggatggactcaaacaccgacaccgtacgggaacccctactactcgcccaggtcccttacgacgagggtcggttttacgtcctttccaccgtagtggtaactaccgttcgtcgggtacgggacggtactttactctcgtacgaagtacttaaaccctaaccttaccgaacctacggaacctactacttcgttacgttttacttttcgtaacgtagtacgtccgtaccgttcgtcgttacgtacgttacggtaattcgtaccttacggtcggggacccgtaacggggtaacccgttcgggtccctacccggtttcctacccgttccgaaccgtcccgtaacccgtacccggaacgggtaccccg

SEQ ID NO: 210821 - DNA, 667 bp, Homo sapiens
  misc_feature: GYAE6OF02JSOMB.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaacccacctatcgcccgtacggcccttacgacgtagggtccggtttgttccgttcctccagtcggacttaccctcgtcggtacgggaccgtacgtttatctacggtcagtaacctaaaccgtaacccttaccaaaccgtcggtaaccgtaactaccggttacgttaccgtttttaacgtttttcggtaaccgtagtacggtcgtttcgtaccttgtaccgtagtacggtaagttcgtacgtacggtacgggaccgtaacgggtaacccttcgggtacctacccggttcgtccgttacgaccgtacccgtaccgacccggtaccgggtaccc

SEQ ID NO: 210822 - DNA, 693 bp, Homo sapiens
  misc_feature: GYAE6OF02H28IB.7.78.H01.1.454.CMB.1.raw
  modified_base (242)..(242): a, c, t, g, unknown or other
  misc_feature (242)..(242): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttntggatacatcttcacttacttattctgtctaattgggtccgacacggtcccctggacaaggccttgacctacatgggatggactacaacaccgacacgtacgggaacccccactagtcgacccgacggtcccttacgacgacggggtcggttttcgtccttcctccgaatggaacttaccctgttcgggtccggggaacggtctttacgtcgtggacctaagtactaaaccctaacccttcaaaccgtagaccgtacaccgttcgttaccgtttttattttaccggtacgtaacggtacgttccggttaccgttcgttacgggttacgtacgggttaggaactttacggaccgttacggtccgggggtacccgaacggggtaaccccttgggtaccctacccgttccgtccctacggaccgttcccctaaccgacccggacgggtaccccg

SEQ ID NO: 210823 - DNA, 606 bp, Homo sapiens
  misc_feature: GYAE6OF02HHBSE.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacacgtcgggaaccccactatcgcccaggtcccttcacgagggtcggtttgtcttctccagtggtactacctcgtcggtcgggacggtcttaatcgtgcagactaacctaccttcaacctgaccacacttcgtcttttatttcgacgagtacgtcgtcgttcttgtccaggtggtaattgtaccgtacggtcggggtacccgtaacggggtaaccctcgggtaccctaccgttccgtacccgtccgaccggtccctacccggaaccggacggtacccc

SEQ ID NO: 210824 - DNA, 548 bp, Homo sapiens
  misc_feature: GYAE6OF02F6G3D.7.78.H01.1.454.CMB.1.raw
  modified_base (378)..(378): a, c, t, g, unknown or other
  misc_feature (378)..(378): n is a, c, g, or t
  modified_base (495)..(495): a, c, t, g, unknown or other
  misc_feature (495)..(495): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcgtttgtcttcncatggatacctctgtcgggacgtcttatcgtgcagactaaccaaccttcaacctgacgactactcgtcgttttattttgacgtagagtcgttcgtctgtcagtggaattgactacgngggccacgggaccctggtccaccgtctcctcacgtccctccgaccgaggtccc

SEQ ID NO: 210825 - DNA, 775 bp, Homo sapiens
  misc_feature: GYAE6OF02HCDYK.7.78.H01.1.454.CMB.1.raw
  modified_base (242)..(242): a, c, t, g, unknown or other
  misc_feature (242)..(242): n is a, c, g, or t
  modified_base (283)..(283): a, c, t, g, unknown or other
  misc_feature (283)..(283): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttntggatacatcttcacttacttattctgtcaattgggtccanaggcccctggacaaggcttgactacatgggatggatcaactaccgacactcggaaccccactatcgaccctacggccttacgacgacggggtcggttttcgtcctttccgtacctaacttggggtaacttacccgttcgttacgggttcccgggggaaccggtcctttaacgtccgttggtacctaacggtaaacttaaaccccgtaaaccgtttacccaaacccgttacgaacccgtaaccgtaaaccgttcggttaaccccggttttttaaattttttcgggtaaaccgtaaggttaaccgggttccgtttaccggttcgtttacggttccgtaaagggttcggtaaaactttacgggaacccgtttacgggtaccgggggttaaccccgaacgggggttaaaccccgttgggttaaccccgaacccggtttccgttaccccgttacgaaccgttcccccgttaaccgaacccggtaaccggggtacccc

SEQ ID NO: 210826 - DNA, 701 bp, Homo sapiens
  misc_feature: GYAE6OF02IIUYO.7.78.H01.1.454.CMB.1.raw
  modified_base (241)..(241): a, c, t, g, unknown or other
  misc_feature (241)..(241): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttnggatacatcttcacttacttattctgtcaattgggtccacaggcccctggacaaggccttgactacagtgggatggatcaacaccgacacgtcgggaaaccccacgtatcgcccaggcccttacacgtagggtcggttttgtccttctccaatcggaacttaccctcgtcgggtaccgggtacggtcctttaatcgtcgcaagtaactaaacccgtaaaccttcaaacccgttagaaccgtaacacgttacgtccgtttttaatttttacggaacgtagtacgtccggttacttccggttagttccgtaaggttacggaaactttcggtaaccgttacggttacggggggtaccctaaacggggggttaaacccccttgggttaccccgtaaccccggtttccttcccgtaacggtacccgtacccgttaccccgtaaccccggtaaacggggtaccccc

SEQ ID NO: 210827 - DNA, 554 bp, Homo sapiens
  misc_feature: GYAE6OF02FQLXZ.7.78.H01.1.454.CMB.1.raw
  modified_base (500)..(500): a, c, t, g, unknown or other
  misc_feature (500)..(500): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccacctatcgccccaggcccttcacacggggcggtttgtcctttctccactggactacctctgtcgggacgtcttatctgcagataaccaaccttcaacctgacgacactgaccttttatttgtacgagagtcgtcgtctgtcagtgaattgacttcgngggccagggtaccctggtcctaccgtctcctcacgccctccaccgaggtacccc

SEQ ID NO: 210828 - DNA, 575 bp, Homo sapiens
  misc_feature: GYAE6OF02IXBFD.7.78.H01.1.454.CMB.1.raw
  modified_base (243)..(243): a, c, t, g, unknown or other
  misc_feature (243)..(243): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacatcttcactacttattctgtcaattgggtccgacacggcccctggacaaggccttgactacatgggatggatcaacaccgacactcgggaaccccactactcgacccgacgccttcgacggggtcgtttgtcttctcagtgactacctctcgtcgggacgtcttactctgacagactaaccacttacaacctgacacactcgttaccgtttatttcgacgagtagtcgttcgtctgtctagtagaattgactcgtgggacctaacgggtaccctgggtacctaccgtctccgtacaccgtcccgtaccaccggacggtccctacgg

SEQ ID NO: 210829 - DNA, 709 bp, Homo sapiens
  misc_feature: GYAE6OF02G0I9P.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcacttacttattctgtctaattgggtccacgacggccccctggacaaggccttgactacagtgggatggatcaacaccgacacgtacgggaacccccacctatcgcccaggtcccttcacgcggggtcggtttcgtctttcctccagtcggacttacccgtcgttcgggtccggggacggtctttacgtcgtcgacgtaagtaacctaaaccctaacccttaccgaaacccttcggaacccgtactaccgttcgttaccgttttttagtttttacggtaaccggtacgtacggttccgtttaccgttcgttacggttaccgtagggttacggtaagtttacgtaacggttaccgggttggggtacccgtaacgggggtaaccccgttgggtaccctacccggtttcctacccgttacgaccggttccccctacccggacccgtaccgggtcccccg

SEQ ID NO: 210830 - DNA, 580 bp, Homo sapiens
  misc_feature: GYAE6OF02HBLT6.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggccccctggacaaggccttgactacatgggatggatcaacaccgacacgtcgggaaccccactatcgcccaggcccttcacagggtcgtttgtcttctccatcggactacctcgtcggtcgggtacgtcttatctgcagactaaccaaccttcaacctgacgacacgtcgtaccgttttattttcgacgtagacgtcgttcgtcttcgtcgtagtggtaattgactacgtggggaccgtaacgggacccttggtcctaccgtctacctcgacgtccctaccgaccgacggtcccg

SEQ ID NO: 210831 - DNA, 614 bp, Homo sapiens
  misc_feature: GYAE6OF02JBJIG.7.78.H01.1.454.CMB.1.raw
tcagcgtgtctctacacgaccggtgctcgatttagtgtgagtagtttgggtttggggacccaacaaccacacccctcctaagaagaagctcctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttatctgtcaattcgggtaccacacggcccctaggacaaggtccttgactacagtgggatggatcaacaccgacacgtcggaaccccactatcgcccaggcccttacgacgtaggggtcgtttcgtcttcctccagtcggactaccgtctggtcgggacgtcttatctgcagtactaacctaaccttacaacgtgaccgactacgtcgtccgttttagtttcgaaccgagtacgtccgttcgtcttgtctaggttagtacttcgacttacggtcggggaacctacggggtaaccttcgggtacctaccgttccgtacccgtaccgaccggtccctaccgaccccggtaaccggg

SEQ ID NO: 210832 - DNA, 754 bp, Homo sapiens
  misc_feature: GYAE6OF02IZJC8.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtgggcgtcagtgagcgttgcctgcaagccttctggatactatcttcactacttattctgtctaagttggtccgacacgcccctggacaaggcctgactacagtgggatggactacgaacaccgaacacctacgggaaccccaccgtaactcgaccccgtaggacccttcgacgtaacggggtcggtttttcggtctttacctccgtaagttcgggtaacttacccgttcgttcgggttaccggggtaacgggtcttttaacgttcgtacggtaccgtacggtaaaaccttaaaccccgtaaaccttttacccgtaaaccccgtaggtaaacccggtaacctaccggttaccgttaccgggtttttttaaccgtttttacggtaaaaccgtcggtaaacgggtccggtttccgttaacggttcgttacgtaacgggtttggtaaacgtttacgaccgtttacggtacggggaccggtaacgggtaaacccgttggtaccgtacccgtcttaccgtccacgtccctaccgtaccgtacggtccccg

SEQ ID NO: 210833 - DNA, 617 bp, Homo sapiens
  misc_feature: GYAE6OF02F2QOH.7.78.H01.1.454.CMB.1.raw
  modified_base (281)..(281): a, c, t, g, unknown or other
  misc_feature (281)..(281): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccanaggcccctggacaaggccttgactacatgggatggatcaacaccgacactagggaaccccactatcgcccacggccttcacgagggtcggtttgtcttctcctatcggactacccgttctcggtccgggacggtctttactcgtggcctaagacttaaacccaacctttcaaacctcggaaccactacgtcgtacgtttttactttggtaactgtacgtcgtcgtatcgtcgtagtggaattgtacttacgcggggtaccacggggtaacccttgggtacccgtcccgttactcccgttccgaaccgtccccgtacccgaaccggtacggtacccc

SEQ ID NO: 210834 - DNA, 559 bp, Homo sapiens
  misc_feature: GYAE6OF02IWE1W.7.78.H01.1.454.CMB.1.raw
  modified_base (512)..(512): a, c, t, g, unknown or other
  misc_feature (512)..(512): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacacggcccctggacaaggccttgactacatgggatggatcaacaccgacacgtcgggaaccccactatcgcccaggccttacacgacgggtcgtttcgtcttctccagtggactacctcgtcgtcgggacgtcttatcgtgcagaactaaccctaaccttaccaacctgaaccgacacttcgtaccgtttttatttgaacgtagagtcgtgtctgtcagtgattgatacgngggccgaggtacctggtctacgtctcgcacgccaccacgaggtaccc

SEQ ID NO: 210835 - DNA, 751 bp, Homo sapiens
  misc_feature: GYAE6OF02F6ZCT.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccacaggcccctggacaaggccttgactacatgggatggatcaacaccgacactcgggaaccccactatcgcccaggcccttcacgacgggtcggttttcgtcctttcgtacccagttcgggtaacttacccgttccgttcggttaccgggggaccggtactttaacgttccttggaccgtaacggtaaaccttaaacccccgtaaacccgtttacccaaacccgttcggaaacccgtaacctaccgtttccggttacccgttttttaacgttttttcgggtaaccgtaggtaacggtccggttacgtttaccgttggttccgtaaggttacggtaaagttttacgaaccttacgggttacgggggaccggtaaccgggggtaaaccccgtttcggggtaacccgttacccgggttccttacccgtaccggttaccgacccccgtttacccaacccggtaaccgggtacccccg

SEQ ID NO: 210836 - DNA, 603 bp, Homo sapiens
  misc_feature: GYAE6OF02GFAZB.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacacggcccctggacaggccttgactacatgggatggatcaacaccgacactcgggaaccccactatcgcccaggtcccttcacacgggtcggtttgtcgttctcatcggatacctcgtgtcgggacgtcttatctgcagactaaccaaccttacaacctcgacgacctactcgtccgttttattttcggacgtagagtccgttcgtctcgtctaggtagtaattcgacttacgtcggggaccgacggggtaaccctgggtacccgtaccgttccgttccgtaccgtaccggtccctacccgtaacccggacgggtacccccg

SEQ ID NO: 210837 - DNA, 563 bp, Homo sapiens
  misc_feature: GYAE6OF02GO54Q.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacaggggcggtttgtcttctccatggatacctctgtcggggacgcttatctgcagactaaaccaaccttcaacctgacgacactgtccgtttattttcgtaacgtagagtcgttcgtctgtcagtcggaattgacttacgtgggccgaagggtaacccttggtccaccgttctaccgtcacgccctcccgaccgaacggtccc

SEQ ID NO: 210838 - DNA, 823 bp, Homo sapiens
  misc_feature: GYAE6OF02HPSOH.7.78.H01.1.454.CMB.1.raw
  modified_base (186)..(186): a, c, t, g, unknown or other
  misc_feature (186)..(186): n is a, c, g, or t
  modified_base (224)..(224): a, c, t, g, unknown or other
  misc_feature (224)..(224): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacgntggtcgtgagtagtaggaagacgtcgggtcggtctagnggagcgttcgtcgcgtcgaacgccttccttggagtactactcttctactacttattcttgtctaattagggtccggtaccacggccccgtcgtacgaacggtaccgttctacgtacctagtgggtagtagtagtactaaccaccgaaccgactacgggaaccccgtaaccctagtacgacccgaccggaccttcgaccgaacgggtcggtttcgtttcttaccgtccgtacgtaggtactaccttaccgtgggttccgggtacgggtacttacttcgtcgacgtaaacgtaacgttaaaccccttaaacccttaccgtaacccgtacggtaccgtaacccgttaccttaggtttaccccggttttttaatttttacggtaaccggaacgtacggtaccggtttcccggttaccgttaggttaccgttaaggttacgggtaaactttcggttaacccgtaaccgggttaccgggggtacccgggtaaccccgggtaaacccggttacccgggttccgtacccccggttaacccggttccttacccggaaccggttccccgtacccccggaaccgttaaccggggtaccccgttaccccgg

SEQ ID NO: 210839 - DNA, 640 bp, Homo sapiens
  misc_feature: GYAE6OF02JPCFU.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagtccttctggatacatcttcactacttattctgtactaattgggtccgacgacggcccctaggaccgaacggccttaggacctaccgagttggggacttgggactaccaaacgaccgtacaccgtacgggaaccccacgtatcgcccgaggtcccttacacgtacgggtcgtttgtcttcctcagtcggtactacctcgtcgtcgggacgtcgttactcgtcgctagtactaaacctaaccttacgaacctcgaaccgtactactcgttccgtttattttcgacgtagtacgtcgtcgtctgtacgtagtacgtattcgacttacgtcgggacgtacgggtacccgttcggtactacccgttcgtacccgtcgaccgtccctaccggtaccgacgggtaccccg

SEQ ID NO: 210840 - DNA, 692 bp, Homo sapiens
  misc_feature: GYAE6OF02IEM1V.7.78.H01.1.454.CMB.1.raw
  modified_base (373)..(373): a, c, t, g, unknown or other
  misc_feature (373)..(373): n is a, c, g, or t
tcagcgtgtctctacacgaccggtgctcgatttagtgtgagtagtttgggtttggggtacccgaacaaccacacccctcctaagaagaagaccctagaccacagctccacaccatggactggacctggaggatcctcttcttggtggcgagtagcaacaggtgcccactcccaggtgcagctggtacagtctgggtctagaattgaggaagccgtgggcgtcagtgagcgttgctgcagccttctggatacatcttacacttacttattctgtctaagttgggtccacacggcccgtggacaaggtcccttagacttacgattggggaattggatacaacgtaccgacacgtagggaacccccaacttagacnccacggtccttacgaccgtaagggcggttttgcctttacgtccaattacgggattacccttgtcgggttcgggtaccggtacgtttattccgtagaccgtagtaaacgtaaacccgtaacctttccgaaaccgttcggaacgtaccaacgttcggtacctttttagtttacggttaaggtacggtacgtccggttagtcctaggttctaaacggtggtaacgttacgacgttacgtcggggtaccgaacgggtaacccgttgggtacccctaacggtccttaccgtccgtacgcccctttacaaccggaacccgtaccg

SEQ ID NO: 210841 - DNA, 610 bp, Homo sapiens
  misc_feature: GYAE6OF02GH49O.7.78.H01.1.454.CMB.1.raw
  modified_base (523)..(523): a, c, t, g, unknown or other
  misc_feature (523)..(523): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacacgtcgggaaccccactatcgcccaggcccttcacgagggtcggtttgtcttctccagtggacttacctcgtggtcgggacggtcttatcgtgcagactaacccaaccttccaactgaacgacacgtcgtaccgttttatttttacggacgtagacgtcgttcgtcttgtcgtagtggtaattcgacttacgnggggaccgtaacggggtaacccttggtacccgtaccgttccttcctaccgtaccggtcccctacccgaacccggaccgggtaccccg

SEQ ID NO: 210842 - DNA, 540 bp, Homo sapiens
  misc_feature: GYAE6OF02FH0VF.7.78.H01.1.454.CMB.1.raw
  modified_base (243)..(243): a, c, t, g, unknown or other
  misc_feature (243)..(243): n is a, c, g, or t
  modified_base (492)..(492): a, c, t, g, unknown or other
  misc_feature (492)..(492): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacatcttcactacttattctgtcaattgggtccgacaggcccctggacaaggccttgactacatgggatggatcaacaccgacactgggaaccccactatcgcccaggccttcacagggcgtttgcttctccatggatacctctgtcgggacgtctatctgcagactaaccaaccttacaacctgacgacactgtccgttttattttcgtacgagagtcgtcgtctgtcagtgtattgactacgngggcagggtaccctggtcaccgtctcctcacgcctccaccgaggtccc

SEQ ID NO: 210843 - DNA, 753 bp, Homo sapiens
  misc_feature: GYAE6OF02HLYHA.7.78.H01.1.454.CMB.1.raw
  modified_base (327)..(327): a, c, t, g, unknown or other
  misc_feature (327)..(327): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcgtggatacatcttcactacttattctgtcaattcgggtccgacacggcccctggacaaggccttgactacatggatggatcaacnccgacacgtacgggacccctacgtactcgacccaggtcccttcgacgtacggggtccggttttcgttacttcctccgtaagttcggtaacttacccgtcgtttcggtacgggggtacccgtcgtttaacgttccgtagtaccgtaaggtaaacctaaacccctaaccctttacctaaacccgtacggaacccgtaccttaaccgttcgttaacccggtttttaatttttccgggtaaacggtagttacgggtaccgtttaccgttcgtacggttaccgtaggtttacgggtaaactttcgggtaacctacggttaccgggggtacccggaacggggttaaccccgttgggttacccgaccccggtttaccgtcccgtttaccggaccggttccccctaacccgtacccggtaacgggtacccccgg

SEQ ID NO: 210844 - DNA, 708 bp, Homo sapiens
  misc_feature: GYAE6OF02HCI52.7.78.H01.1.454.CMB.1.raw
tcagcgtgtctctacacgaccggtgctcgatttagtgtgagtagtttgggtttggggtacccgaacaaccacacccctcctaagaagaagccctagaccacagctccacaccatggactggacctggaggatcctcttcttggtggcagtagcaacaggtgcccactcccaggtgcagctggtacagtctgggtctgaattgaggaagccgtggggcgtcaggtgagcgttgcctgacaagccttcgtggatacgattcttcacttacttattctgtcaattgggtccgacgacggccccgtggtaacaacgggtcttaggactacagttgggatcggatacgaacaaccgactacgtacgggaaacccccacctaagtcgaccctacggccttaccgaaccgaggggtaccggttttgtccttcgtaccagttggaacttacccgtgttacggtccgggggacgtactttagtcgtcggactaaggtaacctaaaccgtaaccctaccaaaccgtgaaacgacctacgttacggttcccgttttaatttttacggtaaccgagtaacgtcggttacggttctcgttacgtaacggttagttaacgttgtaaccgttacggtcggggacctaacgggggtaacccttacggggtcttaccccgttgttaccctcggaacgccccgttacaacccggacggtacccccg

SEQ ID NO: 210845 - DNA, 663 bp, Homo sapiens
  misc_feature: GYAE6OF02IRG49.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttctggatacatcttcactacttattctgtcaattgggtccgacaggcccctggacaaggccttgactacatgggatggatcaacaccgacactcgggaaccccactatcgcccacggccttcacgagggtccggttttgtctttctccattgggactaccctctcggtcgggacggtcttatccgtgcgtagataaccctaaccttcaaacctgaaccgtacaccgttcgtacccgtttttatttttcgtaacggtaggtacggtccgttccgttacttcggttaccgtaggtacggtaagtttaggtaaccttacggttcgggggtacccgtaacgggggtaccccgttgggtacccgtacccggtttcccgtacccgtaccgtaccggtccccttacccggaccccgtaaccgggtcccccg

SEQ ID NO: 210846 - DNA, 748 bp, Homo sapiens
  misc_feature: GYAE6OF02FGMU9.7.78.H01.1.454.CMB.1.raw
  modified_base (243)..(243): a, c, t, g, unknown or other
  misc_feature (243)..(243): n is a, c, g, or t
  modified_base (281)..(281): a, c, t, g, unknown or other
  misc_feature (281)..(281): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctacaagcccttcnggatacatcttcactacttattctgtcaattgggtccncaggcccctggacaggccttgacctacagtggatggatcaacaccgacacgtacgggaacccccactatcgacccaggcccttcacgagggtccggtttgtcccttcgtccagtggacttacccgtcgttcgggtccggggacggtcctttagtccgttgacctaacgaaccttaaacccgtaacccgtttaccaaaccccgtgaacccggtacctaccgttacgttacccggtttttaacttttttacggtaaccgtaagggtacgttccggttaccggtttaccttcggttacgtaacgggttaggtaaacgtttcggtaacccgttaccggggttccgggggaacccgtaaccgggggttaaacccccgttcggggttacccccgtaacccggttccctacccgttaccggaaccgttcccccgttaccccgaaccccggtaaccggggtcccccttaaccggg

SEQ ID NO: 210847 - DNA, 583 bp, Homo sapiens
  misc_feature: GYAE6OF02GW0CU.7.78.H01.1.454.CMB.1.raw
  modified_base (419)..(419): a, c, t, g, unknown or other
  misc_feature (419)..(419): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattcgggtccacacggcccctggacaacggccttgactacagtggatggatcaacaccgacacgtcggaaccccactatcgcccaggcccttacacgacgggtcgtttagtccttctcagtgactactcgtggtcggggacgtcttancgtgcagtaactaaccaccttcaacctgacactacttgtccgttttattttgacgtagtagtcgtctntcgtntaggtgtaatgtactacggtggacccgaagggtacccttggtaccgtaccgtccttaccgcgtaccgccctaccgaccgaacgggtccccg

SEQ ID NO: 210848 - DNA, 751 bp, Homo sapiens
  misc_feature: GYAE6OF02JZJ5H.7.78.H01.1.454.CMB.1.raw
tcagcgtgtctctacacgaccggtgctcgatttagtgtgagtagtttgggtttggggacccaacaaccacacccctcctaagaagaagccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacgatcttcacttacttattctgtcaattgggtccacacggcccctggacaaggccttacgactacgagtagggatagggactaccgaaccaccgacaccgtacggaaccccactacgtcgacccaggtcccttacgaacggtacgggtcgggttttcgtccgtttctaccgtaagttacggtaccttacccgtcgttacgggttaccggggtaccggttactttacgtcgtcgtaccgtagtaaaccttaacccgtaaccttaccaaccgttacggaaccgtactaacgtccgtttaaccgttttacgtttttacggaaccgtaacggttacgtccggttccgttacgttacgttacgtacggttaggttaacgttacgtaaccgttacgggttcgggtaacccggaaccggggttaacccgttcgggtaacccggttcccggtttacgtacccgttcccggaccgttaccctaaccccggtaaccccggtaccgggttacccc

SEQ ID NO: 210849 - DNA, 659 bp, Homo sapiens
  misc_feature: GYAE6OF02JDC03.7.78.H01.1.454.CMB.1.raw
  modified_base (281)..(281): a, c, t, g, unknown or other
  misc_feature (281)..(281): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattggtccganagcccctggacaaggccttgactacatgggatggatcaacaccgacacgtcgggaaccccactatcgacccaggtcccttcacgagggtcggtttgtccgttctccgtagtcggaactacccgtcgtggtccggggtaccggtctttactcgtgctaacgtaactaaacctaccttaccaaccttagaaccgtacacgttcgtaccgtttttattttcggtaaccgtagtacgtccggttcgttcgtacgttcgtaaggttcggtaattcggtaacttacggtaggggtacccgtaacggggtaacccgttgggtacccgtacccggttcgttacccgtaccgaccgttccccgaccgtacccggaccgggtaccccg

SEQ ID NO: 210850 - DNA, 685 bp, Homo sapiens
  misc_feature: GYAE6OF02ICI0W.7.78.H01.1.454.CMB.1.raw
  modified_base (354)..(354): a, c, t, g, unknown or other
  misc_feature (354)..(354): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggctcagtgagcgttgcctgcaagccttcgtggatacatcttacacttacttattctgtcaattgggtccacacggcccctggacaaggtcccttgactacagtgggatggatcaacaccgacacgtacgggaaccccactancgtacccgacggcccttacacgaggggtcggttttactcgttcctacgattggacttaccgtcgtggtcgggacgttcttactcgtcgcaagtaactaacctaaacctttcaaacccgtgacctacgtacttcgttaccgttttagtttttacgacgtagtaacgtccggttacgttcgttcgtacgtagggttagaaacgtttacgtaccgttacggttccgggggaccgtaaaccggggttaaccccgttggggtaacccttaaccggttcccttacccgttaccggtaccgttacccccgtacccgtaacccggacgggtaacccccg

SEQ ID NO: 210851 - DNA, 784 bp, Homo sapiens
  misc_feature: GYAE6OF02ISIIY.7.78.H01.1.454.CMB.1.raw
  modified_base (323)..(323): a, c, t, g, unknown or other
  misc_feature (323)..(323): n is a, c, g, or t
tcagcgtgtctctacacgaccggtgctcgatttagtgtgagtagtttgggtttggggacccgaacaaccacacccctcctaagaagaagccctagaccacagctccacaccatggactggacctggaggatcctcttcttggtggcagtagcaacaggtgcccactcccaggtgcagctggtacagtctgggtctgaattgagaagcctggggctcagtgagcgttgccgtgcaagtccttctggatacatcttcacttacttattctgtacaattgggtccacgtaggccccctggaccgaaggtcccgtttagaccttaancgttaggggaactggaatccgaaacgacccgacctaacgtccgggaaaccccctactacgtcggcccgaaggtcccttacgaccgaggggttacggtttttcggtctttaccgccttatacgggtaccttacccgttcgtcgggttccggggaaccgggttcctttaagtccgttcggaccgttaaggtaacttaaacccgttaaccctttaccgaaacccgttacgaaccgtaacctaccgtttacgtaccgtttttttaactttttacgggaacgtaaccggtagttaccggttccttttaccggttacgtaccggttaacggtaagggttacttacgtaaccgttaccggtttacgggggaacccgttaacggggtaaccccgttggtaccccttaccggttacccgttcccttacggtaccgtccccccgtacgtacccccgggaaggttcccccgg

SEQ ID NO: 210852 - DNA, 812 bp, Homo sapiens
  misc_feature: GYAE6OF02ITNJ0.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattggaggaagccgtggggcgtcgaggtgagtcgttgcctgcaagccttcgtggatacatcttctacttacttattctgtactaagttcgggtccgacaccgggccccgtaggaacgtaacggtcccttagtaaccgttaacgagttcggggagtacggaactaccgaaaccgaccggaccgtaaccgtaccgggaaccccctaccgttaacgtccgacccgtaacggtccccttacgaaccggtacggggttccggttttcgtcctttccgtaccgtaagttacggtaaccgttaccgtcgttcgggtaccggtacggtttacctttacgtccgttggaacctaacgtaaccttaaaaccctaccgttaccgaaccgttcgaaccgtaccgttacgttaccgttttacctttttaagttttacggacgtaagtaccgttcggtttaccgttacgttcgttacgttaacggttaggtaaaccgtttagtaacccgttacggggtaaccggggttaacccggacggggtttaaacccctcgggttaccccttaacggtccccttacgtaacccggtccgtaccccgttacccggtaaccggaacccggttccccgg

SEQ ID NO: 210853 - DNA, 622 bp, Homo sapiens
  misc_feature: GYAE6OF02JCI88.7.78.H01.1.454.CMB.1.raw
  modified_base (387)..(387): a, c, t, g, unknown or other
  misc_feature (387)..(387): n is a, c, g, or t
tcagcgtgtctctacacgaccggtgctcgatttagtgtgagtagtttgggtttggggacccaacaaccacacccctcctaagaagaagccactagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatctcactacttattctgtctaattgggtccgacaggcccctggacaacggccttgactacacgtgggatggatcgaacaccggacacgtcgggaaccccactatgcccagccttacacgagggcggtttagctttacnccatcggactacctcgtggtccgggacggtcgttaacttcgtcgacgtacggaactaaacctaacccttccaaaccgttcggaaccgacctactacgttcccgttttaagtttttcggaacggtacgtacgtacggttccgttaaccgtgttaccgtagttggtaacttgtaccgtgtacgggtccgaacggtaccgtgtctaccgtcctctccacgtccctaccgaccgtacgg

SEQ ID NO: 210854 - DNA, 678 bp, Homo sapiens
  misc_feature: GYAE6OF02IRDK1.7.78.H01.1.454.CMB.1.raw
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcagtgagtcgttgcctgcaagtccttcgtggatacatcttcactacttattctgtctaagttgggtccgacacggccctggacaggtccttgactacagtgggatggatcaacaccganacgtcgggaaccccactancgaccacggtccttcgacgcgggtcgtttgtcttctccatcggatcctcgtcggtacgggacggtcttatcgtacgcacgtactaaaccgtacctaccgtaaccgtacgaaccgtacgtaccgttacgttacccgtttttaagtttcggtaaccgtagggtacgtccggttaccgttccgtacgttcgtacgttagggtaaacgtttcgtaaccgttacgggtaccgggtacccgtaaacgggggtaccccttagggtcccgtacccgttacgttccccgtaacgtccggtaccccgtacccgaacccggaccgggttccccg

SEQ ID NO: 210855 - DNA, 543 bp, Homo sapiens
  misc_feature: GYAE6OF02F82X9.7.78.H01.1.454.CMB.1.raw
  modified_base (492)..(492): a, c, t, g, unknown or other
  misc_feature (492)..(492): n is a, c, g, or t
  modified_base (520)..(520): a, c, t, g, unknown or other
  misc_feature (520)..(520): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagatggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatcgcccaggccttcacagggtcggtttgtcttctccatggatacctctgtcgggacgtcttatcgtgcagataaccgaactcacctgacacactgccgttttatttcgtacgagtacgtcgtcgtctgtcagtgaattcgactcgnggggaccagggtaaccctggcaccgtcnctcgagccctcaccgacggtccc

SEQ ID NO: 210856 - DNA, 612 bp, Homo sapiens
  misc_feature: GYAE6OF02JC2QY.7.78.H01.1.454.CMB.1.raw
  modified_base (253)..(253): a, c, t, g, unknown or other
  misc_feature (253)..(253): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggctcagtgagcgttgcctgcaagccttctggatacatcttnactacttattctgtcaattgggtccgacaggcccctggacaaggccttgactacatgggatggatcaacaccgacactgggaaccccactatcgccaggccttcacagggtcgtttgtcttctccagtggactaccgtctgtcgggacggcttatctgcagactaaccaacttccaactgacgacactcgccgttttattttcgtacgtagtacgtcgtacgttcttcgtcgtagtggtaaattcgaaccgttacgtcggggtcccgtaacggggtaacccgttgggtacccgtaaccggttcccgttacccgttaccaccgggtacccctaccccgtacccggaaccgggtacccccg

SEQ ID NO: 210857 - DNA, 725 bp, Homo sapiens
  misc_feature: GYAE6OF02IVEGR.7.78.H01.1.454.CMB.1.raw
  modified_base (353)..(353): a, c, t, g, unknown or other
  misc_feature (353)..(353): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtcgtgggtctgaattggaggagccgtggggcgtcagtgagcgttgcctgcaagccttctggatacatctcactattattctgtcaattgggtcgacgacggcccctggacaaggccttagactacagtgggatggatcaacaccgacacgtacggaacccctactancgccgacggtccttacgaccgagggtcggtttacgtcttaccgctagtcgataccctcgtacggtcgggagtctttagtcagtcaagtaactaacccgtaacctttacaaccgtgaaccgaaccttacgtcggttaccgttttttaagttttacggtaacgaagggtacggtacccgtttaccggttacctttgggtaaccctagggttaaacgggtaaaccttttgggtaaaccttacccggggttcgggggtaacccggaaaccgggggtttaaccccttaggggtaccccgttaccccgtttaacccgttcccgttaaccgtacccggtaccccgtttaacccccgaacgggttaacccgggtaccccc

SEQ ID NO: 210858 - DNA, 619 bp, Homo sapiens
  misc_feature: GYAE6OF02HMOPC.7.78.H01.1.454.CMB.1.raw
  modified_base (312)..(312): a, c, t, g, unknown or other
  misc_feature (312)..(312): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacattcttcacttacttattctgtctaattgggtccgacaggcccctggacaaggccttgactanatgggatggatcaacaccgacacgtacgggaaccccacctatcgcccgacggccttcacgagggcgtttgtcttctcatggactacctcgtggtcgggacgtctttatcgtgacgacgtaactaaccctaaccttacaacccgtcgaaccgacactttgtaccctttttagttttcgacgtagtacgtcgttcgtcttcgtctaggttggtaattcgacttacggttcgggacccgtacggggaacccttgggtacctacccggttctcccgtcgaccgtccctaccggtaccgaccgggtaccccg

SEQ ID NO: 210859 - DNA, 608 bp, Homo sapiens
  misc_feature: GYAE6OF02I84QP.7.78.H01.1.454.CMB.1.raw
  modified_base (433)..(433): a, c, t, g, unknown or other
  misc_feature (433)..(433): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacacggcccctggacaaggccttgactacagtgggatggatcaacaccgacacgtcgggaacccccactatcgacccaggcccttcgacgacgggtcggttttagtcttctccagtcggactacctcgtcgtcggggtacgcttatcgtgcanaactaaccacttaccaactgactacactgtccgttttattttgtacgagtacgcgttcgtcttgccgtgtacggtaattcgacttaggtccgggaccgaacggggttacccgttcgggtaccctaccggttccttccgtaccgtacgtccccctacccaccggaacgggtccccg

SEQ ID NO: 210860 - DNA, 604 bp, Homo sapiens
  misc_feature: GYAE6OF02HPX8E.7.78.H01.1.454.CMB.1.raw
  modified_base (352)..(352): a, c, t, g, unknown or other
  misc_feature (352)..(352): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttagactacatgggatggatcaacaccgacacgtagggaacccccactacncgcccaggcccttcacaggggtcgtttacgtcttcctaccagtggacttacctctggtccgggacgtcttatctgcagtactaaaccctaacctttaccaaacgtcgaaccgactacgttcgtaccgttttaattttggtaacgtagtacgtcgttcgtcttgtctaggtgaattgaccgttagtcggggaccgaagggtaccctgggtccaaccgtacttctaccctgaccgtcctacccacgtaacccgg

SEQ ID NO: 210861 - DNA, 606 bp, Homo sapiens
  misc_feature: GYAE6OF02G3A4N.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggcccctggacaaggccttgactacatgggatggatcaacaccgacactcgggaaccccactatcgcccaggcccttcacgagggcggttttgtcttctccatcggataccgtctggtcgggacggtcttactctgcagactaaacctaaccttaccgaacctgaaccgacctacgttcgttaccgttttatttttcgtacgagtacgtccgttcgtactgtacaggttaggtaattgacgtacgtcgggacccgtaacgggaacccgttggaccgtaccgtccttccgtccgacgtcccgtaccaccgtacggtaccccg

SEQ ID NO: 210862 - DNA, 809 bp, Homo sapiens
  misc_feature: GYAE6OF02ITW8G.7.78.H01.1.454.CMB.1.raw
  modified_base (189)..(189): a, c, t, g, unknown or other
  misc_feature (189)..(189): n is a, c, g, or t
  modified_base (394)..(394): a, c, t, g, unknown or other
  misc_feature (394)..(394): n is a, c, g, or t
tcagcgtgtctctacacgaccggtgctcgatttagtgtgagtagtttgggtttggggtacccgaacaaccacacccctcctaacgaagaagccctagaccacagctccacaccatggactggacctggaggatcctcttcttggtggcagtagcaacaggtgccactcccaggtgcagctggtacagtntgggtctgaattgaggagccgtggggcgtcagtgagcgttgcctgcaagccttctggatacatcttcactacttattctgtcaattgggtcacgaggcccctggacaggccttgactacactggggatacggatcaacctaacccggacaaccggtcgggaaaccccgtaaccctaagtcggccccaaggcccttacgaacccgnggggtaccgggtttttgtacctttcctaccgtacgttcggggaacttaacccctgggtttccggttacggggaacccgggttaccttttaacgtcccgttggacccgtaacgttaaacgttaaaccccgttaaacccttttaaccgaaaccctttacgggtaaacccggtaacccttaaccgttaccgggttcccgttttttttaaaggttttttaccgggtaaacggttacggttaacgggtacccttacccggggtttcctttacggttacgttagggtttcgtaaaaggtttcgtaaccggtacgtttcgggggaacccgtacgggggtaaacccgtttcgggtaacctaacccgggttccgttacccttcggaacggtccccctttacggaccccggtaaggtacccccgg

SEQ ID NO: 210863 - DNA, 543 bp, Homo sapiens
  misc_feature: GYAE6OF02FLM5Z.7.78.H01.1.454.CMB.1.raw
  modified_base (474)..(474): a, c, t, g, unknown or other
  misc_feature (474)..(474): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatcgcccaggccttcacagggcgtttgtcttctcatggatacctctgtcggggacgtcttatctgcagataaacccaaccttcaacctgacgacactgtccgtttattttcgtacgagagtcgtcgtntgtcagtgaattgactactgggccagggaccctggtccaccgtctcctcacgccctccaccgaggtccc

SEQ ID NO: 210864 - DNA, 559 bp, Homo sapiens
  misc_feature: GYAE6OF02JLIVV.7.78.H01.1.454.CMB.1.raw
  modified_base (311)..(311): a, c, t, g, unknown or other
  misc_feature (311)..(311): n is a, c, g, or t
  modified_base (539)..(539): a, c, t, g, unknown or other
  misc_feature (539)..(539): n is a, c, g, or t
tcagcgtgtctctacacgaccggtgctcgatttagtgtgagtagtttgggtttggggtacccgaacaaccacacccctcctaagaagaagccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacntggatggatcaacaccgacactgggaaccccactatcgcccaggccttcacaggggtcgtttgtcgttctccgatcggactacctctggtccgggacgtctttatctgctagactaacccaacctcaaccttgacgtaccacgtgccgtttttatttgtacgagagtcgtcgtctgtcagtggaattgaactgtcgggccagggtaaccctggtccacgtctccgtcncgcctccgacgtacggtccc

SEQ ID NO: 210865 - DNA, 659 bp, Homo sapiens
  misc_feature: GYAE6OF02I10Y1.7.78.H01.1.454.CMB.1.raw
  modified_base (321)..(321): a, c, t, g, unknown or other
  misc_feature (321)..(321): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttctggatacatcttcactacttattctgtcaattggtccacaggcccctggacaggccttgactacatgggatggatcaacnccgacactcgggaaccccactatcgccaggcccttacgacgtagggtcgtttggttccttcgtcctatacgggtactaccgttcgtcggttacggggaccggtactttagtccgtggccgaagtactaaaccctaactttccgaaacctcggaacgacctacgttcggtaccttttagttttcggacgagtactcggtacttcgtagtccgtagtgtaaattcgacgttaccgggttacgggaccgtaacgggggtaaccctggggttaacccgtaacccgggtttcctacccttcggtaaccgaccccgttacccgaacccggtacggggtaccccc

SEQ ID NO: 210866 - DNA, 558 bp, Homo sapiens
  misc_feature: GYAE6OF02HWIRL.7.78.H01.1.454.CMB.1.raw
  modified_base (470)..(470): a, c, t, g, unknown or other
  misc_feature (470)..(470): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttatttctgtcaattgggtccgacaggcccctggacaaggccttgactacatgggatggatcaacaccgacactgggaaccccacctatcgcccaggccttcacagggcgtttgtcttctccatggactacctctggtcgggacgctttatctgcagactaaccaaccttcaactgacacactgcgtttattttgacgagtagcgtcgtntcgtctggtgaattgacttacgtggggccaacgggaacccttgggtacctaccgtctcccgtcgacgccctaccacccgaaggtcccc

SEQ ID NO: 210867 - DNA, 556 bp, Homo sapiens
  misc_feature: GYAE6OF02FFJIJ.7.78.H01.1.454.CMB.1.raw
  modified_base (242)..(242): a, c, t, g, unknown or other
  misc_feature (242)..(242): n is a, c, g, or t
tcagcgtgtctctacacgaccggtgctcgatttagtgtgagtagtttgggtttggggacccaacaaccacacccctcctaagaagaagccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacatcttcactacttattctgtcaattggtccgacaggcccctggacaaggccttgactacatgggatggatcaacaccgacactcgggaaccccactatcgcccaggccttcacagggtcggtttgtcttctccagtggatacctctgtcgggacgtctatctgcagataaccaaccttcaacctgacacactcgtccgtttattttcgtacgagacgtcgtcgtctagtcagtgattgactacgtggggcctaacgggaccctggtcctaccgtctcccgtcgacgtcctaccaccgaacgggtcccc

SEQ ID NO: 210868 - DNA, 559 bp, Homo sapiens
  misc_feature: GYAE6OF02HW3L5.7.78.H01.1.454.CMB.1.raw
  modified_base (432)..(432): a, c, t, g, unknown or other
  misc_feature (432)..(432): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatggggatggatcaacaccgacactgggaaccccactatgcccaggccttcacagggcggtttgtcttctccatggactacctctgtcgggacgcttatctgcagataaccaaccttcaactnacgacactgtcgtttattttgtacgtagagcgtcgtctgtcagtggaattgacttacgtggggccgaacgggtaccctaggtcctaaccgttcctcctcgacgccctaccgacccgaaggtaccccg

SEQ ID NO: 210869 - DNA, 735 bp, Homo sapiens
  misc_feature: GYAE6OF02G2KUO.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttactttattctgtacaagttcgggtccgacacggcccctggaccaaggccttgactacagtgggatggaataaacgaccgacacgtacggaacccactatcgccaggtccttacgacgtaggggtcgtttacgttcttctaccgtagtcggacttaccgtcgtacggttccggggacggttcttacgtcttcgacgtaacgtacgtaaaaccctacctttaaccgaaccttacgaacccggtaacctaacgttacgttacccgtttttaagtttttacggtaacggtagttaacgggtcccgtttacgggttaccttcggttaacgttagggttacggtaaagttttaccgggtaaccgtttacgggtaccgggggtaccgtaaccggggtaaccccgggtggttacccgttaccggtcccgttaccgttccggaccgttccccttaacccggacccggtaccgggtaccctaccgg

SEQ ID NO: 210870 - DNA, 611 bp, Homo sapiens
  misc_feature: GYAE6OF02G8FLL.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacacggcccctggaccaaggccttgactacatgggatggatcaacaccgacacgtacgggaaccccacctatcgcccgaggcccttcacgaggggtcgtttgtcttctccagtggactcctctggtcgggacgtcttatcgtgctagactaacctaaccttacaacctgaacacacgtcgtccgttttattttcggacgtagtacgtcgtcgtctgtctagtcgtaagttgacgttacgtcggggtacccgaacggggtaacccgttcggtaccgtacccgttcttacccgttaccgaccgtcccctacccgtacccgaacgggtaccccc

SEQ ID NO: 210871 - DNA, 604 bp, Homo sapiens
  misc_feature: GYAE6OF02G47PV.7.78.H01.1.454.CMB.1.raw
  modified_base (386)..(386): a, c, t, g, unknown or other
  misc_feature (386)..(386): n is a, c, g, or t
  modified_base (403)..(403): a, c, t, g, unknown or other
  misc_feature (403)..(403): n is a, c, g, or t
tcagcgtgtctctacacgaccggtgctcgatttagtgtgagtagtttgggtttggggacccaacaaccacacccctcctaagaagaacgcccctagaccacagctccacaccatggactggacctggagatcctcttcttggtgcagtagcaacaggtgcccactccaggtgcagctggtacagtctgggtctgaattgaggaagccgtaggggcgtcagtgagcgttgccgtgcaagccttctggatacatcttacacttacttattctgtcaagttcggtccacaggcccctggacaaggccttgactacatggatggatcaacacgagacacgtcggaacccctactatcgacccagccttcgacgagggtcgtttgtcttcnccgtagtcgacttcctntcgtacgggactcgttatcgtcgacagtacgtaacctaacctacaacctgaccacacgtcgtaccgttttatttacgacgagtacgtcgttacgtcgttgtcctaggtacgtaatttcgacgttacgtaggggccctaagggtaacccctggtacccaccggttccgtccgtacgacgtcccttacgaacccgtaaccggg

SEQ ID NO: 210872 - DNA, 681 bp, Homo sapiens
  misc_feature: GYAE6OF02IBXZZ.7.78.H01.1.454.CMB.1.raw
  modified_base (159)..(159): a, c, t, g, unknown or other
  misc_feature (159)..(159): n is a, c, g, or t
  modified_base (264)..(264): a, c, t, g, unknown or other
  misc_feature (264)..(264): n is a, c, g, or t
  modified_base (318)..(318): a, c, t, g, unknown or other
  misc_feature (318)..(318): n is a, c, g, or t
  modified_base (630)..(630): a, c, t, g, unknown or other
  misc_feature (630)..(630): n is a, c, g, or t
tcagcgtgtctctacacgaccggtgctcgatttagtgtgagtagtttgggtttgggacccaacaaccacacccctcctaagaagaagcccctagaccacagctcccacaccatggactggacctggaggatcctcttcttggtgcagtagcaacaggtncccactcccaggtgcagctggtacagtctgggtctgaattgaggagccgtggggcgtcagtgagcgttgcctgcaagccttctggatacatcttacactaacttnttctgtataagttgggtccgacacggtccctaggacaaggtccttagacctaanagtgggatggactcaacacccggacacgtacgggaacccctactaatcgaccctaggtccttacgacgtgggtcgtttgtcttacgtccaatcggtacttaccgtcgtcgggtacgggacggtcttaagtcgtacgcgtaagtaacctaaccctaacttaccgaactcgaacgtactattcgtttacgttttagtttacggaacgtggaacggttcttcgttacctggttacctagggtagtaactttaggaccgttacggtaccgggggacccgtaaccgggaacccgtttccgggaactacccccggttnttacccgaccgtaaccgttccccgtaacccgaaccggtaccgggtaccccc

SEQ ID NO: 210873 - DNA, 628 bp, Homo sapiens
  misc_feature: GYAE6OF02GMALY.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagtccttctggatacatcttcactacttattctgtcaagttgggtccgacacggcccctggacaaggccttgactacagtgggatggatcaacaccgacacgtacgggaacccccactatcgcccacggccttcgacggggtcggtttgtcttctccagtcggtacttaccgtcgtcggtcggggacggtctttagtctgactagtaacctaacctaaccttaccaaccgtcgaaccgacctacgttcgttaccgttttagttttggaccgtagtacgtcgttccgttcttcggtcgtgttaggaattcgacttacggtcggggacctacggggtaaccctggtacctacccgttcctccgtccacggtccctccaccggacggtccctaccgg

SEQ ID NO: 210874 - DNA, 558 bp, Homo sapiens
  misc_feature: GYAE6OF02JEKPJ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacaccgacacgtcgggaaccccactatcgcccacggcccttcgacggggtcgtttgtcttcgtccatggactcctctcggtcgggacgtcttatctgacagactaaccaccttcaacctgaccactctgttccgttttattttcgacgagtacgtccgttcgtctgtcagtgtaattgactcgtgggcacgggtcctggtcaccgtctccgcactccctacaccgacggtccctacg

SEQ ID NO: 210875 - DNA, 577 bp, Homo sapiens
  misc_feature: GYAE6OF02HIT78.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacacgtcgggaaccccacctatcgcccacggcccttcacgaggggtcggttttgtcttctcctatggaacttacctcgttcggtcggggacggtcttatcgtgcagtaactaaccctaaccttcaacctgaaccgacactcgtccgttttattttcgtacgagtacgtcgtcgtctgtcaggtgattgactacgtgggaccagggaccctggtccacctatcctcctcacgccctaccgacgtaaccgg

SEQ ID NO: 210876 - DNA, 716 bp, Homo sapiens
  misc_feature: GYAE6OF02IBKCT.7.78.H01.1.454.CMB.1.raw
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (308)..(308): a, c, t, g, unknown or other
  misc_feature (308)..(308): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggctnagtgagcgttncctgcaagccttgtggatacatctcacttattattctgtcaattgggtccgacacggcccctggacaggtccttgacctanagtggatggatacaacaccgtacacgtacgggaacccctaccgtatcgtacccgacggtcccttaccgaacggtacgggtcgggttttatccgtttccaccgtaacgttggtaaccttacccgtcggtttacggtaccggggtacgttcctttaacgttccgtcggtaactacgtaaaccgtaaacccttaacccttaccgaaaccttaccggaaccgtaaccgtaccgttccgttaccgttttttacgtttaccgggttaacgacggttaaccggtcgtttaccgtcgttagtaccgttagtacggtaacgttacgacgtcgtacggggaccgtaacgggtaccccgtaggtcccttaccgtcccgttcgaccgtaccgtcccgtaccgacccggtaggtaaccccg

SEQ ID NO: 210877 - DNA, 592 bp, Homo sapiens
  misc_feature: GYAE6OF02HQ13K.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttgactacatgggatggatcaacacgacacgtcgggaaccccactatcgcccaggcccttcacgtagggtcggtttgtcttctcagtcggactacctcgtggtccgggacggtctttatctgcagtaactaaccaccttacaacctcgaacgacacttcgtccgttttattttcgaacgtagtacgtcgttcgtctgtacaggttcgtaattcgacgttacgtcggggtaccaacggggtaccctggtccgtaccgttcctaccgtcgacgtccctaccaccgacggtcccg

SEQ ID NO: 210878 - DNA, 575 bp, Homo sapiens
  misc_feature: GYAE6OF02F7YMW.7.78.H01.1.454.CMB.1.raw
  modified_base (513)..(513): a, c, t, g, unknown or other
  misc_feature (513)..(513): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggcccctggacaaggccttgactacatgggatggatcaacaccgacactcgggaaccccactactcgccccaggcccttcacgacggggtcggtttagtcttctcctatcggacttaccgtctgggtccgggtacggtcttatctggcagactaaacccaaccttcaacctgacacactgtccgtttatttgacgagtagcgtcgtctgtctagtggtattgactagngggccgacgggaccctggtacctaccgtccgtcctcgacgtccctccgaccgtacggtcccg

SEQ ID NO: 210879 - DNA, 628 bp, Homo sapiens
  misc_feature: GYAE6OF02H5DR0.7.78.H01.1.454.CMB.1.raw
  modified_base (331)..(331): a, c, t, g, unknown or other
  misc_feature (331)..(331): n is a, c, g, or t
  modified_base (364)..(364): a, c, t, g, unknown or other
  misc_feature (364)..(364): n is a, c, g, or t
  modified_base (390)..(390): a, c, t, g, unknown or other
  misc_feature (390)..(390): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtcgcccactcccaggtgcagctggtacagtctgggtctgaattgaggagcctggggcgtcagtgagcgttgcctgcagccttcgtggatacatcttcacttacttattctgtctaattggggtccgacacggcccctggacaacggccttgactacagtgggatggatcaacnccgaacacgtcgggaaccccactacgtcgaccncggcccttcacgacgggcggtttttncctttcctctatcggactttacctcgttcggttaccggggacggtcgtttactccgtgtacaaggtaactaaaccctaaccttcaaccgtggaccgtactacgtcgttacgttttatttacgtagagtacgtcgtctcgtgtactggtagtaattgtacttcggtagggccgtacgggaccctgggtacctaccgtccgttcccgtactaccgtcccgtcccaaccggacggtccccg

SEQ ID NO: 210880 - DNA, 551 bp, Homo sapiens
  misc_feature: GYAE6OF02HNL0R.7.78.H01.1.454.CMB.1.raw
  modified_base (394)..(394): a, c, t, g, unknown or other
  misc_feature (394)..(394): n is a, c, g, or t
  modified_base (528)..(528): a, c, t, g, unknown or other
  misc_feature (528)..(528): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtcgacaggcccctggacaaggccttgactacatgggatggatcaacaccgaacactgggaaaccccacctatcgccacggccttcacagggcgtttgtcttctccatggactacctntgtccgggacgtcttatctgcagataaccaacttcaactgacacacttgtaccgttttattttagacgagacgtcgtcgtctgtcgaggttgaattgactacgtgggaccagggaccctggtccaccgtctccnctcgccctaccaccgaggtaccc

SEQ ID NO: 210881 - DNA, 594 bp, Homo sapiens
  misc_feature: GYAE6OF02IFGLL.7.78.H01.1.454.CMB.1.raw
  modified_base (505)..(505): a, c, t, g, unknown or other
  misc_feature (505)..(505): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccacaggcccctggacaaggccttagactacagtgggatggatcaacaccgacaacgtcgggaaccccactatcgacccaggcccttcacgagggtcgtttgtcttctccatggacttaccgtcgtggtccgggacggtcttatctgctagtaactaaccaaccttacaacctgaaccgacacttcgttaccgttttattttggtacgagtagtcgtcgtctgtacnggttagaattgacgtacgtcggggacctacgggtaaccctgggtacctaccgtctccctcgaccgtccctacccacccggacggtcccg

SEQ ID NO: 210882 - DNA, 554 bp, Homo sapiens
  misc_feature: GYAE6OF02FZHS3.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcgtttgtcttctcatgactacctctgtcgggacgcttatcgtgcagactaaccaacttcaacctgaccgacactcgtaccgttttattttgacgtagagtcgtcgtcttgtctagtgaattgactacgtgggaccagggaacccttggtacctaccgttctcctcgacgccctaccaccgacgggtccc

SEQ ID NO: 210883 - DNA, 804 bp, Homo sapiens
  misc_feature: GYAE6OF02HEN27.7.78.H01.1.454.CMB.1.raw
  modified_base (704)..(704): a, c, t, g, unknown or other
  misc_feature (704)..(704): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatccctcttcgttggcgcagtagacaacgaggtcgcccacctcccgaggtcgacgacgcgttacggtaacgtagtcggtggtctagtaagttaggaaggaacggtccggtggggtcctcgtaggtggacgtcgttcgccgtcgacgacgtccttgagtactactacttcctactaacttaactttcttctcgtacgtaaggttccggtaccgacggtacccgtcccgtacggaacgacggtccttacgaacctacgtaggtggtagtaggactacgaaccaccgactaccggtacccgaaccctacgtacgccgaccgtacgtcctaccgacggtacgggttccggttttcgtccgttccgtaccgtagttacggtacccttaccgttcgtacgggtaccggggtcttacgtttagccgtacgacgaaacgttaccaaaccttacctaacccgtaaccgtcggaacccacgttaaccggtttccgtttaaccgtttttacttacggaacgtacgtacgggttcgttccgttcgtacgtacgggttaagttaaggtacgttacgtcgttaccgggnggggtaaccccgaaccgggttacccggttaggtacccgtaccggttccctacccgttccgtaacccgttcccgtaacccggaccggttaccccggtaccg

SEQ ID NO: 210884 - DNA, 658 bp, Homo sapiens
  misc_feature: GYAE6OF02IJ17F.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgattgaggaagcctggggcgtcagtgagcgttgcctgcaagccttctggatacatcttcacttacttattctgtcaagttgggtccgacacggcccctggacaaggccttagactacagtgggatggatacaacgaccgacacgtcgggaacccctactatcgcccgacgccttcgacggggtcggtttacgtcttctccgtatcggtaactaccttcgtcggtaccgggacggtacttacgtctgcaagtaacttaaccgaaccttccaaacctcgaaccgtactaccgttcgttaccgttttagtttttacgtaacggtagtcgtccgttcgttcgtgttacgaaggttggtaattacggtacgtaccggtggggtacccgaacgggtaacccgttggtacccgtaccgttcctccgtaccgtccgtaccctacccggaacccggaccggtaccctaccgg

SEQ ID NO: 210885 - DNA, 594 bp, Homo sapiens
  misc_feature: GYAE6OF02FFF2V.7.78.H01.1.454.CMB.1.raw
  modified_base (243)..(243): a, c, t, g, unknown or other
  misc_feature (243)..(243): n is a, c, g, or t
  modified_base (385)..(385): a, c, t, g, unknown or other
  misc_feature (385)..(385): n is a, c, g, or t
  modified_base (419)..(419): a, c, t, g, unknown or other
  misc_feature (419)..(419): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacatcttcactacttattctgtcaagttgggtccgacaggcccctggacaaggccttgactacatgggatggatcaacaccgacacgtcgggaaccccacctatcgcccaggccttcgacaggggtcgtttgtcttcnccatggactaccctctggtcgggacggtctatcngcagactaacctactacaacctgacgacactcgtccgttttattttgtacgtagagtcgttcgtcctgttcgagttaggaacttgacttcgtacgggccgtaacgggtaacccttcgggtcctaacccgttcctacccgttaccacggccctaccccgtaccgaacgggtacccc

SEQ ID NO: 210886 - DNA, 581 bp, Homo sapiens
  misc_feature: GYAE6OF02HGNIR.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaacgcctggggcgtcagtgagcgttgcctgcaagccttctggatacatcttcactacttattctgtcaattgggtccgacaggcccctggacaaggccttgactacatgggatgggatcaactaccgacacgtgggaaccccacctatcgcccacggcccttcacaggggcggtttgtcgttctaccgatcggataccgtctggtcgggtacggctttatctgcagataaccaaccttcaacctgacacactgccgttttattttgtacgtagacgtcgtcgtctgtctggtgaattgacgttacgtcgggaccacggggtaaccctggtccacccggttctcccgttcgacgtccctcccacccgaggtacccccg

SEQ ID NO: 210887 - DNA, 692 bp, Homo sapiens
  misc_feature: GYAE6OF02HUC09.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagcttctggatacatctcactacttattctgtcaattgggtcgacaggcccctggacaaggccttgactacacgtgggatggatcaactaccgacacgtgggaaccccactatcgccaagtccttcgacggggtcgtttagtcttctccagtggactaccgtcttcgggtcgggacggtactttactcgtcgtcacgtaactaaacctaaccgtttaccaaccttacggaacgtaccgtacttcgttaccgtttttatttttacggaacggtaagtacgtccggttacgttcgttgtaccgtaggttaaggtaacgttcgtaacgttaccggtacgggggtacccgtaaccggggtaacccttagggttccccgtaaccggtttacccgttaccccgtacggtaacccgtaccccgttaccccggtaaaccggtaaccggggtacccccttaaccggg

SEQ ID NO: 210888 - DNA, 769 bp, Homo sapiens
  misc_feature: GYAE6OF02JE3DV.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggcccctggacaacggccttgactacatgggatggatcaacaccgacacgtacgggaacccctacgtactcgacccaggtcccttacgaaccgtacggggtcggttttcgtcctttccgtacctagttcggtaaccttacccttacgttcgggtccggggtaaccggttcttttaacgccttcggacctaaggtaactaaaccccgtaaaccgttcccaaaccgttcggaaacccgtaccgtaaccgtttccggttacccgttttttaagttttacggtaaccggtaaggtaacccggttaccggttaccgttacgttacggtaccgttaacgggttacggtaaacgtttacggtaaccgttaaccggtcggggggtaccctaaaccggggggtaacccctttcggggttaccctaacccggtttccgtacccgttacgtaacccggtccccgttacccgtaacccggtaacccgggttacccc

SEQ ID NO: 210889 - DNA, 662 bp, Homo sapiens
  misc_feature: GYAE6OF02HOCR3.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagtccttctggatacatcttcacttacttattctgtcaagttcgggtaccgacgacggcccctggaccaaggccttagacctacagtgggatggatcaacaccgacacgtcgggaaccccactacgtcgcccgtacggcccttacgacgacggggttcgttttcgtcctttcctacctagtcggtacttacccgttcgtcggtcgggtacgtctttagtctagcagtactaaccctaaccttacctaaccgtagaacctactacttcgtacttttagttttcgacgtacgtacgtcgtcgtacgttcgtacgtaggtacgtaagtttcgacgttacgtcggggaccgtaaccggggtaccccgttcgggtaccttaacccggttcgttaccctcgaccggttccctacccgtaccgtaacgggtcccc

SEQ ID NO: 210890 - DNA, 589 bp, Homo sapiens
  misc_feature: GYAE6OF02G2KZ8.7.78.H01.1.454.CMB.1.raw
  modified_base (362)..(362): a, c, t, g, unknown or other
  misc_feature (362)..(362): n is a, c, g, or t
  modified_base (437)..(437): a, c, t, g, unknown or other
  misc_feature (437)..(437): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatccgtcttcttggtggcagtagcaacaggtgcccactcccaggtgcagctggtacagtctgggtctgaattgaggaagcctggggagtcagtgagcgttgcctgcaagccttctggatacatcttcactacttattctgtcaattgggtccacaggcccctggacaaggccttgactacatgggatggatcaacacgacactgggaaccccactatcgcccaggccctcacncgggcggtttgtcttctcatcggtatacctctgtcgggacgcttatctgcagactaaccacttcacctgacgacnctgtccgttttattttcgtacgagtacgcggttcgtcgtgtctaggtcggtaattcgacttacggtcggggtccgaacggggtaacccgttcgggtaccacccggttccttcccgtcgaccgtcccgtacccacccgtaacgggtacccccg

SEQ ID NO: 210891 - DNA, 728 bp, Homo sapiens
  misc_feature: GYAE6OF02JWWX2.7.78.H01.1.454.CMB.1.raw
  modified_base (247)..(247): a, c, t, g, unknown or other
  misc_feature (247)..(247): n is a, c, g, or t
tcagcgtgtctctacacgaccggtgctcgatttagtgtgagtagtttgggtttggggtacccgaacaaccacacccctcctaacgaagaagccctacgaccacagctccacaccatggactggacctggaggatcctcttcttggtggcagtagcaacaggtgcccactcccaggtgcagctggtacagtctgggtctgaattggaggaagcctggggcgtcgagtgagcgttgcctgcagccttcnggatacatcttcacttacttattctgtactaagttggtaccgacacggcccctaggaacctaaggccttgaactaacgagtggggaactggactacgaaaccgtaccgacacgtccggggtaaaccccacctacgtcgacccctaggtcccttacacggtagggttaccgggtttgtaccctttcgtaccgtagtcggtaacttaccctcgttcggtaccggggacgtctttagtcgtcgtacgtaacgtaactaacccgttaaaccttcgtaaaccgttagaaccgtaacaccgttacgtttaccgttttattttacggtaacgagttacggtccgttaccgttacgttgtactacggttaaggtaatttacgtacgttaccgtggggtacccgtaacggggtaacccgttcggtacccgtaccgtttccgtacccttcggtaacccggtcccttaacccgtacccggaaaccggtcccg

SEQ ID NO: 210892 - DNA, 687 bp, Homo sapiens
  misc_feature: GYAE6OF02JFDUX.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaagttgggtccgacaggcccctggacaaggccttgactacagtgggatggactcaacgaccgacacgtacgggaaccccacctaactcgacccacggccttacgacgagggtcggtttcgtcttctctatggactacctcgtggtccggggtacgtctttacgtctcggcagtactaaccgtaacccttacaacccgtgaaccgtacctacttaccggtccgtttttaagtttttcggaaccggtaggtaccggttaccgttccggttacgttggtacctaacgggttggtaacttcggtaaccgttacgggttacgggggaccccgttaacggggtaaccccgttggttacccgtaacccgtttccgtcccgttacgaccggtccccgttaccgaccccggtaacgggtacccccg

SEQ ID NO: 210893 - DNA, 778 bp, Homo sapiens
  misc_feature: GYAE6OF02JKLQI.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtgggcgtcagtgagcgttgcctgcagtccttctggatacatcttcactacttattctgtactaagttgggtaccgacgacggccccgtaggaacgaacggtccttacgaactaacgtagtacggggatggtactacgaaaccgaccggaaccaccggtaccgggaaccccctacgtactacggacccgacggtcccttaccgaccgacggggttccggttttacgtccgtttctaccgtacgttacggtaaccttacccgtccgtttcggggtaccggggtaccgtaccgttttaactccggttacggtaacgtaaccggtaaacttaaacccctaacctttaccgaaacccgttaggaacccgtacttaacgttccgttaaccgttttttagttttaccgggaacgtacggtaacggttccggttaccgttacgttacgtccgttaaggtacggttaacttacgggttacgtaccgggtcgggtaaccgggtaaccgggtaccgtacggttcccgtaccgtccgttaccgtacgcccggtaccctcccggaaccgtacccggtcccg

SEQ ID NO: 210894 - DNA, 581 bp, Homo sapiens
  misc_feature: GYAE6OF02F2CJF.7.78.H01.1.454.CMB.1.raw
  modified_base (268)..(268): a, c, t, g, unknown or other
  misc_feature (268)..(268): n is a, c, g, or t
  modified_base (551)..(551): a, c, t, g, unknown or other
  misc_feature (551)..(551): n is a, c, g, or t
tcagcgtgtctctacacgaccggtgctcgatttagtgtgagtagtttgggtttggggacccaacaaccacacccctcctaagaagaagccctagaccacagctccacaccatggactggacctggaggatcctcttcttggtggcagtagcaacaggtgcccactcccaggtgcagctggtacagtctgggtctgaattgaggaagccgtggggcgtcaggtgagcgttgcctgcaagccttctggatacatcttcactacttattcngtcaattgggccgacacggccccgtggacaaggccttgactacagtgggatgggatccaacaccgacacgtacgggaaccccactatcgcccaggccttcgacggggcgtttgcttcgccatcggatccgtctcggtcgggacgcttagcctgctagactaaccacttcaacctgacgacacgtagtccgtttatttgacgtagacgtcgtcgtatgtacgtagtagaacgttgaccgttagtcgggaccacgggtaaccctcgtaccgaaccgtctccgtcncggtccctacgacccgtacgggccctacgg

SEQ ID NO: 210895 - DNA, 767 bp, Homo sapiens
  misc_feature: GYAE6OF02HM2M5.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagcttcgtggatacatcttcactacttattctgtcaagttcgggtacgacacggcccctggacaaggtccttgactacagtgggatggatcaacaccgacacgtcgggaaacccctactaagtcgacccgaggtcccttacgacgacgggtccggttttcgtctttccgtaccaagttggaaccttaccgtcgttcggtaccggggtacgtacgtttatccgtacggccgaagtaaacttaaaccctaacccgtttaccgaaaccgttacgaacccggtaacctaaccgttacggtttaccgtttttaacgtttttacggaaccggttaacggtacgttcccgttaccggtttaccgtacggtttacctaagggttaacggttaaagtttacggtaacccgtttaccgggtaccgggggtacccgttaaaccggggtaaccccgttcgggttaccccggttaacccgttccgtttaccccgtaccgtaccgacccccgttacccgtaacccggaacccgggttacccccgg

SEQ ID NO: 210896 - DNA, 589 bp, Homo sapiens
  misc_feature: GYAE6OF02JC9DF.7.78.H01.1.454.CMB.1.raw
  modified_base (407)..(407): a, c, t, g, unknown or other
  misc_feature (407)..(407): n is a, c, g, or t
tcagcgtgtctctacacgaccggtgctcgatttagtgtgagtagtttgggtttggggacccgaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttctggatacatcttcactacttattctgtcaattggtccgacaggcccctggacaaggccttgactacatgggatggatcaacaccgacactgggaaccccactatgcccaaggccttcacagggcgtttgcttctccgatggactacctctgtcgggacgtcttanctggctagactaaccaaccttcaacctgacgacactcgccgttttattttgtacgagagcgttcgtctcgtacaggttggaatttcgaacttacgtacgggggaccaaggggtaaccccttggggtacctaccggtaccttcccgtacaaccggtccctaccgtacccgtaacgggtccccg

SEQ ID NO: 210897 - DNA, 662 bp, Homo sapiens
  misc_feature: GYAE6OF02GZ5RQ.7.78.H01.1.454.CMB.1.raw
  modified_base (393)..(393): a, c, t, g, unknown or other
  misc_feature (393)..(393): n is a, c, g, or t
  modified_base (539)..(539): a, c, t, g, unknown or other
  misc_feature (539)..(539): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggctcagtgagcgttgcctgcaagccttcgtggatacatcttcacttacttattctgtctaagttcgggtccacgacggcccctaggacaacggtcctttggacctaacacgtgggatggactcaaaccgaccgtacaacgtccgggaacccctactacgtcgacccaggccttaccgacgnggggtcgtttcgtcttctccagtcggactaccgtcgtcggtccgggcggtacttactcgttacgctagactaaacctaacctttacaaccgtacgaccgactacgtacgttccgttttatttacggtacgtgtacgtcgttccgtntcgtctaggtacgtaacgttgtaccgttacggtacgggtccggtaacgggtaacccgttcgggtaccctacccgttccgtaccgtaccgaccgtcccgtacccgtaccggtaacccggtcccg

SEQ ID NO: 210898 - DNA, 736 bp, Homo sapiens
  misc_feature: GYAE6OF02IRV2H.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggctcagtgagcgttgcctgacaagcttctggatacatcttcacttacttattctgtactaagttcgggtccactacggcccctaggacaaggcttagactacagtggactggatacaacaccgacacgtcggaaccccactagtcgacccgagtcctacgacgtagggtcgtttcgtacttctaccgagttacgacttacctcgtcggtacgggacgtcttactcgtagacgtaagtaactaaacccgtaaccttactaaaccgtcggaaccgtactacgttaccggttaccgttttttatttaacgggtaaccgaagggttaacgtcccggtttaacgttaccgttacgggttagtaaccgggttaagtaaagtttacccgtaacggttaccggtacgggggtacccgttaaaccggggtaaccccgtttcgggtaacccgttaacccggttcccgtttaacccgtaccggttacccggtaaccccctttaaccggaaccccgggtaaaccgggttcccccg

SEQ ID NO: 210899 - DNA, 537 bp, Homo sapiens
  misc_feature: GYAE6OF02FXBBH.7.78.H01.1.454.CMB.1.raw
  modified_base (520)..(520): a, c, t, g, unknown or other
  misc_feature (520)..(520): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcgtttgcttctccatggatacctctgtcgggacggcttatctgcagactaaaccaaccttcaacctgaacgacactgccgtttattttcgtaacgagagtcgtcgttctgtcagtggaattgactacgtgggccagggacctggtcacgtctccncacgcctcaccaggccc

SEQ ID NO: 210900 - DNA, 855 bp, Homo sapiens
  misc_feature: GYAE6OF02ITYDW.7.78.H01.1.454.CMB.1.raw
  modified_base (241)..(241): a, c, t, g, unknown or other
  misc_feature (241)..(241): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcagtgagcgttgcctgcagccttntggatacatcttcactacttattctgtcaattgggtccgacacggcccctggacaaggtccttagactacagtgggatggatacgaacgaccgacgacgtacgggaacccctaccgtacgtcgccccgtaaggtcccgttacgaacggtaccggggtcgggtttttacgttccgtttaccttacccgtaagttacgggtaaccttacccgtttaccgttcggttaccgggggtaaccggttccgttttaaacgttccgttacgggtaccgtaaacggttaaaccgttaaacccccgttaaaacccttttaacccgtaaaccccgtttaccggaaacccgtaacccgttaacccgtttacggtttaccccgtttttttagttttttaccggtaacggtacggttaacgggtttccgtttaccggttccgtttcggtaacgttacggttaacgggttaaacttagggtaacccgtttacggggttaaccggggtacccggtaacgggggttaaacccccgttcgggttaaaccccgttccccgggtttaccttaccccgttaccggtaacccgtccccggttaaacccccgacccggtaaacccggggttaccccg

SEQ ID NO: 210901 - DNA, 632 bp, Homo sapiens
  misc_feature: GYAE6OF02HACF6.7.78.H01.1.454.CMB.1.raw
  modified_base (359)..(359): a, c, t, g, unknown or other
  misc_feature (359)..(359): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcaggtgagcgttgcctgcaagccttctggatacatcttcacttacttattctgtcaatttgggtccacacggccccgtggacaacggccttgactacagtagggatggactacaacgaccgacacgtacggaaccccactancgccacgccttcgacggggtcgtttgtcttctcagtgactacctcgtcggtcgggacgtcttagtctcgcagactaaacctactcaacctgaacgacctacgtcgttaccgtttattttacgacggagtacgtccgtacgtctacgttcgacgttagttaacttgtacgttacggacggggtaccgtaacggggtaacccgttcggtaccgtacccggttccgtcccgtacgtacggtacccctacccggaacccggtacggtcccctaccgg

SEQ ID NO: 210902 - DNA, 568 bp, Homo sapiens
  misc_feature: GYAE6OF02G6TKH.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtctaattgggtccgacacggcccctggacaacggccttgactacatgggatggatcaacaccgacactcgggaacccccactactcgcccaggtcccttcgacggggtccgtttgtcttctccatgactacctctcggtcgggacgcttatctgcagactaaccaaccttcaactgacacactgccgttttattttgtacgagtagtcgtcgtctgtactaggtagtaattgacttacggtcggggccgacgggaaccctggtccaccgttcctctcacgccctcaccgacggccctacg

SEQ ID NO: 210903 - DNA, 875 bp, Homo sapiens
  misc_feature: GYAE6OF02JBQOZ.7.78.H01.1.454.CMB.1.raw
  modified_base (163)..(163): a, c, t, g, unknown or other
  misc_feature (163)..(163): n is a, c, g, or t
tcagcgtgtctctacacgaccggtgctcgatttagtgtgagtagtttgggtttggggacccaacaaccacacccctcctaagaagaacgcccctagaccacagctccacaccatggactggacctggaggatcctcttcttggtggcagtagcaacagggtcncccactcccaggtgcagctggtacagtctgggtctgaatgaggaagcctggggctcaggtgaggcgtttgccttgacaacggtccttcgtaggacttaccagttccttacaacctttactttatttccttaggttcctaaagtttcggggtcccaacgtacgggtcccccttagggaactaacgggtccctttaggaacctaccgaagttcgggggaactcgggaactaccgaaaccgccccggtaaaccaccgggttacccggggaaacccccctacgtttaacgacccggtaccccgtacgggtacccctttaacgaaccgggtacggggtttccggttttcgtacctttaccgtcccgtaagttcgggtaccttaccctcgtacgggttccggggaccgttactttacgtcgttacggcccaaagttaacccttaacctaaccttacccgtaacctacgtaacccgtaccttaaccgttcgttaaccgttttttacgtttacgggaccgtaagttaccgttacccgttaccgttacggttacgtaacgttacggtagttaacgggttactttaacccggaccggggttaaccgggggtaccctaaacccggggtttaacccgttcgggtaaccccttacccggttaccgttaccccgtacggtacccgtttacccccgaaccggttaaccccggtacccggggtacccc

SEQ ID NO: 210904 - DNA, 704 bp, Homo sapiens
  misc_feature: GYAE6OF02FLW61.7.78.H01.1.454.CMB.1.raw
tcagcgtgtctctacacgaccggtgctcgatttagtgtgagtagtttgggtttggggacccaacaaccacacccctcctaagaagaagccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttctggatacatcttcactacttattctgtcaattgggtccgacaggcccctggacaaggccttgactacatgggatggatcaacgaccgacacgtgggaaccccacgtatcgcccacggccttacgacgtaggggtcgttttgtctttcgtccagttacgggacttacccgttcgtcgggtaccggggtaccggtctttaacgtccgtacggtacgacgtaacttaaacccctaaacccgtttaccaaacccgttgtaaccggacctaccgtcgttaccgtttttagtttttacggtaacgtagtacgtccggttacgtcgttcggttaccgaggttacggtaacgtttcgaacgttacggtcgggggacccgtaacggggtaccccttcgggtacccttaacccggttccgttacccgttaccgaccgtccccgttaccccgacccggtaaccggggtacccccg

SEQ ID NO: 210905 - DNA, 738 bp, Homo sapiens
  misc_feature: GYAE6OF02IDW0E.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatctcactacttattctgtcaagttgggtccgacacgccctggacaaggccttgactacagtggatggatcaaccacgacaccgtacgggaacccccacgtactcggacccaggtcccttacacgacggggtcggttttgtcttcctccgaatcggtacttaccgttccgtagggtccgggtacggtcctttaagtctcggtacgtaagtaaaccgtaaaccctaaacccgttttccgaaaacccgttcggaaaccgtaaccgtaaccgttcggttaacccgttttttaacgtttttaccggtaacgtacggtacgttacggttccgttcgttcggtacctaagggtacggttaaagtttcgtaaccgttacggggtaccggggacccgtaaccggggttaacccgttcggggtaacccgttacccggtttacccgtcccgtttaccgaccggttaccccctaccggaaccccggtacgggtacccccg

SEQ ID NO: 210906 - DNA, 922 bp, Homo sapiens
  misc_feature: GYAE6OF02FXKCJ.7.78.H01.1.454.CMB.1.raw
tcagcgtgtctctacacgaccggtgctcgatttagtgtgagtagtttgggtttgggggacccgaaacaaccactacccctcctaagaagaagcccctagaccacagctccacaccatggactggacctggagactcctcttcttggtggcagtagcaacaggtgcccactcccaggtgcagctggtacagtcgtgggtctgaattgaggaacgtccgtggggctcagtcgagtcgttcgcctgcctaagtccctttcgtggtaactacattccgttacaacttacgtttaattccgttggtacctaagtttcggggtaccccgaaccgtaccgggtacccccgttagggaaccgtaaacggggtcccgtttaggaaacccgttaacggtaacggttacgggggtaacttacggggtaaccgttaaaccggaaaaccccgtaacccccgggtaaactaacccggttaaccccggggaaaacccccccttaacccgtaaccttaccgggaccccgtaacggtacccccgtttaaccgaaccggtaacgggggtttcccggtttttacgttacccgtttaccgtaaccgttaagttaccgggtaaacctttaccccgttacgtttccgggtaccggggtaaccggtttccgtttaacgttccgtacggtaccgtaaacgtaaaccgttaaaccccgtaaacccgttaaccgtaaacccgttacgggtaaacctaaccgttaaccttcggttaccgttttttaagttttacggacgtaacggtcgttaccggttcgttacgttcgttacgtacggtaggtaacgttacgtaccggttacggcggtacccggtacggtaacccgttggtaccctaccgttccctcgttaccaccggtccccacccgtaaccggtacccggtaccccg

SEQ ID NO: 210907 - DNA, 668 bp, Homo sapiens
  misc_feature: GYAE6OF02JITOY.7.78.H01.1.454.CMB.1.raw
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
  modified_base (334)..(334): a, c, t, g, unknown or other
  misc_feature (334)..(334): n is a, c, g, or t
  modified_base (409)..(409): a, c, t, g, unknown or other
  misc_feature (409)..(409): n is a, c, g, or t
  modified_base (485)..(485): a, c, t, g, unknown or other
  misc_feature (485)..(485): n is a, c, g, or t
tcagcgtgtctctacacgaccggtgctcgatttagtgtgagtagtttgggtttggggtacccgaacaaccacaccctcctaagaagaagccctacgaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttactattctgtcaattgggtccanacggcccctggacaaggccttagactacngtgggatggatcaacaccgacncgtacgggaaccccactatgcccaggccttcgacgacgggtcggttttacgcgttactccattcggatacccgtntcgtcggggacggtcttagtctaggcagtaacaacctacttaccaactcgaacgtaccacgttcgtaccgtttttnttttacggacgtaggtacgtacggttcgttcgttaccgtgtaaaggttcggtaaacgttcgtaaccgtttacggttacggggacccggttaacggggtaacccttaggggttccccaaacggttcccttcccggttaacgaaccccggttcccgttaacccgaacccggtaccggggtacccc

SEQ ID NO: 210908 - DNA, 793 bp, Homo sapiens
  misc_feature: GYAE6OF02GVN28.7.78.H01.1.454.CMB.1.raw
tcagcgtgtctctacacgaccggtgctcgatttagtgtgagtagttttgggtttggggacccaacaaccacaccccccctaagaagaagcccctacgaccacagctccaccaccatggactggacctggaggatcctcctttcttggtgggcagtagcaacaggtgcccactcccaggtgcagctggtacagtcttgggtctgaattggagggaagcccgtggggcgtcagtgagcgttgcctgcaagccttctggatacatcttacactactttattctgtactaagttcgggtacccgacgacggccccctggaccaacggtccgttagactacacgtgggatggactacaaccaccgacacgtacgggaacccccacctatcgccacggtcccttaccgaccggaggggttccggttttcgttccttcctcctagtcggtactacccttccgttcgggtaccgggtccggtctttacgtcgtcgacgtacgtaactaaacccctaacccgttactaacccctaggaaccgtacctaccgttcggtttacccgttttttttaacgtttttaccggtaaccgtaacgggtacggttacccggtttccggttctttcggaccggttaagggttaagggttaacttacggtaccgttaaccggggtccggggggtaccccaaccggggttaacccccgttggggttacccccaaccccggtttccccgttacccgttacggaccccgttccccctaccccgggaaccccggtaacccggggtcccccgtaaccg

SEQ ID NO: 210909 - DNA, 767 bp, Homo sapiens
  misc_feature: GYAE6OF02HGN19.7.78.H01.1.454.CMB.1.raw
  modified_base (242)..(242): a, c, t, g, unknown or other
  misc_feature (242)..(242): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttcnggatacatcttcactacttattctgtctaattgggtccgacacggcccctggacaaggtccttgactacatgggatggatcaacaccgacacgtacgggaaccccactatacgcccgacggtcccttacacgtacgggtacggttttcgtccgttacctccgtaagttacgggtacttacccgttcgttacgggtaccgggggtaaccggtaccgttttaagttccgttacggtaccgtaacggtaaaccttaaacccgtaaacccttttaaccgaaacccgttacggaaacccgtaaccttaaccgttcggttaacccgttttttacgtttttacggtaaccgtaagggttaaccgtccggtttaaccgttcgttacggttaacgtaacgggttcgtaaagtttacgttaaccgttacgggtaccggggtacccgtaaccggggtaaccgtttccgggtacccgtacccgttccgttacccgtacgtacccggttaccctacccgtacccggaaacggtccccg

SEQ ID NO: 210910 - DNA, 654 bp, Homo sapiens
  misc_feature: GYAE6OF02JW1RU.7.78.H01.1.454.CMB.1.raw
  modified_base (583)..(583): a, c, t, g, unknown or other
  misc_feature (583)..(583): n is a, c, g, or t
tcagcgtgtctctacacgaccggtgctcgatttagtgtgagtagtttgggtttggggtacccgaacaaccacacccctcctaagaagaagccctacgaccacagctccacaccatggactggacctggaggatcctcttcttggtggcagtagcaacaggtgcccactcccaggtgcaggctggtacagtctgggtctgaattgaggaagcctggggcgtcagtgagcgttgcctgcaagccttctggatacattcttcacttacttattctgtctaagttcggtccgacgcggcccctggaccgaacggtccttagactacagtggatggactacaaccgaccgacacgtaccgggaacccccacgtactcgacccgacggtcccttacgacgtacgggtcggttttacgtctttccgtacctagttcgggtaaccttacccgtcgttcgggtaccggggacggtacttactcgtgactaagaactaaccctaaccttaccaaccgtagaccgtacaccgttacgttccgttttagtttaccgacgtagacgtcgtcgtcgtgtacagtgtatcgacgtcgngggtaccgtaggacccgttggtacctcccggtcttccgaccgaccgtaccctacccgtacgaccggtcccg

SEQ ID NO: 210911 - DNA, 681 bp, Homo sapiens
  misc_feature: GYAE6OF02IFOUU.7.78.H01.1.454.CMB.1.raw
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
tcagcgtgtctctacacgaccggtgctcgatttagtgtgagtagtttgggtttggggacccaacaaccacacccctcctaagaagaagcccctagaccacagctccacaccatcggactggacctggaggatcctcttcttggtggcagtagcaacaggtgcccactccaggtgcagctgtacagtctggtctgaatgagagcctgggctcngtagngcgttgccgtgcaagccttgacggatacatctcatattatctgtacagttcggtccgacacggtcccctaggaccaaggtcctagtactactagtcgggtactaggtataccaaccgaccgaactacggtaccggaaccctacgttacgtcgtacccgacggtccttcgaacgtcggggttccgtttcgtcgtttcctaccgttaagtacggtacttacccgttcgttcggtaccgggaccgttacttagtccgtcgggtacacgttactaaaccgttacctttaacgaccgttagaacgactacgttcgttcgttttaatttccggacgtagtacgtcgtacgttccgtagtcgtagtacgtaagttaccgtacttacgggtcggccggtaaccgggtaaccttcggtaccttaccgtcccctacgtacccgtacctccggtaaccaacccggtcggtaaccc

SEQ ID NO: 210912 - DNA, 634 bp, Homo sapiens
  misc_feature: GYAE6OF02JSG56.7.78.H01.1.454.CMB.1.raw
  modified_base (256)..(256): a, c, t, g, unknown or other
  misc_feature (256)..(256): n is a, c, g, or t
  modified_base (323)..(323): a, c, t, g, unknown or other
  misc_feature (323)..(323): n is a, c, g, or t
  modified_base (389)..(389): a, c, t, g, unknown or other
  misc_feature (389)..(389): n is a, c, g, or t
  modified_base (548)..(548): a, c, t, g, unknown or other
  misc_feature (548)..(548): n is a, c, g, or t
  modified_base (623)..(623): a, c, t, g, unknown or other
  misc_feature (623)..(623): n is a, c, g, or t
tcagcgtgtctctacacgaccggtgctcgatttagtgtgagtagtttgggtttggggacccgaacaaccacacccctcctaagaagaagcccctagaccacagctccacaccatggactggacctggaggatcctcttcttggtggcagtagcaacaggtgcccactcccaggtgcagctggtacagtcgtgggtctgaattgaggaagcctggggctcgagtgagcgttgccctgcaagccttcgtggacttacntacttcaacttacttattctgtcaatttgggtcgacagggcccctgggacaacggtccttgactacncgttgggatgggatccaacaccggactactacggggaacccccactatcgacccaggtccccttanacgacggggtcgttttacgtcgtccttccagtcggttacaccctgttcggtacgggacggtacttacgtcgtgactacggtatacccgtaaaccttcaaccggtgaccgctacgtcgttactttattacggttacagtacgcgttctgttcgtctaggngtaagttcacgttacgtcgggacgtaacggaccttcggtaccgtcttccgccttacggaccgtaccaccccgtanaccgggtaccc

SEQ ID NO: 210913 - DNA, 600 bp, Homo sapiens
  misc_feature: GYAE6OF02HZQS3.7.78.H01.1.454.CMB.1.raw
  modified_base (475)..(475): a, c, t, g, unknown or other
  misc_feature (475)..(475): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactcgggaaccccactatcgcccaggccttcacgagggcggtttgtcttctccatggacttaccgtctggtcgggacggtcttatctgcaagtataaaccaaccttcaaactgaacactacgtgttaccgttttatttgtaacgngtacgtcgtacgtcgtagtctaggtggtaacttgaccttacgtggggacctaacggggtacccgtggtaccgtacccgttccgttcccgtacgaccgtcccctaccgacccggaacggtaccccg

SEQ ID NO: 210914 - DNA, 592 bp, Homo sapiens
  misc_feature: GYAE6OF02FO2KW.7.78.H01.1.454.CMB.1.raw
  modified_base (345)..(345): a, c, t, g, unknown or other
  misc_feature (345)..(345): n is a, c, g, or t
  modified_base (407)..(407): a, c, t, g, unknown or other
  misc_feature (407)..(407): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccacacggcccctggacaggcctgactacatggatggatcaacaccgacacgtcgggaaccccactancgcccaggtccttcacgagggtcgtttgtcttctccatgactacctctcgtcgggacgtctntctgcatactaaccgtaaccttaccaactcgaacacctactcgtacgtttattttagacgtagagtcgtcgtcgtcgtctaggtgtacgttacgtacgtacgtcggggtaccgaacgggtacccttcgggtaccgtaccgtccgttccgtaccgtacgtccctacccgacccgtacggtaccccg

SEQ ID NO: 210915 - DNA, 939 bp, Homo sapiens
  misc_feature: GYAE6OF02IHXPE.7.78.H01.1.454.CMB.1.raw
  modified_base (245)..(245): a, c, t, g, unknown or other
  misc_feature (245)..(245): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagtatcctcttcttggtggcagtagcaacaggtcgcccactcccaggtgcagctgtacagtctgggtctgaattgaggacgccgtggggctcagtgagtcgttgcctggctagtccttncggatactctcgttacactactttattctgtactaacgttcgggtccgacgtaccggtccccgtaggaccgtaacggtcccttagtactaaccgtaggtacgggactcggtaactaccgaaccgaaccggaacctacccggtaacccgggtaaacccctaccgtacgttaccgaccccgtacggttcccctaaccgtacggtacggggttccgttttcgtacccgtttacctccggtaagttacggttaaccttcccgttaccgggttcgggtacccggggttacgttactttacccgtaccgtaggtaaacccttaccggttaaaaccgtttaaacccgtaaccccgttaacccgtaaaacccgtaccggtaacccgttaaaccctttcgttaacccgggttttttaacggtttttacgttttaaacccgggtacgttaaccggttaccgggttttcccgtaccgggtttccggttaccgttaaccgggttacggttaacggtttaaacccgttaaccgggttaacgtttaccccgggggggttaccgggtaaccccggttaaaccgggggtttaccccggtaacgggttaccccccgttaacccggttaccccgtttaccccgggttaacctaccccgggttaccccccggtttaaacccggacccccggggtaacccggttaacccccggg

SEQ ID NO: 210916 - DNA, 688 bp, Homo sapiens
  misc_feature: GYAE6OF02H786R.7.78.H01.1.454.CMB.1.raw
  modified_base (351)..(351): a, c, t, g, unknown or other
  misc_feature (351)..(351): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactactttattctgtcaagttgggtccgacaggcccctggacaggtccttgacctacatgggatggatcaacaccgacacgtcgggaaccccactancgcccacggcccttcacgagggtcggtttgtcttcctccatggacttacccgtcgttcggtaccggggtacgtctttactccgtcgactaagaacgtaaacccctaaccctttcaaacccttcggaaccgtacctaccgttcgtttaccgtttttaattttacggtaacgtaaggtacgtccgttacgttcgttacgttacgtaaggttggtaacttacgaccgttacggtccggggtacccgtaacggggtaacccccgttggggtaccccttaccgttcccttacccgtaccgtaccggtacccctttaccggaaccccgtaaccgggtaccccc

SEQ ID NO: 210917 - DNA, 676 bp, Homo sapiens
  misc_feature: GYAE6OF02FXBLC.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggagtatcctcttcttggtggcagtagcaacaggtgcccactcccaggtgcagctggtacagtctgggtctgaattgaggaagccgtggggcgtcagtgagcgttgcctgcaagccttctggatacatcttcacttacttattctgtcaattgggtccgacaggcccctggacaaggccttgactacagtgggatggatcaacaccgacacgtacgggaaccccacctatcgcccaggcccttcacgacgggcggtttgtcttctccatcgattacctcgtcggtcgggacgtcttatccgtgcgacgtaactaaaccctaaccctttaccaaccgtaggaacgtaaccacgttacgttacccgtttttaattttttcggaaccgtaggtacggtccggttccgttcgttaggttaccgtaaggtgggttaaattcggtaaccgttacggttcggggacccgtaacgggggtaaccccttacgggtacctacccggttccgtcccgttacgtaacccgtccccttccccggtaaccggtaacgggtaccccg

SEQ ID NO: 210918 - DNA, 678 bp, Homo sapiens
  misc_feature: GYAE6OF02I9GCA.7.78.H01.1.454.CMB.1.raw
  modified_base (338)..(338): a, c, t, g, unknown or other
  misc_feature (338)..(338): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctgggcgtcagtgagcgttgcctgcaagccttacgtggatacatcttcacttacttattctgtcaattgggtccacaggtcccctggacaacggccttacgactacagtcggatggatacaacgaccganacgtcgggaaccccacgtatcgccacggcttcgacgagggtcgtttgtcttctcctagtcgacttacctcgtcggttacgggaccggtacgtttactcgtcgtaccgtaagaccgttaaacctaccttaccaaaccgttcggaaccgtacctacgtgttacccgttttagttttacggacgtaacggacgtccgtttacgtcgttcggtaacgtggttaggtacgttgtaaccgttcgtaccggggtaccgtaaccggggtaacccgtcgggttaccctacccgggtttccctacccggtacggtaccgtacccggtccctaaccggtacccggtacccg

SEQ ID NO: 210919 - DNA, 561 bp, Homo sapiens
  misc_feature: GYAE6OF02FS4GH.7.78.H01.1.454.CMB.1.raw
  modified_base (244)..(244): a, c, t, g, unknown or other
  misc_feature (244)..(244): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
  modified_base (538)..(538): a, c, t, g, unknown or other
  misc_feature (538)..(538): n is a, c, g, or t
tcagcgtgtctctacacgaccggtgctcgatttagtgtgagtagtttgggtttgggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacatcttcactacttattcctgtcaattgggtccgacaggcccctggacaaggccttgactacatgggatggatcaacaccgacactgggaaccccactatgcccaggccttcacagggtcgtttgtcttctcatggatacctctgtcgggacgtcttatcngcagntaacccgacttcaaccttgaacgacacgtgtccgtttattttacgacgtagagtcgtcgttctagtacagtaggtattgacttcgtgggaccagggtaccctggtacctaccgtctcccgtanacggtccctcgaccgagggtccc

SEQ ID NO: 210920 - DNA, 802 bp, Homo sapiens
  misc_feature: GYAE6OF02JRZKL.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttcgtggatacatccttcacttacttattctgtctaagttgggtaccgacacggtccccgttagggaccgtaacggtccttagaaccgtaacgacggtggggtacttacgggaacttaccgaaacccgtaacccggaaccgtaccggttaccggggaaacccccctaaccgttaacgtccgaccccgacgggtacccttaccgaaccggacggggttccgggttttacgttcctttaccgtaccgtaagtccgggttaacttacccgtcgttcgggtaccggggtaccgtcgttttaacgtcgtacgtaccggaagtacctaaacccgttaaccttaccgtaacccgttaaggaacccgtaacccgttaccgtttcgggttaaccccgttttttagttttaccgggttaaccggtacgtaacggttccgttcgttaccgttcgttacgtaaggtcggtaaattcggtaaccgtaggtcgggtacccgtaacgggttacccgtaggtcccgttaccgtacccgtaccgtcgacccgtaccctacccgtaaccgtccgggtacccg

SEQ ID NO: 210921 - DNA, 598 bp, Homo sapiens
  misc_feature: GYAE6OF02F5RL7.7.78.H01.1.454.CMB.1.raw
  modified_base (382)..(382): a, c, t, g, unknown or other
  misc_feature (382)..(382): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacacgtcgggaaccccactactcgcccaggtcccttcacgacgggtcggttttntcttctaccagtcggactacctcgtcggtcggggacgtcttactctgcagactaacctaaccttcaacctgaccgacacgtcgtccgttttatttacgacgagagtcgtacgtctcgtctagtggtaattcgacgtacgtcgggaccgaacgggtaacccttgggtacctacccgtcttaccgtacgaccgtccctacccgaccgacgggtacccc

SEQ ID NO: 210922 - DNA, 989 bp, Homo sapiens
  misc_feature: GYAE6OF02JHJWD.7.78.H01.1.454.CMB.1.raw
tcagcgtgtctctacacgaccggtgctcgatttagtgtgagtagtttgggtttggggacccaacaaccacacccctcctaagaagaagccctagaccacagctccacaccatggactggacctggaggatcctcttcttggtggcagtagcaacaggtgcccactcccaggtgcagctggtacagtctgggtctgaattgaggaagcctggggcgtcagtagcgtcgtcgctgacacgtccttcgtgactacattctactacttacttattcgtacgtactaaggttccggtaccaacggtccggtccccgtaggaaccgaacggttcccttacggtaacctaacgtagggtacgggtagttacggaactaaccaaaccccgacgaaccgtaccggtaacccggaaaccccctaacgttacgtcccggacccggtacggttccccttaaccgaacggggttacggggttttcccggttttacgttcccgtttaccgtacccgtaacggttacgggttaaaccccttcccgtttaccgggttacggggtaccccggggggtactttaccgtttaccgttaccggtacgtaaacccggtaaagttaaaaccccctttaaaacccccgtttaaccccgtttaacccggtaaaaccccgttacgggtaaaacccccgtaaccgtttaacccggtttacccgggttttttaaccgtttttttttaaacggttaccgggaaacccggttacgggtaaccgggttttcccggtttacgtttaccggtttaccggtaaaccggttaaggggtttaacgttaaaccgtttaccgttaacccgggtttacggggtaccccggggtaacccgggttaaacccggggttaacccgtttacgggttacccccggtaaccctttttcccggtaacccccgttacccggttaacccccggaccccttaacccccgggaacccggggttacccggttaaccccgg

SEQ ID NO: 210923 - DNA, 680 bp, Homo sapiens
  misc_feature: GYAE6OF02FPD5J.7.78.H01.1.454.CMB.1.raw
  modified_base (240)..(240): a, c, t, g, unknown or other
  misc_feature (240)..(240): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgagagcctggggctcagtgagcgttgcctgcaagccttcnggatacatcttcactacttattctgtcaagttcgggtcccaacgacggtccccctgggaacaacggtccttgacctacagtgggatggaatccgaacaccgacacgtcgggaacccctactactcgcccaggtcccttacaccgaggggtcgttttacgctttcgtccaagttcggaccttacccgtcgttacggtaccggggtacgtcctttaagtccgttagacctagtaacctaaaccgtaacccttacaacccgttaggaacctacgtacgttccgttacgtttttacgtttttacgaacgtagtacgtcgttcgtccgttagtaccgtagttacggttaagtcgtacgttacggtacgggtaccgtaacggggtaacccttcgggtacccgtaccgttcctcctacgccgtacccctacacccggtacggtcccg

SEQ ID NO: 210924 - DNA, 679 bp, Homo sapiens
  misc_feature: GYAE6OF02ISUSB.7.78.H01.1.454.CMB.1.raw
tcagcgtgtctctacacgaccggtgctcgatttagtgtgagtagtttgggtttggggacccaacaaccacacccctctaagaagaagccctagaccacagctccacacatggactggacctggaggatcctcttcttggtggcagtagcaactaggtcgcccactcccaggtgcagctggtacagtctgggtctgaattgaggaagccgtggggctcgagtgagtcgttcggcctgacaggtccttgtggactacattcttccacgtacttattctgtcaagttgggtccacgcgccctaggacgagtccgtacgtactagtagcgggatacggtacaccaaacgccgacgtaaccgtcggaaccccctatacgccgtaccgacgtcttaccgaggtacggggtccgttttgtactccgtacgtacgtacggtactaccgtctcggggtcggtacgtcgttatcgtacgacgtaacgtactaacgttacctactacgtacacggtactacgttccgtacgttttatcggtaaggaacgtggtacctttcgtcgtacgtgtacggtaagtacgttcgtacggttaggaccgggacgtaacggggacccctttagggaaccctaccggtttcctacccgtaccggtctaaaccccggtccgtaaccgggtacccgtcccgg

SEQ ID NO: 210925 - DNA, 665 bp, Homo sapiens
  misc_feature: GYAE6OF02GO1T8.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagtccttctggatacatcttcacttacttattctgtactaagttgggtccacgacggcccctggacacggtccttgactacagtgggatggaactacaacaccgacacgtaccggaacccctcgtacgcgccgtacgtccttacgacggtacgggtcgttttctcttaccgtacgaacgttcggtacttacccgtcgttacgggtaccggggtacgttcttacgtccgtaggacctaacggtaaactaaaccccgttacctaccgaaccgtacggtaaccaccttacgttaccgtttactttttaggtttaccggaacgtagtccggtcgttccgtgtcgtacgtaggtgtaactgtacgtacggtacgggaccgtacggtaccgtcgtaccgtcctcgttaccgcaccgtcccacgacccgaccggtccg

SEQ ID NO: 210926 - DNA, 941 bp, Homo sapiens
  misc_feature: GYAE6OF02G6ED2.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgagaagcctggggcgtcagtgagcgttgcctgcagccttctggatacatcttcactattattctgtacattgggtccacacggcccctggacaacggtccttagactacagtgggatggataccaaaccaccgacgtaaccgacgggaacccccaccttaagtccgcccgaacggtcccttacgaccggtacggggttaccgggtttttcgtacccgttttccgttaccgtaaggttacggtaacctttaaccccgtttccgggtttaccggtttacccgggggggaaccggtttccttttaaacgttcccgttacggtaccttaaacgggtaaaccttaaaccccgttaaaaccccgttttacccgtaaacccgttaacgggtaaaccccgtaacccgttaaccgttacgggtttttaaccccggtttttttaaacgttttttttaacggggtaacccgttaaacgggtaaccggtttacccgggtttacccgggtttcccgtttacgggttaccgttaaacggggtttacgggtaaaaccgtttttcgggtaaacccggtttaccggggttaccggggggtaaccccgttaaacccggggggttaaacccccggttttacggggttaaccccgttaacccccccggttttaccgtttacccccggttacccgtaacccgggttacccccccgttaaccccccggtaaacccgggttaaccccggggtaaccccccccgg

SEQ ID NO: 210927 - DNA, 742 bp, Homo sapiens
  misc_feature: GYAE6OF02HZOP5.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcaggtgagtcgttgcctgcaagccttctggatacattcttacacttacttattctgtactaagttcgggtccgacacggcccctaggacaacggtccttcgactacagtgggatggactcaacgaccgtacaccgtacggaacccctactacgtccgcccgtacggtcccttacaaccggtacgggttcggtttacgttcctttaccgtacccgtaagttacgggtaccttacccgttacgtccggtaccgggggtaccggttctttaaccggtccgttacgtacgaacggtaaacttaaaccccgtaacccttaccgaaaccccgttagaaacccgtacaaacccggtttcgttaaccgttttttagttttacggttacggtaaggtaccggttcggtttaccgttcgttacggttacgtaggttagtaacgtttcgacgttacggtcggggtaccgaaccggtaccgtcggtaccttacccgtcgttaccctacgtaccgtacccacccgacgaccggtccc

SEQ ID NO: 210928 - DNA, 724 bp, Homo sapiens
  misc_feature: GYAE6OF02JK8WI.7.78.H01.1.454.CMB.1.raw
  modified_base (218)..(218): a, c, t, g, unknown or other
  misc_feature (218)..(218): n is a, c, g, or t
tcagcgtgtctctacacgaccggtgctcgatttagtgtgagtagtttgggtttggggtacccgaacaaccacacccctcctaagaagaagccctagaccacagctccacaccatggactggacctggagatcctcttcttggtggcagtagcaacaggtgcccactcccaggtgcagctggtacagtctgggtctgaattgaggagccgtggggcgtnagtgagcgttgcctgcaagccttctggatacgattcttcacttattattctgtctaagttgggtccgacacggcccctggacaaggccttggacctacacgtggggtactgggattaccgaaacgtaccgacgaccgttacggggaaccccctacgtaacgtcggacccacgggtacccttaccgaacgacgggggtacgtttttcggtaccttttcggtcccaacgttacgggtaaccttaccccgttacgttcgggttacccgggggtacggttaccgtttacgtccgttacggacgtaaccgtaacgtaaaccctaaccccgttactaacccgtacggaacgtaacctaccgtcgttccgtttttaagtttcggttacgacggtacgtccggtcgtcgttgtacctgggaacggttaagtgtacctacgggtacgggtcctaacggggtaacctggtccctaacgttcctacgtccaccggcctaacccgacgtaccgggccc

SEQ ID NO: 210929 - DNA, 599 bp, Homo sapiens
  misc_feature: GYAE6OF02FJRCK.7.78.H01.1.454.CMB.1.raw
  modified_base (325)..(325): a, c, t, g, unknown or other
  misc_feature (325)..(325): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtcccacaggcccctggacaaggccttgactacagtgggatggatcaacnccgacacgtcgggaacccccacctatcgcccaggtccttcgacggggtcgttttgcttctccatcggataccctctggtcgggacggtcttatctgctagtataacccaacttccaacctgaccgtacactcgtccgttttattttcgacgtagtacggcgttcgttctgtactagtggtaattgacttacgtcggggccaacggggtaccctggtcccgtaccgttcctacccgtcgacgtacccctccgaacccgtacgggccccttaccgg

SEQ ID NO: 210930 - DNA, 784 bp, Homo sapiens
  misc_feature: GYAE6OF02GZZJQ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtcgtgggtctgaattggaggaagccgtggggcgtcagtgagcgttgcctgcaacgtccttctggatacattcttacacttacttattctgtctaagttcgggtaccgacgacgggcccctaggaccgtaacggtcccttacggaaccctaacgtaggtcgggtaagtagggaactaccaaaccgaacccggtaaccaaccggtacccgggaaacccccctaccgtaacgtccgaccccgtaacggtacccttacgaccggtaacggggttccggttttacgttcctttccgtaccgtagttcggtacttacccgtcgttcgggtaccgggacgttcttacgtcgtgaccgtaagtaaccgtaacccttaaccgttaccaacccgtacggaaccgtacctacgttcgtttaccgtttttagttttaccggtacggtaggtacggttccgttcgttccgttagtacgtaagggttacgtaagttcgtaaccgttcgggtacggggtacccggtaacgggtaaccccgttgggtaccctcccggttcccgtacccgtaccggtaccgtaccccgtaccggtaacccggtacccggtccccg

SEQ ID NO: 210931 - DNA, 657 bp, Homo sapiens
  misc_feature: GYAE6OF02INDUB.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagtccttctggatacatcttcactacttattctgtctaattgggtccacacggcccctaggacaacggccttagactacagtgggatggatacaacacgacacgtacggaaccccactatcgacccaggtccttacgacgacgggtcgtttgtcttctcctagtcgtactaccgtcgttcgggtcgggtacgtcctttaagtcgtacgacgtaacgtaacctaaaccctaacccttaccgaaaccgtagtacccgtaactaccgttacgttccgttttttaagttttcgacgtaggtacgtccggttactcgttagtctaggtacggttaacttcgaccgttacgtcgggtaccgaacggtaccgtcgggtacctccgtacgtcccgtacgtacgtccctacccggaccgaacggtaccccg

SEQ ID NO: 210932 - DNA, 801 bp, Homo sapiens
  misc_feature: GYAE6OF02JOGKV.7.78.H01.1.454.CMB.1.raw
  modified_base (238)..(238): a, c, t, g, unknown or other
  misc_feature (238)..(238): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgaccgnacgtccgttcgtggatactactcttacctactacttacttctcgtactacgtcggtccgaccgtaccggtaccccgtacggtaacggtaaccggtaccgttacgtaaccgtaaccgtaacggtacgggtaggtacggtacgtacctaaccgaaccgaaccgtaaccgtaccggtaaccccgtaacccgtaacgtaccgacccgtaccggtacccgttaccgtaccggtacgggtacggtttacggttaccgttaccgttaccgtacgtacggtaccgtaccgttaccgtacggtacgggtaccggtacgttacgttacgtacgtacgtaacgtaacgtaaacccgtaaaccctaaccgtaaccgtaacgtaaccgtaaccgtaccgttacgttaccgtttaacgttttacgttaacgtaacggtacgtaccgttacgttacgttacgttacgtacggttacgtacgttacgtacgtacggtacgggtaccggtaccggtaccggtaccggtaccgtaccgtaccgtaccgtaccgtaccgtacccgtacccgtaccgtaccgg

SEQ ID NO: 210933 - DNA, 613 bp, Homo sapiens
  misc_feature: GYAE6OF02FZ8IK.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttctggatacatcttcactacttattctgtcaattgggtccgacacggcccctggacaggccttgactacatgggatggatcaacaccgacaccgtcgggaaccccacctatcgcccaggccttcgacggggtcggtttgtcttctccagtcgacttacctcgtcggtccgggacgtcttatcgttgcagaactaaccaaccttaccaacctcgaacgacacttcgtaccgtttattttcgtacgtagacgtcgtcgtctgtcgtagtcggtaattcgacgtacgtcggggccgtaacgggtaacccgtggtaccctacccggttcctcccgtacgaccgtcccttacccgaccggtaaccgggccctaacccgg

SEQ ID NO: 210934 - DNA, 807 bp, Homo sapiens
  misc_feature: GYAE6OF02IJAD8.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaatgaggagccgtggggcgtcagtgagcgttgcctgacaagtccttactgggtatacattcttcaacttacttattccgttagactaaagtttcgggtccaacgaccgggtccccctagggaaccgtaacggtaccgtttacggaacttaaccgtaggtagggtacgtggtaacctaccaaaccgtaacccggacgtaacggtacccggaaaccccctaacttaacgtccggaccaccggtacccttacgaacggtaggggttccgggttttctacctttaccgtaccgtacggtaacggtaccttcccgttagtaccgggggtaccgggtaaccgttacgtttacgttcgaacgtcgtaaacggtaaaccctaaacccgttaacccttaaccgaaccttacgggaaacctacgttacccgttaccgtttaaccgtttttttagttaccgggtaaacgtcggtaaccggttccgttccgttacgttacgcggttaaggtgtaaacgttcgaccttcggggttacgacccggaaacggttacccgttcgtaaccccgtccgtttaaccgcccttaacggactacccctaacgggtacccgtacggtaccccg

SEQ ID NO: 210935 - DNA, 549 bp, Homo sapiens
  misc_feature: GYAE6OF02I7DMF.7.78.H01.1.454.CMB.1.raw
  modified_base (347)..(347): a, c, t, g, unknown or other
  misc_feature (347)..(347): n is a, c, g, or t
  modified_base (411)..(411): a, c, t, g, unknown or other
  misc_feature (411)..(411): n is a, c, g, or t
  modified_base (498)..(498): a, c, t, g, unknown or other
  misc_feature (498)..(498): n is a, c, g, or t
tcagcgtgtctctacacgaccggtgctcgatttagtgtgagtagtttgggtttggggacccaacaaccacacccatcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccacaggcccctggacaaggccttgactacatgggatggatcaaacaccgacacgtgggaaccccactancgcccaggcctttacgacaggggtcggtttgtcttctcatggatacctctgtcgggacgcttanctgcagataaccaaccttcaacctgacgtacactgtacctttattttcgtaacgagtagtcgtcgtctgtcagtgaattgactacgngggcacggaacctggtactacgtctccgtcgactcccgtcaccgtaacggg

SEQ ID NO: 210936 - DNA, 724 bp, Homo sapiens
  misc_feature: GYAE6OF02GYB4X.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattggagagcgtggggcgtcagtgagtcgttgcctgcaacgtcccttcgtggatacattcttcacttacttattctgtactaagttcggggtaccgacgacggtccccgtagggaacaaggtccttgacctacaagtgggatcggataccgaacgaccgtacaccgtacgggaacccctaccgtatcgacccgacggtccttaccgacgtacggggttccggtttacgttctttaccgtacctacgttacgtaaccgttaccctcggtacgggttacccgggggacgttcctttaagtccttggactacggttaaccgtaaaccctaacccgttacccgaaacctccggtaacgacctacgtacgttcccgtttttattttacggaacgtaggtaccggtcgttacgtcttacggtctaagggttcgtaacgttagtacgtaccggtacgggccgtaaaccgggtccctacggtacccgtaccgttctaccggtacgtaccacccgtacccgtacggaaccgtcccg

SEQ ID NO: 210937 - DNA, 745 bp, Homo sapiens
  misc_feature: GYAE6OF02INMSG.7.78.H01.1.454.CMB.1.raw
tcagcgtgtctctacacgaccggtgctcgatttagtgtgagtagtttgggtttggggaccccaacaaccacacccctcctaagaagaagcccctagaccacagctccacaccatggactggacctgaggatcctcttcttggtggcagtagctaacaggtgcccaactcccaggtgacagtctggtacagtctggtctgtattgaggaagccgtgggctcagtgagtcgttgcctgacaacgtccttcgtggaactactcgttccttctaccttacttactttcgtgtaccgtaagtttcggggtaccgaacgaccgggtcccccgtaggaaccgtaacggtcccgttagaacctaacgagtggggagtggactaccgaaaccgaccgacaaccgttacgggaaacccccaccgtaacgtccgacccgacggtcccctttaccgaacggtaggggtccggttttacgtccgtttaccgttcccgtaagtcggtaactttacccgtcgttacgggtccgggtaacggtctttacgtcgtacgacgtaagtaaccgtaaccctaaccttaccaaccgttccgaacgtaccaccgtttcgttaccgttttacgttttacgtacgtagtacgtacgttcgtacgttcgtagtacgtagtaattgaccttacggtgggaccgtaacgggtaccctagggtcctaccggttcctaccgtcgaccgtaccctaccgtaccgaccggtacccg

SEQ ID NO: 210938 - DNA, 730 bp, Homo sapiens
  misc_feature: GYAE6OF02JROT0.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcagtgagcgttgcctgcaagtccttgtggatacgatcttcactacttattctgtctaagtgggtccgacgcggccccgtaggacacgggtccttgacttacgagtgggtatggaactccaaacaccgactacggtaccgggtaacccccacgtaactcggacccacggccctttacgaaccggtcggggtacggttttcggtccttacgtcctagttcgggtaactaccgttcgtcggttaccggggtacgtctttatcgtagacgacgtaaccgtaaacccgtaacctttaccgaacctaccggaaccgtaccgtacgttacggttaccgtttttacgttttacggttaacggacggtacggtaccggtttcgttacgtttacggtacgtaaggttacggtaagtttaccgacggttaccggtacggggttaccggaacgggttaaccctcgggttacctacccggttctcccgtaacgccgtaccctaccggtaacccgtcgggtaacccg

SEQ ID NO: 210939 - DNA, 685 bp, Homo sapiens
  misc_feature: GYAE6OF02HLR80.7.78.H01.1.454.CMB.1.raw
  modified_base (312)..(312): a, c, t, g, unknown or other
  misc_feature (312)..(312): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttcgtggatacatcttcactacttattctgtcaattcgggtccacacggccctggacaggtccttgactacngtgggatggactcaacaccgacacgtacgggaaccccacgtacgtcgccgacggtcctcgacgacggggtcgtttacgtcttctctagtcggacttacctcgttcggtacggggtaccgttacttagtctcggacgtaacgtacttaaaccctaaccttacgaacccgttaggaacctactaccgttcgttacctttttagttttacggtacgaggtacggtcgtttcgtacgttcgtaccgtaggttacggtaacgttacgaaccgttacgggtcgggggacccgtacggggtaaccccgtttgggtaacccacccggttccgttcccggtaccaccggtaccccttaccggacccggttaacggggtcccc

SEQ ID NO: 210940 - DNA, 571 bp, Homo sapiens
  misc_feature: GYAE6OF02FWFJL.7.78.H01.1.454.CMB.1.raw
  modified_base (375)..(375): a, c, t, g, unknown or other
  misc_feature (375)..(375): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcattggtccgacaggcccctggacaaggccttgactacatgggatggatcaacaccgacacgtcgggaaccccacctatcgcccaggccttcaccagggcggtttntcttctccatggactacctctggtcggacgtcttatcgtgcagactaaccaaccttcaaacctgaaccgacacttcgtccgttttattttcgtaacgtagacgtcgtcgttctgttcagtggaattgacttacgtcgggccaagggtaccctggtacctaccgtcctcctcgacgtccctccgaccgacggtcccc

SEQ ID NO: 210941 - DNA, 735 bp, Homo sapiens
  misc_feature: GYAE6OF02J0OLS.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttctggatacatcttcactacttattctgtctaattgggtcctacacggccccgttaggaccaaggcccttcggaactaccgaatcggggatcggtatccgaaacaccggtacacgtacgggaaccccctacgtacgtcgacccgaacggtccttaccgacgacggggtcgtttcgttcgttactccgattggactaccgttcgtacggtcggggaccgtacgttagtctggactagtaaccttaaccctaaccgtttaccaaccggttacgtaacggaaccttaacgtccggttaacgttttacgttttacggttaaccggtagtacgttcggtttaaccgtgttacgtacgttacggttacggtaaacgttcggtaaccgtttcggacggggtaacccgtaacggggtaaccccgtttcgggcccttaacccggtcctttaacccggtctaaaccgggttccccgtaacccgtaacccgtaacgggttacccccg

SEQ ID NO: 210942 - DNA, 649 bp, Homo sapiens
  misc_feature: GYAE6OF02JJP7Q.7.78.H01.1.454.CMB.1.raw
  modified_base (240)..(240): a, c, t, g, unknown or other
  misc_feature (240)..(240): n is a, c, g, or t
  modified_base (446)..(446): a, c, t, g, unknown or other
  misc_feature (446)..(446): n is a, c, g, or t
tcagcgtgtctctacacgaccggtgctcgatttagtgtgagtagtttgggtttggggacccaacaaccacacccctcctaagaagaagccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttntggatacatctcactacttattctgtcaagttgggtaccacacggcccctaggacaagggtccttgactacagtgggactggatcaacaccgacgacgtacgggaaccccactagtcgaccacggtcccttacacgtacgggtcgtttagtaccttctcgaagtgacgttacctcggtacgtcgggacgtcttagtcgtgacgtanacctaaaccgtaacctcaacgtagacgacctaatcgtaaccgttttatttacggacgtagtacgtccggttacgtcgttacgtacgtaggtacgtaacgttcgaacgttccggtaggggtacccgtaaccgggtaccttagggtaccctaaccgttaccttccgtaccggtacgtacccgtaccgtacccgtaacgggtcccc

SEQ ID NO: 210943 - DNA, 711 bp, Homo sapiens
  misc_feature: GYAE6OF02JW7FV.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcagtgagcgttgcctggaccaagccttcgtcggatactatcgttcacctacctttattcctgtctaagttcgggtaccacgacggccccgtaggacgaacggtccttcgaacgtacgagttgggatgggtactacaacgacccgacgtacgtcggggaaacccctacgtaacgtcgacccgaaggcccttacgacgtacgggtcggttttcgtcttccgtccaagttcgggtaactaccggtccgtcgggtaccgggtcgtaccgttatccgtagacgtaagtaacctaacccttacgtacctaccgtggaacaccgtacgtcgtttacgttttactttacggacgtaacgtccggtacgtccgttacggtcgttaacgtaggttagtaccgttacgacgtttacgggacgggtaccgaacggttacccgttaggtccccgtaacggttcctaacgtcggtaccttaccggacccgttaccggaaccggtcccg

SEQ ID NO: 210944 - DNA, 662 bp, Homo sapiens
  misc_feature: GYAE6OF02GK9GA.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacatcttcacttacttattctgtctaagttcgggtaccgacacggcccctaggacgaacggtccttagactacagtggagtggactcaacgaccgacacgtacggaaccccactatcgcccgacggccttcacgacgggtcggtttacgtctttctcgagtcggtactaccgttcgtcgggtaccgggtcgtcgtttacgtcgtgtacgaagtaacctaaaccgtaacccttacaacccgtagaccgtactacgttacgttaccgttttacgttttacggtaacgtaggtacgtcgttacgtcgttcgtagtacgtagtagtagtaccgttacggtcggtaccggtaacggtacccgtgggtaccctaccgttcgtcccgtcgtaccgtcccctaccgaccggaccggtacccg

SEQ ID NO: 210945 - DNA, 788 bp, Homo sapiens
  misc_feature: GYAE6OF02G5LMN.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtcgcccactcccaggtgcagctggtacagtctgggtctgaattggaggaagccgtggggctcaggtgagcgttgcctgcaagtccttcgtggatacatcttacacttacttattctgtctaagttcgggtaccacgtacggcccctggaacgaacggtccttagacctacgacgtgggtatggactacaaccgaccgactaccgacggaaccccctacgtagaccgcccacggtccttacgaccgtgggtcgttttacgtccttccgtactagtcggtacttacccgtcggtacgggtaccggggtaccgtaccgttttagtccgtacggtaccgaacgttaaacctaaaccccgttaaacccgttaaccgtaaacccttacggtaacccggtaacccttacccggtttaaccgtttaccggttttttactttttaacgggtaacccgtaggttaaccggttccgttacccgtttacgaccggttttaacgaacgggttacgtttaaacgtacgttaaccggttacgggtacccggggtaccgtaaaccgggtacccggtttcggtaaccccgtccgttacccgtccgtacggacccgttcccgtaccccggaacggtaccggtacccccg

SEQ ID NO: 210946 - DNA, 620 bp, Homo sapiens
  misc_feature: GYAE6OF02JFZYS.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacacggcccctggacaaggccttgactacatgggatggatcaacaccgacactcgggaaccccactatcgcccaggccttcacagggtcggtttgtcttctccatggactaccctcgtcggtcgggacgtctttatctagcaagtaactaacctaccttaccaacctgaaccgcacgtcgtccttttattttcgacgagtacgtccgttcgttcgtgtcgtaggttggtaaattgaaccgttcggtacggggaccctaaacggggtacccgtcgggttaccctaccgttccgtcccgtaccgaccggttccctacccgtaccggtaccggtacccccgg

SEQ ID NO: 210947 - DNA, 645 bp, Homo sapiens
  misc_feature: GYAE6OF02JUURY.7.78.H01.1.454.CMB.1.raw
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (314)..(314): a, c, t, g, unknown or other
  misc_feature (314)..(314): n is a, c, g, or t
  modified_base (466)..(466): a, c, t, g, unknown or other
  misc_feature (466)..(466): n is a, c, g, or t
  modified_base (523)..(523): a, c, t, g, unknown or other
  misc_feature (523)..(523): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacntctcactacttattctgtcaagttggaccacacggcccctggacaggccttgactacatggganggtactcaactaccgacacctacgggaacccctctagtcgcccaggccttacacgtacgggtcgtttcgttctcgtccaagtcgtactaccctggtcggtcgggacgtacttacgccgttgactagaccttaacccgtacttaccgtaaccnggtaccgtaacctaccgtcgggttaacctttttaggttttaccgacgggttaaccgnggtacccgttcggttacgtacgttacgtacggttagtagttacgactccggtaggggaccctaacggggaccttcggtaccgtccgttactccgtcgacgtcccacggtacccgaggccccg

SEQ ID NO: 210948 - DNA, 665 bp, Homo sapiens
  misc_feature: GYAE6OF02JZDJV.7.78.H01.1.454.CMB.1.raw
  modified_base (237)..(237): a, c, t, g, unknown or other
  misc_feature (237)..(237): n is a, c, g, or t
  modified_base (383)..(383): a, c, t, g, unknown or other
  misc_feature (383)..(383): n is a, c, g, or t
  modified_base (594)..(594): a, c, t, g, unknown or other
  misc_feature (594)..(594): n is a, c, g, or t
  modified_base (620)..(620): a, c, t, g, unknown or other
  misc_feature (620)..(620): n is a, c, g, or t
  modified_base (628)..(628): a, c, t, g, unknown or other
  misc_feature (628)..(628): n is a, c, g, or t
  modified_base (635)..(635): a, c, t, g, unknown or other
  misc_feature (635)..(635): n is a, c, g, or t
tcagcgtgtctctacacgaccggtgctcgatttagtgtgagtagtttgggtttggggtacccgaacaaccacacccctcctaagaagaagccctagaccacagctccacaccatggactggacctggaggatcctcttcttggtggcagtagcaacaggtgccactccaggtgcagctggtacagtctgggtctgaattgagagctggggctcagtgagcgttgcctgcaagccttntcggatacgatcttcacttacttattctgtctaagttcgggtaccgacgaacggtcccctggactaaggtccttagaactacgaagttgggaattcgggattaccaaaccgaccgtaacgacgtaccgggaaaccccctaacgtanccgacccgaggtcccttcggacgggggtccgttttagcctttaccacgtacgtcggacttaccctgtcggttaccggggacgttaccgttatcgtgaccgtagacttaaacccgtactcgaaacctggaacctacgtacgtgttaccgtttttaagttgtaaccgtaagtcgtcgttcctggtaactcgtagttcgacgttgaaccgtcgnggggtaccaacgggtactcggtaccncgttaccncggtacncggtcccctaacgcccggtaacgcctaccg

SEQ ID NO: 210949 - DNA, 635 bp, Homo sapiens
  misc_feature: GYAE6OF02JVC8E.7.78.H01.1.454.CMB.1.raw
  modified_base (404)..(404): a, c, t, g, unknown or other
  misc_feature (404)..(404): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttctggatacatcttcacttactttattctgtctaattcggggtccgacacggccccttggaaccaacgggccttaggacctacagttgggactggatcaacaccgacacgtacggaacccactatcgccacggtccttcgaacgtagggtccgtttgtcctttcnccgtagtcggactacccgtcgtcggtcgggtacggtcttacgtctgacagtaactaacctacctcgaaccgtcgacgtacgctacgttacctttagttttacgacggagtacgtcgttaccgttctcggtactaggtagtattcgacttcggtcgggaccgtaacgggtccgtacggtccgtaccgttccgtaccgttacgtagtaccccgtccgaaccggtacgtacccg

SEQ ID NO: 210950 - DNA, 808 bp, Homo sapiens
  misc_feature: GYAE6OF02JB47Z.7.78.H01.1.454.CMB.1.raw
  modified_base (637)..(637): a, c, t, g, unknown or other
  misc_feature (637)..(637): n is a, c, g, or t
  modified_base (762)..(762): a, c, t, g, unknown or other
  misc_feature (762)..(762): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaaattgaggaagcctggggcgtcagtgagcgttgcctgcaagtccttctggtatacgattctcacttactattctgttcaagtttcgggtccgtacgaggtccccctggaccgtaaggtcccttagacttacacgtaggggagtggtactacaacgaccgacgaccgtacgggaccccaactagtcgcccgacggtacccttcgaaccgtaggggtccggttttgttacccgtttacttcccgtagttacggtaaccttaaccgttcgtacggtacggggtacgggtacccttttacgtccgttcgacgttaaacgaacgttaaaccccgttaaaccttcccgtaaaccctcggtaaaccggactaaaccgttccggtttaacccgttttttaacgtttttagtaaaccggtacgggttaacgttcccggttaaccgtttntttacgggttaccgtaaaggtcgttaaacgttttcggaaacccgttacgggttaccgggggtacccgtaaaccgggggttaacccctttaggggtaacccttacccgggtttaccgtttaacccnccgtttaaacggtaccccgtaccgaaccccgtaggggtaacccccg

SEQ ID NO: 210951 - DNA, 727 bp, Homo sapiens
  misc_feature: GYAE6OF02HKPNS.7.78.H01.1.454.CMB.1.raw
  modified_base (243)..(243): a, c, t, g, unknown or other
  misc_feature (243)..(243): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcagccttcnggatacatcttcacttacttattctgtacaagttcgggtaccgacacggcccctaggacaaggtccttagactacgagtgggatggatcgaacaccgacacgtacggaaccccactactcgaccacggtccttacgacgacgggttcggttttacgtccttctaccgtagttcggaacttacccgtcgtcgggttaccggggtacggtcttttacgtccgttaggacctaaggtaaccttaaacccgttaacccttaccgtaaaccgtacgaaacggtaccctacgtttacggtttaccgtttttttaacgtttttacggtaacggtacggtacggttaccgtttccgtttcgttcggttacgtagggttaggtaagtttaccgtacgttaccgggtcggggtaacccgaacgggtaccccgttcggaccgttacccgttcttcccgtacgaccgtcccgttacccgaccggtaaccggtcccg

SEQ ID NO: 210952 - DNA, 703 bp, Homo sapiens
  misc_feature: GYAE6OF02HFCSO.7.78.H01.1.454.CMB.1.raw
  modified_base (241)..(241): a, c, t, g, unknown or other
  misc_feature (241)..(241): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcagccttcnggatacatcttcactacttattctgtcaattcgggtccgacacggcccctggacaaggccttgactacatgggatggactcaacaccgacacgtacgggaacccccactatcgacccaggtccttcacgagggtcggtttgtctttctacctactcggactacccttcgtcggtccggggaccgttctttacgttctcggtactaaggtaaccttaaaacccgtaaccctttaccaaaccttacggaaccgtaacctaccgttacgttaccgttttttaacgtttttggtaacggtagtacgttccgtttaccgtcgttcggtcttaagggtcgtaacgtttacggtaccgttaccggttcgggggtacccgtaacgggtaaccccggttacgggttacccacccggtttcctttacccgacccgtacggtcccctacccgaacccggtacgggtacccccg

SEQ ID NO: 210953 - DNA, 802 bp, Homo sapiens
  misc_feature: GYAE6OF02I6KHR.7.78.H01.1.454.CMB.1.raw
  modified_base (176)..(176): a, c, t, g, unknown or other
  misc_feature (176)..(176): n is a, c, g, or t
tcagcgtgtctctacacgaccggtgctcgatttagtgtgagtagtttgggtttggggacccaacgaaccacacccctcctaagaagaagcccctagaccacagctccacaccatggaactggacctggagatcctcttctggtggcagtagcaacaggtgcccacgtcccaggtcncagctggtacagttctgggtactgaattgaggaagccgtggggactcaggtgacgtcgttgcctgcaagccttctggactacgatcttcgacttcttatctagtctaagttggttccgacacggtccccctggaaccaacgggtccctttacggacccttacgaaggtcggggattgggaacttacgaaccgaccgtaactaccgtacgggaaccccacgtactcgaccccaacggtcccttacgaaccgtacggggtacggttttcgtaccgtttacctaccgtaagttcgggtaacttacccgtccggttacgggtaccggggtaaccggtaccctttaacggttccctacggtaccgtaaggttaaccttaaaacccgtaaccctttaccgtaaaccgttccggtaaacgacccttaaccgttcggttaccccgttttttaagttttaccgggaccgtaacggttacggtacccgtttcgttcgtacgttacgtacggtacgtaaggttccacgttaccggtcgggtacccgtaacggggtaaccccttgggtaccttacccggttaccttaccggtccgtaacccgggtacccctacccggtaaacccgtcgggtaaccccc

SEQ ID NO: 210954 - DNA, 609 bp, Homo sapiens
  misc_feature: GYAE6OF02FOBPV.7.78.H01.1.454.CMB.1.raw
  modified_base (243)..(243): a, c, t, g, unknown or other
  misc_feature (243)..(243): n is a, c, g, or t
  modified_base (284)..(284): a, c, t, g, unknown or other
  misc_feature (284)..(284): n is a, c, g, or t
  modified_base (329)..(329): a, c, t, g, unknown or other
  misc_feature (329)..(329): n is a, c, g, or t
  modified_base (535)..(535): a, c, t, g, unknown or other
  misc_feature (535)..(535): n is a, c, g, or t
  modified_base (586)..(586): a, c, t, g, unknown or other
  misc_feature (586)..(586): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtcctgggtctgaattgagaagcctggggctcagtgagtcgttgcctgcaagcccttntggatacatcttcactacttattctgtcaattgggtccacnggcccctggacaaggtccttgactacagtgggatggactcaaacnccgacacgtacgggaacccccactaactcgccccaggtcccttcgaccgtaggggtccggttttgttccttcgtccagttacgggacttccttcgtaggtccggggacgttctactcgtgcgaagataaaccctaccttccgaccttgaaccactcttcgttacccgtttttattttcggaacgtagtagtcgtcgtctgttacgngttagaagttcgacgtacgtcggggaccacgggtacctcggtccacgttcnctcaccgtcctccacgacgtccg

SEQ ID NO: 210955 - DNA, 690 bp, Homo sapiens
  misc_feature: GYAE6OF02I252F.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtaccgacacggcccctggacaaggccttgactacagtgggataggatacaaccgaccgaccacgtacgggaaccccacctatcgccacgcctacgacgacgggtcgtttgtcttcctcagtcgactacctcgttacggtcgggtacggtcttactcgtgacagtaactaaccctaaacttaccaacctacgaaccgtacacttacgttacgttttatttttacgggtaacgtacggtagtccgttacgttcgttacgtacgtaggttacgggtaactttacgtaccgttacggtaccggggggtaacccggtaacgggggtaaaccccgttcgggttaccccgtaacccggtttcccgttcccgtaccgtacccggtaccccttacccgaacccgggtaacccgggtaccccg

SEQ ID NO: 210956 - DNA, 757 bp, Homo sapiens
  misc_feature: GYAE6OF02J3RG6.7.78.H01.1.454.CMB.1.raw
  modified_base (174)..(174): a, c, t, g, unknown or other
  misc_feature (174)..(174): n is a, c, g, or t
  modified_base (186)..(186): a, c, t, g, unknown or other
  misc_feature (186)..(186): n is a, c, g, or t
  modified_base (217)..(217): a, c, t, g, unknown or other
  misc_feature (217)..(217): n is a, c, g, or t
  modified_base (244)..(244): a, c, t, g, unknown or other
  misc_feature (244)..(244): n is a, c, g, or t
  modified_base (275)..(275): a, c, t, g, unknown or other
  misc_feature (275)..(275): n is a, c, g, or t
  modified_base (490)..(490): a, c, t, g, unknown or other
  misc_feature (490)..(490): n is a, c, g, or t
  modified_base (641)..(641): a, c, t, g, unknown or other
  misc_feature (641)..(641): n is a, c, g, or t
tcagcgtgtctctacacgaccggtgctcgatttagtgtgagtagtttgggtttggggacccaacaaccacacccctcctaagaagaagccctagaccacagctccacaccatggactggacctggaggatcctcttcttggtggcagtagcaacaggtcgcccactcccaggtncgagctggtacngtcgtggtctgaattgagagccgtggggctnagtgagtcgttgcctgcacgtccttcnggactacacttcgttctacttacttattccngtactagttccgggacctaccgcggtcccgtaggacgacggttacctcgaactacgagtacgggtactaggactaccgaaacgacccggtacaccgtacccggaaccccctacgttagccgacccgacgtcccgttaaacgcggtaggttccggtttctacccgttcaccgtagtacgtacctacccgtttgcgggttaccggacgttactcgtntaacggactaacggtaacccttaaccgtacccctaagtaacccgttacgacccgtaaaccttccggttagtttacccgttttaacgtttaggtaaccgtagtacccggttccgttcgttacggtattaccgggtacttaggaaaccgtttnaaaccccgggtttgccggggtaaccccgtaacggttccctacggtaccccggttaccgttccgtaacccgtttcggaccccgtcccgtaaccgtaccccgggtccgttaaccccgg

SEQ ID NO: 210957 - DNA, 678 bp, Homo sapiens
  misc_feature: GYAE6OF02I5B1E.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccatcccaggtgcagctggtacagtctgggtctgaattgagagcctggggctcagtgagcgttgcctgcaagccttctggatacatcttcacttacttattctgtcaattggtccgacaggcccctggacaaggccttgactacagtgggatggatcaacacgaacacgtacgggaaccccacgtatcgccgaacggccttacacgacgggtcggtttcgtacgtttcctacgagtacggtacttacccgtcgtacggtccggggtacggtctttacgtccgttacgctaacggtaactaaaccccgtaacctttaccaaacccgttgaaacccgtactaccgttcgttaccgtttttacttttacggtacgtaacgtacggtccgtcgtacgttgtaccgaggtacgtaattcggacttacgcggggtaccctacggggtaacccttcgggtaacctaccggttccctttccgtaccggaccggttccctaccccgtaacggtacccgggtacccc

SEQ ID NO: 210958 - DNA, 549 bp, Homo sapiens
  misc_feature: GYAE6OF02F7RS7.7.78.H01.1.454.CMB.1.raw
  modified_base (532)..(532): a, c, t, g, unknown or other
  misc_feature (532)..(532): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcactacttattctgtcaattgggtccgacaggcccctggacaaggccttgactacatgggatggatcaacaccgacacgtcgggaaccccactatcgcccaggcccttcacgagggtcggtttgtcttctccagtcggatacctctggtcgggacgtcttatctgcagactaaccaaccttcaacctgacgacactcgtcgtttattttgacgtagacgtcgtcgtctgtcagtggaattgactacgtgggccgagggacctggtccaccgtctctcgnccctccaccgaggtccc

SEQ ID NO: 210959 - DNA, 549 bp, Homo sapiens
  misc_feature: GYAE6OF02IJXMU.7.78.H01.1.454.CMB.1.raw
  modified_base (283)..(283): a, c, t, g, unknown or other
  misc_feature (283)..(283): n is a, c, g, or t
  modified_base (324)..(324): a, c, t, g, unknown or other
  misc_feature (324)..(324): n is a, c, g, or t
  modified_base (517)..(517): a, c, t, g, unknown or other
  misc_feature (517)..(517): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcagccttctggatacatcttcactacttattctgtcaattgggtccgacnggcccctggacaaggccttgactacatgggatggatcaacnccgacactgggaaccccactatgcccaggccttcgacagggcgtttgtcttctcctatcggatacctctgtcgggacggtcttatctgcagataaccaaccttcaacctgaccgacactcgccgttttattttcgtacgtgaagtcgtcgtctgtcagtgtaattgatactggggccagggaccctggtaccnccgtcctcctcacgccctcacccgaggtcccc

SEQ ID NO: 210960 - DNA, 742 bp, Homo sapiens
  misc_feature: GYAE6OF02IHAL6.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgtaattggaggaagcccgtggggcgtacgaggtgaggtcgttgccgtgacacgtccttcgtaggaactactactcttcacttactttattctgtactaagttcgggtccgacgcggtcccctaggaacgaacggtccttacgactacagtggatggatacaacgaccacacgtaccgggaacccctacgtagccgccgacggtcccttacgaccggtacgggttcgtttcgttccttaccgtccgtagtacggtacttccgtcgttcgggtacgggtacgtcgtttacgtctcgaactaaggtaaccttaaacccgtaaccttaccgaaacccgtacgtaaacccgtaccttaacggttaccgtttaaccgtttttaacgtttacgggaacgttacggtaccggtccgtttcgttacctgggttactaagggttacgttattacgtaccgtacgggtcgggacccgtaaccgggtaccgttcgggtacccgtaccgtccgttacccgccggtacctaccccggtaccgaccggtaacccggtcccgg

SEQ ID NO: 210961 - DNA, 687 bp, Homo sapiens
  misc_feature: GYAE6OF02F056J.7.78.H01.1.454.CMB.1.raw
  modified_base (243)..(243): a, c, t, g, unknown or other
  misc_feature (243)..(243): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacatcttcactacttattctgtcaagttcgggtccgacgacggcccctggacaaggtccttagactacagtgggatggatacaacgaccgacaccgtacgggaaccccacgtatcgacccgaggtcccttacgacgtagggtcggtttcgtcttcctccgtagttcgggtaacttaccctcgttacggtaccggggtacggtctttaatcgtggtctaaggaaccttaacccgaacctttaccgaaaccgttaggtaacctactacgttcgttaccgtttttagttttacggaacgtagacgttcgtccgtcttcggtacgtagttaggtaacttcgaccgttacggacgggacccgtaacgggtaacccgttggtccccgttaccgtccgttacccgtcgtacccgtcccgtaacccgtacccggaaccgggtaccccg

SEQ ID NO: 210962 - DNA, 682 bp, Homo sapiens
  misc_feature: GYAE6OF02GXG1N.7.78.H01.1.454.CMB.1.raw
  modified_base (217)..(217): a, c, t, g, unknown or other
  misc_feature (217)..(217): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtnagtgagcgttgcctgcaagccttcgtgatacattcttacacttacttattctgtctaagttcgggtaccgaccgacggtccccgtaggaacgaacggtccttaggactacgtagtgggagtcggatacaaccgaaccggacaacgtacgggaacccctacgtacgtcgcccgacggtcccttaccggacggggttccggtttcgttccgttcgtccgtagtacgtacttaccgtcgtcgggtacgggacgtcttacgtcgtcgacagtaactaaccctaacttaccaaccgtcgaaccgtactacgttcgttacgtttagtttacgtagtagtcgttcgtcgttgtcgtacgtagttagtaacttgtacgtacggtcgggaccgtaacgggtacccgttacggtaccgttaccgtccgtaccgtcgaccgtacccgtcccgtaacggtaccgggtccctaaccgg

SEQ ID NO: 210963 - DNA, 625 bp, Homo sapiens
  misc_feature: GYAE6OF02GCID8.7.78.H01.1.454.CMB.1.raw
  modified_base (381)..(381): a, c, t, g, unknown or other
  misc_feature (381)..(381): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggctcagtgagtcgttgcctgcaagccttctggatacatcttcacttacttattctgtcaattgggtccacaggcccctggacaggccttgactacagtggactggatacaacaccgacacgtcgggaacccctacgtatcgcccaggtccctacacgacgggtcgtttntctttactccgtatcggtaacttcccgtcgttcgggtaccgggtacggtactttacgtcgttcgacgacgtaaactaaccctaccttaccaaccgttgaacgacctacttcgttacgttttattttacggagtaacgtgtacgtcgtctgttcgagtggtaattgacgttcgcggaccggtaacgggtacctggtaccctccgttaccgtcctacggcctacccttccgaccggacgtaccccg

SEQ ID NO: 210964 - DNA, 607 bp, Homo sapiens
  misc_feature: GYAE6OF02IBB46.7.78.H01.1.454.CMB.1.raw
  modified_base (352)..(352): a, c, t, g, unknown or other
  misc_feature (352)..(352): n is a, c, g, or t
  modified_base (575)..(575): a, c, t, g, unknown or other
  misc_feature (575)..(575): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcacttacttattctgtcaattgggtccacacggcccctggacaaggccttgactaacagtgggatggatacaacaccgacacgtcgggaaccccactancgcccacggcccttcacgagggtcggtttgtcttctcatggactacctcttcggtcggggacgtctttatctgcagtactaaccaaccttacaacctgaacacacttcgtaccgttttatttacgtacgtagtacgtcgttcgtctgtactaggtagtaagttagacttacggacgggtaccgaacgggtaacccgttcgggtacctaacccgtcgttacccncgtaccgacccctaccacccggacggtacccc

SEQ ID NO: 210965 - DNA, 813 bp, Homo sapiens
  misc_feature: GYAE6OF02G18P3.7.78.H01.1.454.CMB.1.raw
  modified_base (243)..(243): a, c, t, g, unknown or other
  misc_feature (243)..(243): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtgcagtagcaacaggtgcccactcccaggtgcagctggtacagtctgggtctgaattgaggaagccgtggggcgtcagtgagcgttgcctgcaagccttcnggatacatctcacttacttattctgtctaagttgggtccgacgacggccccgtggaccacggtccttgaactacgagtcgggatcggtactaccaaaccgaccgtaactaccgtacggggaaaccccccaccgttaactccggaccccgaacggtcccttaaccaacggtacggggtaccggttttagtccctttacgtacctacgtcgggtaacttacccgtcgttacgggtccgggaaccgggtcctttaagtcgttagacgaacgtaactaaacccgtaaacctttaccaaaccgttaggaaccggtactacccgttcggttcccggtttttaaacttttacgtaaccggtaacgtacggttcccggttaccggttacgtttcggtacgttaacgggttaacggtaaatttacgggtaaccttacgggtacgggggggtaccctaaaccgggggtaacccccgtttaggggttaaccccccgtaacccggttccgtttaaccccgtacggttaacccggttaccccggtttaaccccggtaaacccggaaccccgggggttaacccc

SEQ ID NO: 210966 - DNA, 713 bp, Homo sapiens
  misc_feature: GYAE6OF02F0AJF.7.78.H01.1.454.CMB.1.raw
  modified_base (244)..(244): a, c, t, g, unknown or other
  misc_feature (244)..(244): n is a, c, g, or t
  modified_base (270)..(270): a, c, t, g, unknown or other
  misc_feature (270)..(270): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttcnggatacatcttcacttacttattctntctaattgggtccgacacggcccctggacaaggtccttagactacagtgggatggactaccaaccaccgactacgtaccgggaaccccctaccgtagtcgcccaacggtcccttaccggtaccgggggtaccgtttcggtcctttccgttccgagtacggtacttacccgtcgttcggtaccgggtacggtctttacgtctggactaagtactaaaccctaacccgttaccaaaccgtcgaacgacctacgttccgttaccgtttttaacttttacggaaccgtaggtacgtccggtttaccgttcgttcgtacgagttggtaaatttcgaaccgttacggtccggggaccgtaccggggtaaccccttccggtacccgtacccgttcctcccgttcctaccggtcccctaacccgaccccgtaaccgggtcccctaacccgg

SEQ ID NO: 210967 - DNA, 730 bp, Homo sapiens
  misc_feature: GYAE6OF02G7NMX.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaacggtcctgactacagtgggatggactcaaccaccgacaccgtacgggaacccccacgtactcgacccacggtcccttcacgaggggtccggtttgtccttcctaccgtacgttcggtaacttaccttcgtacgggtccggggacggtcctttagtcctggactagacttaaacccaacctttaccaacccgttgaacccgaacctacgttcgttacccgtttttaacttttaggtacgtaggtaccggttcgttccgttacgttcggttaccgtagggttacggtaaagtttacgggaaccgtttacggtacgggggttacccgaacgggggttaaccccgtcggggtttacccgtacccggtttaccccgttaccgttccggtaaccccggtacccctttacccggaaccccggtaacccgggttacccccg

SEQ ID NO: 210968 - DNA, 738 bp, Homo sapiens
  misc_feature: GYAE6OF02H38NE.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatccttcttcttggtggcagtagcaacaggtgcccactcccaggtgcagctggtacagtctgggtctgaattgaggaagccgtggggcgtcagtgagcgttgctgcagccttctggatacatcttcacttacttattctgtactaagttcggggtaccacgaggccccctaggacctaaggtccttagaccttaacagtggggactgggactacaaacctacccggaactacgtccgggaaacccccaccttaacgtcgtaccctacggtcccttacgaacgtacgggggtcggttttacgtctttccgtacctaagttacggtaacttacccttcgtacgggttacccgggggtaacggtccttttaacgtccgttacgaccgtaaagtaaaccttaaacccgtaacccttttaccgaaacccgtttacggaacccggtaacctaacggttaccgtttacccgtttttaaattttaccgggaacgtacggtacgtaccgttcgttacgtcgttacgagtaggtattacgacctaggtcgggacgtaacgggtacccgtggtaacctaccgtctaccgtacgaccgtccctacaccgggtaccggtccc

SEQ ID NO: 210969 - DNA, 547 bp, Homo sapiens
  misc_feature: GYAE6OF02GI3FA.7.78.H01.1.454.CMB.1.raw
  modified_base (532)..(532): a, c, t, g, unknown or other
  misc_feature (532)..(532): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctggggtctgaattgaggaagcctggggcgtcagtgagcgttgcctgcaagccttctggatacatcttcactacttattctgtcaattggtccgacaggcccctggacaaggccttgactacatggatggatcaacaccgacactgggaacccccactatcgcccaggccttcacgagggtcgtttgtcttctccatggactacctcgtgtcgggacgtcttatctgcagactaaccaaccttcaacctgacgacactcgtccgttttattttacgtacgtagagtcgtcgtctgtcagtcgtatcgactacgtcgggcgacgggtacctggtccacgtctctcncgcctcaccgagccg

SEQ ID NO: 210970 - DNA, 679 bp, Homo sapiens
  misc_feature: GYAE6OF02GREB1.7.78.H01.1.454.CMB.1.raw
  modified_base (245)..(245): a, c, t, g, unknown or other
  misc_feature (245)..(245): n is a, c, g, or t
  modified_base (269)..(269): a, c, t, g, unknown or other
  misc_feature (269)..(269): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (457)..(457): a, c, t, g, unknown or other
  misc_feature (457)..(457): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtcgcagctggtacagtctgggtctgaattgaggaagcctggggctcagtgagcgttgcctgcaagtccttcgnggatacgatcttcactattattcngtacaagttcgggtaccacacggcccctaggacaacggtccttgaactacaagtgggatggtaatccaaaccgccgaacacgtacgggaaaccccncttaancggacccaggtcccttagaccggagggttccggttttagtccttctaccgtagtacggtactcctacgtggtccgggacgtcttancgtgactacgaacttaacccgaaccttacgaacctacgtaacactaaccgttgttacttttacgtttagaacgtagtacgtcgttcgtcgtagtaccgtagtaggtacgtcgtaacgttcggtaccggggaaccgtacgggttaacccttcgggtacccgacccgttttccgacccgttcgtaaccgtacccccgtttacgaaccccggtaccgggtacccc

SEQ ID NO: 210971 - DNA, 629 bp, Homo sapiens
  misc_feature: GYAE6OF02JG5JY.7.78.H01.1.454.CMB.1.raw
  modified_base (349)..(349): a, c, t, g, unknown or other
  misc_feature (349)..(349): n is a, c, g, or t
  modified_base (382)..(382): a, c, t, g, unknown or other
  misc_feature (382)..(382): n is a, c, g, or t
  modified_base (505)..(505): a, c, t, g, unknown or other
  misc_feature (505)..(505): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtacattgggtccgacacggcccctggacaaggccttgactacatgggatggatcaacaccgacacgtacggaccccactancgcccaggcccttacgacgtagggtcggttttntccttctccaagttcggactaccctcgtcggtcgggaccgtctttactctgccagtactaaccctaaccttccaacctgaccgacacgttgtcctttttatttcgacgacgtcgtcgttcgtnttcgtactaggtacgtaacttgaaccgttcggtcggggaccctaacggggtaacccttgggtaccctacccggttctacccgtacctaccggtcccttacccggacccggtaaccgggtccccc

SEQ ID NO: 210972 - DNA, 857 bp, Homo sapiens
  misc_feature: GYAE6OF02JD22O.7.78.H01.1.454.CMB.1.raw
  modified_base (246)..(246): a, c, t, g, unknown or other
  misc_feature (246)..(246): n is a, c, g, or t
tcagcgtgtctctacacgaccggtgctcgatttagtgtgagtagtttgggtttggggtacccaacaaccacacccctcctaagaagaagccctagaccacagctccacaccatggactggacctggaggatcctcttcttggtggcagtagcaacaggtgccactccaggtgcagctggtacagtcgtgggtctgaattggaggtaagccgtggggcgtcaggtgagcgttgcctgcaagtccttntggactacatcttcactacttatcttgtcaagttcgggtaccacgtacggtccccgtagtaaccgaaacggccgtttaggaacctaacgaggttaggggaacgttagggaactaccggtaaaccaccgggtaaccaccggtaacggggaaccccctaactacgtaccggacccgtaacggttcccttaacgtaaccggtaacgggggtaccggtttttacggtacctttacccgttaccgtaggttaccggaacgtttaaccctacgggtttacgggtaaccgggggtaaccggttccgttttaaagtccgttacgggaaccgttaaggtaaccctaaaacccgttaccggtttaacccaaaccggtttcggaaaccgacctttaccgttaccggttcccggttttttaaagttttaccggaaccggtaagtaaccgggttcctttaccgggttaactcgggtaaaccttaggggttacgggttaaaactcggtaaaccgtttccgggtacggggaacccgtttaagggggaacccctttggaccccggttacctttaccgacccgttaacggcccggttaccgtaacccacggggtacccggttacccgg

SEQ ID NO: 210973 - DNA, 759 bp, Homo sapiens
  misc_feature: GYAE6OF02JTD50.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtcgcccactcccaggtgcagctggtacagtcgtgggtctgaatgaggagcgtgggctcagtgagcgttgacctgcaacgtccttgtaggaatcgtatcttacaacttacttattcttgtacgtaacgttcgggtacccgaaccgtacggtacccctagggaaccgtaacggtcccgttacgtaacgtaacgtaggttcggggtaactggtactaccgtaaaccgaccggtaactaccggtaccgggtaaacccctacgtaccgtacgacccgtacggtacccttacgaccggtacggttaccggttttacgtaccgttcgtaccgagtacggttactacccgttcgggttacgggtaccgggtacgttacgttaccggttcgtacggtacctaacggtaaacctaacccgttaactaacccgtaacgtctaaccggttaactccgtttacgttcccgttttaagtttccggaacggtacgtacgttaccggttcgttactcgtacgtagttacggtactagtacgttaccggaggtaccggtaacggtcgttacgtccgtaccgtctacccgtacgcgtacccgtctaaccgcccggtacg

SEQ ID NO: 210974 - DNA, 674 bp, Homo sapiens
  misc_feature: GYAE6OF02G3OVV.7.78.H01.1.454.CMB.1.raw
  modified_base (448)..(448): a, c, t, g, unknown or other
  misc_feature (448)..(448): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgagaagcctggggcgtcagtgagcgttgcctgcaagccttctggatacattcttcacttacttattctgtctaagttcgggtccgaacgacggcccctaggaccgaacggtccttagactacgagtggggatggatccgaaaccgaccgaccacgtaccgggaacccctactactcgacccacggtcctacgacgacgggtcgtttgtcctctccagtcgtactactcgtcggtcgggacgtctttancgtgacagtactaaacctacgtttaccaccgtagaaccgtactaccgtaccggtttactttttaagttttcgaacgtagtaaccgtccggtttacgtccgttagtacgttaggtagtaacgttcgtaaccgtccggttacggggacccggtaacggtacccgtagggttaccctaccgttaccgttccctacgaccgttcccgtaccgtacccggtacggtacccg

SEQ ID NO: 210975 - DNA, 703 bp, Homo sapiens
  misc_feature: GYAE6OF02IPYY5.7.78.H01.1.454.CMB.1.raw
  modified_base (245)..(245): a, c, t, g, unknown or other
  misc_feature (245)..(245): n is a, c, g, or t
  modified_base (458)..(458): a, c, t, g, unknown or other
  misc_feature (458)..(458): n is a, c, g, or t
tcagcgtgtctctacacgaccggtgctcgatttagtgtgagtagtttgggtttggggtacccgaacaaccacacccctcctaacgaagaagacccctagaccacagctccacaccatggactggacctggaggatcctcttcttggtggcagtagcaacaggtgccactcccaggtgcagctggtacagtctgggtctgaattgaggaagcctggggcgtcagtgagcgttgcctgcaagccttnggatacatcttcacttacttattctgtcaattgggtccgacacggtccccgtaggacaacggtccgttgacttacagtgggatggactacaacaccgactacgtacgggaaccccactagtacgaccgtacggccttacgacggtacgggtcggtttacgttctcttccaagtgacgttaccttacgtggtacgggtacggtactttacgtcnggtacagtaacgtaaccctaaacttcctaaaccgtgaaccgtacaccgttgtaccgtttttagtttcgtaagacgtaggtccgttacgtccgttgtccgtaagggttcgtaacgtttacggtaccgtacgggttcgggtacccggtaacggggaaccccgtttcggggttaacccgtaccgtttacccggttcccttaccggaccgttacccccggtaccttacccggggaacgttacccccggg

SEQ ID NO: 210976 - DNA, 713 bp, Homo sapiens
  misc_feature: GYAE6OF02H96CX.7.78.H01.1.454.CMB.1.raw
  modified_base (244)..(244): a, c, t, g, unknown or other
  misc_feature (244)..(244): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagtcgttgcctgcaagccttntggatacatcttcatacttattctgtacaagttgggtccacgacggtccccgtggaccgaaggtccttagacctacgtagtggggaatggactacgaacaccgacaccggtaccggaacccctacgtatccgcccgacgtcccttcgaaccgtaggggtaccgtttcgtccttacctctactcggtacctaccgtcgtacgggtaccgggtacgtcttacgttcggtcgaccgtaacgtaacctaaaaccccgtaacctttaccctaaaccgtacgaacccgtaaccgtacgttacgtttacccgttttattttaccggtaacggtaacggtacggtccgttcgttcgttagtacgtaggttaggaacgttttcgaccgtttacggtcgggacccgtaacgggtaacccgttgtcccgtaaccgttcctacccgttacaccggtccctacccgaccgtaccggtacccg

SEQ ID NO: 210977 - DNA, 772 bp, Homo sapiens
  misc_feature: GYAE6OF02HVISS.7.78.H01.1.454.CMB.1.raw
  modified_base (185)..(185): a, c, t, g, unknown or other
  misc_feature (185)..(185): n is a, c, g, or t
  modified_base (257)..(257): a, c, t, g, unknown or other
  misc_feature (257)..(257): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacngtctgggtctgtaattggaggaagccgtggggcgtcaggtgagtcgttgcctgacagtccttcgtggatacntcttacacttacttattctgtactaagttcgggtaccgactacggcccctagggaacaacggtacccgtttagaacgttaactaggttaggggtagtaggtactaccaaccgacccgtaaccaaccgtaccgggaacccccaaccgttacgtaccgacccgtaaccggtcccttacgaccggtacggggttccggtttttcggttcctttccgtaccgtacgtaggtaaccttaccgtcggttgggtacccgggtacggttctttacgtccgttacgacgtaacgtaactaaacccgtaaccttaccgaaccttaccggaaccgtactaccgttgtttaccgtttttagtttaccggtaacgacggtacggttccgttacgttcgtacggtatacgggtagttaacgttacgacgttaccgggcgggggtacccgtaaccggggttaaccgtcgggttaccctacccgttccgttacccgtcgtacccgcccgtaccgacccggaccgtaccccg

SEQ ID NO: 210978 - DNA, 670 bp, Homo sapiens
  misc_feature: GYAE6OF02GGYXM.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggctcagtgagcgttgcctgcaagccttctggatacatcttcactacttattctgtcattggtccacaggcccctggacaggtccttgactacagtggatggtactcaacgaccgacacgtacgggaaccccactactcgacccacggcccgttcgacggggtcgtttcgtccttcgtccgagtggactacctcgtcgtccgggtacgtcttacgtcgtcgcaagtactaaccgtaaccttaccgaaccgtcgaaccgtactacgtacggttaccgtttttagttttcgacgtacgtacggtccgttcgtcttcggtacgtcgggttaagtaacgtttcgacccgtttcggtaccggggacccgttaccggggtaaccccgttcggtacccgtaccccggttccgtcccgtacgtccgtaccccttacccgaacccggtaccggtccccgtaacccgg

SEQ ID NO: 210979 - DNA, 663 bp, Homo sapiens
  misc_feature: GYAE6OF02HXTYB.7.78.H01.1.454.CMB.1.raw
  modified_base (287)..(287): a, c, t, g, unknown or other
  misc_feature (287)..(287): n is a, c, g, or t
  modified_base (391)..(391): a, c, t, g, unknown or other
  misc_feature (391)..(391): n is a, c, g, or t
tcagcgtgtctctacacgaccggtgctcgatttagtgtgagtagtttgggtttggggacccaacaaccacacccctcctaagaagaagccccgtagaccacgagctccgacaccatggactggacctggaggatcctcttcttggtggcagtagcaacaggtgccactcccagtgccagctggtacagtctgggtctcgaattgaggaagcctggggctcagtgagcgttgcctgcaaggccttctggatacattcttcacttacttattctgtcaattgggtccanaggcccctggacaaggcctgactacagtggatggatcaacacgacacgtggaaccccactatgcccaaggcccttacacgacgggtcggtttagtccgtttccncctagtcgattaccccgtgtggtaccggggtacggctttagtctggacaagtactaaaccgaacctttccgaaaccttgaaccgttcctacttcgttacccgtttttagtttttacggaacgtacggtacgtacggttcgttcgttacgttcctaagggtcggtaaatttcgtaacttaccggttcggggaacctaacgggggtaacccttagggtacccctacggttaccctcgtcctacggtaccctacccgtaccgaaccggtaccccg

SEQ ID NO: 210980 - DNA, 581 bp, Homo sapiens
  misc_feature: GYAE6OF02JAKPP.7.78.H01.1.454.CMB.1.raw
  modified_base (254)..(254): a, c, t, g, unknown or other
  misc_feature (254)..(254): n is a, c, g, or t
  modified_base (314)..(314): a, c, t, g, unknown or other
  misc_feature (314)..(314): n is a, c, g, or t
  modified_base (552)..(552): a, c, t, g, unknown or other
  misc_feature (552)..(552): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatctnactacttattctgtcaattgggtccacacggcccctggacaaggccttgactacatgggntggatcaacaccgacactgggaaccccactactgcccaggccttcgacggggcgtttgtctctcatgatcctctgtcgggacggtcttatctgcagataaaccacttacaacctgacgactactcgtaccgttttattttacgacgtacgaggcgttccgttacttcgtactaggtggtattcgacttacggtgggacctacggggtaaccctcggttcacccggttactcccgtacncgtaccctacgaccgacgggtccctacgg

SEQ ID NO: 210981 - DNA, 736 bp, Homo sapiens
  misc_feature: GYAE6OF02IDOMG.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacattcttcactacttattctgtcaattgggtccacaggcccctggacaaggcccttgactacagtgggatggatcaacaccgacactcgggaaccccactatcgcccaggtcccttacacgagggtcgtttgtcttctcatggactaccgtctggtaccgggtacgtctttacgtccgttacggcgtaagtaaccttaaacccgtaaccctttaccgaaacccgtacggaacccgtaacctacgttaccggttacccgtttttaagtttttccggtaaacgtacggtaacggtcccggttaccgttccgttacggttaccgtaacgggtttacggtaaacgtttacgggtaaccgtttaaccgggttccgggggtaccccgtaaacggggttaaacccccgttggggtaccccttaaccccgggttaccttccccgttacgtacccggttacccccgtaccccggtaccccgtaacccggggtacccccg

SEQ ID NO: 210982 - DNA, 748 bp, Homo sapiens
  misc_feature: GYAE6OF02IFEKS.7.78.H01.1.454.CMB.1.raw
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
  modified_base (441)..(441): a, c, t, g, unknown or other
  misc_feature (441)..(441): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtgcagtagcaaacaggtcgcccactcccaggtgcagctggtacagtctgggtctgaattgaggagcctgggctnagtgagcgtgcctgacagccttcnggatacatcttcactacttattctgtctaaattgggtccgacaggcccctaggacaacggtcttgactaacattgggactggatcaacctaccgacaacgtcggaaaccccacctagtcgcccaggtcccttcacgtagggtcggtttagtccttcgtccagtacggtactacccgttcgtcgggtccggggtaccgggtntttaactcgtcgactaagtaactaaaacccgtaaccctttactaaaccgtacggtaaccgaaccctaacggttcgttaacccggtttttacgtttttttacgtaaacgggtaacgtaacggttccggttacccggttacgttacgttacctaagggttacggtaaatttacgtaacccgtttacggtaaccgggggtccctaaaccgggggtaaaccccgtttcgggtaacccgtacccggtttccctaccccgttacccgtaaccgtaccccgttacccgaaccccggaaccgggttaacccccgg

SEQ ID NO: 210983 - DNA, 671 bp, Homo sapiens
  misc_feature: GYAE6OF02IGB6C.7.78.H01.1.454.CMB.1.raw
  modified_base (345)..(345): a, c, t, g, unknown or other
  misc_feature (345)..(345): n is a, c, g, or t
  modified_base (586)..(586): a, c, t, g, unknown or other
  misc_feature (586)..(586): n is a, c, g, or t
  modified_base (644)..(644): a, c, t, g, unknown or other
  misc_feature (644)..(644): n is a, c, g, or t
  modified_base (661)..(661): a, c, t, g, unknown or other
  misc_feature (661)..(661): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctagggtctgaattgaggaagccgtggggcgtcaggtgagcgttgcctgacagccttctggatacatcttcacttactttattctgtactaagttgggtccgcacggcccctggacaaggtccttagactacgagtggggatggatcaacacccgtanaccgtacgggaaccccactactcgacccgacggtcccttcgaacgtacggggtccgttttgtacctttcctcctagtacggacttaccgtacggttgggttacccggggaggtacctttacgtcgttagggacctaaggtaaacctaaacccgtaacctttcccgtaaacgtacggtaaccgtaacctaccgttccgtttacgttttacgttttacgacgaggtacgtcccgttgttcgtnttcgaaggttacgtattcgacgttacggcgggtccgaacggtacctggtcctaccgtntccacgtcgccctaacnccgagtcccg

SEQ ID NO: 210984 - DNA, 819 bp, Homo sapiens
  misc_feature: GYAE6OF02JKZZ6.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagcccttctggatacattccttacgacttacttattctgtacctaattgggtaccgacgacggcccctgggaaccaacgggtcccttagaccttaacgatacggggattcggactacgaacctaccgaacgtacgtacgggaaccccctacgtacgtccgacccgacggtcccttcgaacggtacggggtccggttttacgttaccgtttcctaccgtaagttcgggaacttccgttcgtaccgggtaccggggtacgttcctttaagtccggttacgctaacggtaaccgttaaaccctaaacccgttccaaacccgttacggaaccgtaccgtaaccggtcggttttaccccggtttttaattttacgggtaaccggaacggttacggttaccggtttccggtttaccttacgggttacccgtaacgggtttagggttaaacctttacgggttaacccgttacggttccggggaaccggttaaccggggttaaccccgttacgggttacctacccccgggtttaccttacccgtaccgttacccggaccctttacccggaaccggttacccgggtacccccg

SEQ ID NO: 210985 - DNA, 808 bp, Homo sapiens
  misc_feature: GYAE6OF02GCC6K.7.78.H01.1.454.CMB.1.raw
  modified_base (246)..(246): a, c, t, g, unknown or other
  misc_feature (246)..(246): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagcgtggtacagtctgggtctgaattgaggaagccgtggggctcgagtgagcgttgcctgcaagccttcgnggatacatcttcacttacttattctgtactaagttcgggtacctacgaccggtccccgtaggaactaacggtccttcgaaccttcaaggtcggggtaatcgggactaccgaaacgacccgtaacgaccggtaacccgggaaccccctaaccgttaacgtccggaccctaaccgggtcccttaccgggtaccggggttacggtttcgttcccgttccgtacgtacgttcgggtaacttacccgttcggtcggtaccggggtacgtctttacgtccgtgaccgtataaccgttaaacctaaccttaccgaactcgacgtaactaccgttcgtttaccgttttacgttttaacgacggtaacgttacggttccgttacgtttccgtaaggttaccgtaggggttacgtaaacgtttcggaaccgggtttaccggacccggggggtacctaaacccggggtttacccggttacggggtaccccctttaacccgggttcctaccccgtaacggtccccggtaccctaacccccggaaccggttacccggggaccccctttaaccggg

SEQ ID NO: 210986 - DNA, 686 bp, Homo sapiens
  misc_feature: GYAE6OF02IL77L.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgattgaggaagcctggggcgtcagtgagcgttgcctgcaagccttctggatacatcttcactacttattctgtcaattcgggtccgacacggcccctggacaacggccttgactacagtcgggatggatacaacaccgacactcgggaaccccactatcgcccaggccttcgacaggggtcggttttgtctttctcctaagtcggacttaccctctcggtcgggaccggtctttagtcgtcgacacgtaactaaaccctaaccttaccaacccgtgaaccggtaacctacgttacgttaccgtttttacgtttttacgtaacgtacggtacgtcgtttcgtacttcgtcgtaaggttacggtaaagttcgtaacgttacgggttacggggcccgtaaacggggtaacccctgggttacccctaccggtttcccgttacccgtaccgtaaccggtcccccttaacccggaccccgtaaccggggtacccccg

SEQ ID NO: 210987 - DNA, 787 bp, Homo sapiens
  misc_feature: GYAE6OF02HO6PU.7.78.H01.1.454.CMB.1.raw
  modified_base (185)..(185): a, c, t, g, unknown or other
  misc_feature (185)..(185): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacngtctgggtctgaattggaaggagccgtggggcgtcagtgagtcgttgcctgacaagtcctttcgaggactactattccttctaacttactttattcttgtctaagttcgggtccgacgtaccggtccccgtaggacctaacggtccttagaacctaacgtaggttaggggtaacttaggaacttaccgaaaccgacccgtaaccgtaaccggttaaccgggaaaccccctaccgtacgtcccggtacccgtaacggtccccttacgaaccgggtcggggtttaccgttttcgttccgttacctaccgtaacgttacggaacttacccgtcggttacggggtaccgggtacggttacctttagtccgtacgtaacgaaacgttaaccttaaaaccccgaacttttaccgaaacgtaccgtaccgaaccttactttccgggtttaactttttagttacgacggttacgacgttcggtttcctaggtcgttacgtaggtagttaacgttcgaacgttcggtcggggacccgtaacggttacctgggtaacccttccgtccgttaccgtcggaacccgtacccgttacccaacgggcccggttacc

SEQ ID NO: 210988 - DNA, 688 bp, Homo sapiens
  misc_feature: GYAE6OF02FNMGA.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagcccttctggatacatcttcactacttattctgtctaattgggtccacaggcccctaggacaaggccttgactacgatgggatggatcaacaccgacacgtcgggaaccccactactcgcccagcccttacacgtacgggtcggtttcgtctttcctccgatcggtaacttacccgtcgtaggtccgggtaccgggtctttaacgtcctggtacaagtaacgtaaacccctaaccttaccgaaccttacggaaccaaccctacgttcgttaccgtttttagtttttacggtaacgtacgtaacggtccgttcgttccgtgttacgaggttaggtaagttacgtacgttacgtcggggtaccgtaaccggggtaacccgttcggttaaccgtacccgtttccgttacccgtaccgtacccggtccctacccggtaccgaacccgggtaccccg

SEQ ID NO: 210989 - DNA, 878 bp, Homo sapiens
  misc_feature: GYAE6OF02ILIOQ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgattgaggaagccgtggggcgtcagtgagcgttgcctgcaagtccttctggatacatcttccacttacttattctgttcaaatttcgggtccgacacggccccgtggacaaggcccttagacctaacctagtacgggagtggacttaccaaccgaccgaactaccgtaccgggaaaccccctaaccttagtccgaccccgacggtcccttaccgaaccggtaacggggttccgggtttttagttccctttaccgttacccgtaagttaacgggttaccgttaaccccgtttccggtttacgggttaccggggggtacccggttacccggtttttaacgttccgttacggtaaccgtaaacggttaaaccgtaaacccccgttaaaccgtttacccgtaaaccgtttaaccggaaccggtaaccctaccggtttaccggtttaaacccggttttttactttttttaacgggtaacccgttaagggtaaccggttacccggttttaccggttacgtttacgggttaccggttaaagggtttacgggttaaacgttttaaccgggtaaccgttaccggggtacgggggtacccgtaaaccggggttaccccggtacggttacccggttacccggtaccctttccgaccgtccgttaccccgaccggtacccgaaccggggtacccc

SEQ ID NO: 210990 - DNA, 583 bp, Homo sapiens
  misc_feature: GYAE6OF02HN8NG.7.78.H01.1.454.CMB.1.raw
  modified_base (360)..(360): a, c, t, g, unknown or other
  misc_feature (360)..(360): n is a, c, g, or t
  modified_base (389)..(389): a, c, t, g, unknown or other
  misc_feature (389)..(389): n is a, c, g, or t
  modified_base (501)..(501): a, c, t, g, unknown or other
  misc_feature (501)..(501): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattggaggaagccgtggggcgtcagtgagtcgttgcctgcaagccttcgtggatacatcttcacttacttattctgtcaagttgggtccacacggcccctggacaagggccttgactacagtgggatggatccaacgaccgacacgtacggaaccccacgtancgaccagtccttcacgtacgggtcgtttntccttctcagtgactcctcgtgtccgggacgtcttacgtcgtgctaagactaacctactacacgtgaaccacactcgttacgttttagtttagacgagtagtcgttctcgtntcgagtgtattgcgtagtcgggacgaacgggtacctggtacctaccgttctactccacgtccctaccgacgaccggtacccg

SEQ ID NO: 210991 - DNA, 654 bp, Homo sapiens
  misc_feature: GYAE6OF02I1YCS.7.78.H01.1.454.CMB.1.raw
  modified_base (242)..(242): a, c, t, g, unknown or other
  misc_feature (242)..(242): n is a, c, g, or t
  modified_base (446)..(446): a, c, t, g, unknown or other
  misc_feature (446)..(446): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggctcagtgagcgttgcctgcaagccttnggatacatcttcacttacttattctgtactaagtttcgggtcccgacgacggtccccctggacaaggcctttagactacgagtggggatggactcaaccaccgacaccgtacgggaaccccactatcgacccaggtcccttacaacgagggttcggtttcgtcttctccagtggtactcctcgtcgggtcggacgttacttgtntcggatacgaactaaccctaacctaccacctacggactacgtacgttccgtttacgttttattaggtacgtaggtacgttcgtcgtctgtactaggtacgtttaagcgttacgtacggggtcggtaaccggtaacgggtacccgttacggtccctacccgttccttcccgtaacgtcccgacccgtacctacccgggaccgtacccgg

SEQ ID NO: 210992 - DNA, 656 bp, Homo sapiens
  misc_feature: GYAE6OF02IGK0E.7.78.H01.1.454.CMB.1.raw
  modified_base (469)..(469): a, c, t, g, unknown or other
  misc_feature (469)..(469): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagtccttcgtggatacatcttcacttacttattctgtcaattcggtccgacaggcccctggacaaggtcccttgactacagtgggatcggactacaacacccgacacgtacgggaaacccccactacgtcgcccaggtcccttacgacgagggtcgtttgtccttcgcctagtcggactaccgtcgtcggtaccgggtacgtcttactcgtgacaagtactaaacctaacccttnaaaccctcggaaccacctacgttccgttacgtttttaatttcgtaacgtacggtacgtccgttcgtacctggttacgagtacggtaacttcggtacgttacggtcggggtaccgtacgggtacccgtcggtacccgtaccgttccgtccttacggaccgtccctaaccgacccgtaaccgggtcccc

SEQ ID NO: 210993 - DNA, 941 bp, Homo sapiens
  misc_feature: GYAE6OF02HJTXT.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtactagtcgtgggtctgtaattggaaggaagccgtggggcgtcgaggtgagtcgtttcgccgtgaccgaacgtccttcgtaggacttacacttcttcctaacttactttacttcttagtactaagtttcggggtaccgaccgaccggtccccgttacgggaacgtaacgggtcccgtttacgtaaccgttaacgtaagttaggggaacgttagggaacttaaccgaaaccgtaaccccggtaacctaacccggttaacccggggtaaacccccctaaccgttacggtaccggaaccccggtacccggttcccgttaacccgaacgggtacggggtttccgggtttttacgttcccgtttacgttacccgtaacggttacggttaacccgtttacccgttaccgggtttaccgggggttaccggggtaaccgggttccgtttttaacgccggtttacggaaccgttaaacgtaaacccttaaaccccgttaaacccgtttaccgtaacccgtaacgtaacccgtaccttaaccgtttacgttttacccgtttttttaacggttttaccggacggttaacggttaccgttccggttacgttcggttagttacgttacggttaagttaccttcgggtaacgtaccgggttacggggacccgttaaaccggggtcccttacgggtcccgttaacccgtttcctacccgggttaccgttaacccggtccccttaaccggtaacccccggtaaccgggttacccccg

SEQ ID NO: 210994 - DNA, 634 bp, Homo sapiens
  misc_feature: GYAE6OF02GU3NH.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggctcagtgagcgttgcctgcaagccttctggatacatcttcactacttattctgtcaattgggtccgacaggcccctggacaaggtccttgactacagtgggatggatacaacaccgacacgtacgggaaccccactatcgacccgagcctcacgagggtcggtttcgtactctcatggactaccgtcgtcggtcgggacgtcgttactcgtgcgaagtactaaaccctaccttaccacctaggaaccactcgtcgtaccgttttagttttcgacgtagtacgtcgttacgtcttgttacgacggttggtaaacttgtaaccttcgggtaccgggccggtaaacgggtaccccgttaggtacccgttacccgtaccttcccgtacgtaccggtcccctacccggtaccgaaccgggtccccg

SEQ ID NO: 210995 - DNA, 712 bp, Homo sapiens
  misc_feature: GYAE6OF02IMIIS.7.78.H01.1.454.CMB.1.raw
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgctgcaagtccttctgatacatcttcactacttattctntcagttgggtccancggccctggacagctagacanatggatggactcacacgacacgcggacccactatcgccncggcctacgacgtacgggtcgtttagtcttctcctagtcgactaccgtcgtcggtccggggacggtctttacgtcgtaggcctaagtacctaaacccgtaacccttaccgtaacccgttaacggtaccaacctaccgttaccggtttaaccgtttttacgttttaggtaaccgtaacggttaccgggtccgtttaccggttgtttacgttcgttaacgggtagttactttacgggaaccggtttacgggtaccggggtacccggtaaccggggtttaacccgttgggttacccccgtaccccgttacgttacccgtccggttaccccggtacccccgttaacccgtaacccgggtaccccggggtaacccc

SEQ ID NO: 210996 - DNA, 841 bp, Homo sapiens
  misc_feature: GYAE6OF02F59TX.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggccacgacggcccctggacaaggccttgactacagtgggatcggatacaacgacccgacgaaccgtaccgggaacccccaccttaagtcgacccccgaacggtcccttacgaaccggtacgggtcgggttttacgttcgtttccgtacccgagttccggggaacttacccgttcgttagggttacccggggggtaccggtccgtttaagttccgttacggacgtaacggtaaaccttaaaaccccgttaaaccctttaacccgtaaacccgttaccggaaaccggtaacccgtaacccgtttaaccgggtttacccgttttttaaccggtttttttaccggttaacgggtaacgttaacgggtacccggtttccgtttcccggttacggttacgttaacgggttcgggttaaatttaccgggtaaccgtttaccgggtacggggaacccggttaacccggggtaaccccggtttccgggtaccccggttacccggttacccgttacccgtacccggtaccggtaacccccgttccccgtaaacccggtacccgggtaccccccgg

SEQ ID NO: 210997 - DNA, 614 bp, Homo sapiens
  misc_feature: GYAE6OF02GOD96.7.78.H01.1.454.CMB.1.raw
  modified_base (345)..(345): a, c, t, g, unknown or other
  misc_feature (345)..(345): n is a, c, g, or t
  modified_base (511)..(511): a, c, t, g, unknown or other
  misc_feature (511)..(511): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacgatccttcaacttactttattctgtcaaatttgggtccgacacgggcccctggaaccaaggccttgactacagtcgggatggatcaaacaccgganactcgggaaccccacctatcgcccaggtccttcacgagggtcggtttgtcttctaccgatggactacctctggtccgggacggtcttacgtctcgacgagactaaacccgtaacctacaacctgacacacgtcgtacgttttattttagacgtagacgtgtccgtntcgtctagtagtaattcgacttacggtcgggaccgtaacgggtaaccctgggtactacccggtctcccgtcgtacgtcccgtaccgaccgtaacgggtccccg

SEQ ID NO: 210998 - DNA, 773 bp, Homo sapiens
  misc_feature: GYAE6OF02GSAPF.7.78.H01.1.454.CMB.1.raw
  modified_base (404)..(404): a, c, t, g, unknown or other
  misc_feature (404)..(404): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaacgccttcgtggatacatcttcacttacttattctgtactaagttcgggccacgacggcccgtaggacaggccttgactacgagtggatggactacaaccgacgacgacgtaccgggaacccctactactcgaccgacggtcctacgacggtgggtcgtttgtcttcnctagtcggtactaccgtcgtacggtacggggtacgtctttacgtcgtacgacgtaacgtaaaccttaaacccgaacctttaacccgtaaacccgttacggaaacccgtaaccgttaccggttacggtttaacccgttttttacgtttttacggaacggggtacgtaacgggttcccggtttacgttccggttacgtacgggttaaggtacggttaaacgtacggttaaccggttacggggtaccggggtaacccggtaacggggttaacccccgtttcggggttaccccgtaacccggttttccgtccccgttaccgggtacccgttacccccggtaaccccggtaaccggtaccccgggggtaacccc

SEQ ID NO: 210999 - DNA, 777 bp, Homo sapiens
  misc_feature: GYAE6OF02F812L.7.78.H01.1.454.CMB.1.raw
tcagcgtgtctctacacgaccggtgctcgatttagtgtgagtagtttgggtttgggggacccgaacaacccacacccctcctaagaagaagcccctagacccacgagtctccgactaccattgggactggacctggaggatcctcttcttggtggcagtagcaacaggtgcccactcccaggttgcagctggttacagtctgggtctgattgagaagccgtggggcgtcagtggagcggtttgcctgcgacggtccttcgtggactacacgtcttctacttacttacttcgtgtactacgttcggtccgtacgtacggtcccgtaggacgtacggtccgttacgactacgtaggtacgggtacgtggacgtacgaacgtaccgacgaccgtaaccggaacccacgtacgtacgaccgacggtacctacgaacggtacgggttcggtttacgttccttcctacgtacgtacggtacgttaccgttcggtacggtaccgggtacgttacgttaccgtacgtacgtactaacgtaaccttaaaccctaccgttaccctaaccgtacgaactacctacgttaccgtttacgttttacgtttaggaaccgtagtacggttacgtcgtacgttacgtcgttagtacggttaacttacggtacgttaccgggacgggtaccggtaaccgggttaacccgttccgggtaacccgtaccccggttcccgttacccgtaccggttacccgttaccccgtaaccggtaccccggacccggtaccccgg

SEQ ID NO: 211000 - DNA, 614 bp, Homo sapiens
  misc_feature: GYAE6OF02F6JS6.7.78.H01.1.454.CMB.1.raw
  modified_base (198)..(198): a, c, t, g, unknown or other
  misc_feature (198)..(198): n is a, c, g, or t
  modified_base (248)..(248): a, c, t, g, unknown or other
  misc_feature (248)..(248): n is a, c, g, or t
tcagcgtgtctctacacgaccggtgctcgatttagtgtgagtagtttgggtttggggacccaacgaaccacacccctcctaagaagaagcccctagaccacgagctccacaccatggactcggacctggaggatcctcttcttggtggcagtagcaacaggtgcccactcccaggtgcagctggtacagtctgggtcngaattgaggagcctggggctcgagtgagcgttgcctggcgaagccgttcnggatacgagttccttacaccttacgttattctgtcaattgggtcccacacggccccctggaccaacggcccttgacctacagtcgggatggatccaacaccgacactcgggaacccccactactcgacccaggccttcaccgagggtcggtttgtcttctcagtggtactcctctcgtacgggacgtctagtctgcagactaacccaacttccaacctgacgactcgttcgtccgttttacttttcgaccgtagcggtaccgtcgttcttacggttctacggttaggtattagacgtacgtcgggccgtaagggtacccttggtaccaccgttcgtcctcgacggtccctcgaccgacggtccccg

SEQ ID NO: 211001 - DNA, 833 bp, Homo sapiens
  misc_feature: GYAE6OF02H1ZV8.7.78.H01.1.454.CMB.1.raw
  modified_base (248)..(248): a, c, t, g, unknown or other
  misc_feature (248)..(248): n is a, c, g, or t
tcagcgtgtctctacacgaccggtgctcgatttagtgtgagtagtttgggtttggggtacccgaacaaccacacccctcctaagaagaagaccctagaccacagctccacaccatggactggacctggaggatcctcttcttggtggcagtagcaacaggtgcccactcccaggtgcagctggtacagtcgtgggtctgaattgaggagccgtggggcgtcagtgagcgttgcctgcaagtccttcgnggatacatcttcactacttattctgtcaagttgggtccgacgacggtcccctggacgaacggtccttgactacagtcgggataggactacaacgaccgtacgacgtacgggaacccctacctagtccgacccgacgtccctttacgaacgtacgggttccggttttagtcgttccttacgagttggtaccttaccgtcgtacgggttaccggggtaccggtacgttacgttacgttcgtaccgtacgtaaccgttaaaccgttaaccccgttaaccttaaccgtaaccgttacggtaaccgaacgtttccggttacgtttttacgttttttaacggttaacgggttaccggtaacgggttaccgtaccggtttacgttaccgggtttacgtaacgggtttacggttaaaacgtttcgggttaacccgtttaccgggttaccgggggtaaccccggttaccgggggttaaaaccccggtttccggggtaacccgttaaccccgtttacccgggtttcccgttaacccggtccggtttaaccccccgtacccggttaaacccccgggtaaccggtaaccccccgggg

SEQ ID NO: 211002 - DNA, 760 bp, Homo sapiens
  misc_feature: GYAE6OF02JZGZR.7.78.H01.1.454.CMB.1.raw
  modified_base (256)..(256): a, c, t, g, unknown or other
  misc_feature (256)..(256): n is a, c, g, or t
  modified_base (428)..(428): a, c, t, g, unknown or other
  misc_feature (428)..(428): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagtcctggggcgtacagtgagcgtgcctgacagcttcgtggatacatctanacttacttattctgtactaattcgggtacgtacacggtcccctaggaacaaggccttaggactaaccgagttagggattagggactaccgaacgaacccgaacgacgtacgggtaaccccactacgtcgtacccgacggtcccgtttacacggtaagggtacccgggttttntcgtttcctaccccgtgttacgggaacttacccgtcgttcggtacgggggcgttacgttacgtcgtacggtacccgtacgtaaacgttaacccgtaaccttaccgaaccgtcggtaacccaacgttaccgtacgggtttacgttttacgtttacggtaacggtacgtactaccggttccgtaccgttagttaccgttaaggtacggttaaagttcgaaccgtttacgggacgggtaacccggaaccggttaaccggttacgtacccgggtttacccgtaccttcccgtacacccggttacctaacccggtacccgggaacggttacccccgg

SEQ ID NO: 211003 - DNA, 687 bp, Homo sapiens
  misc_feature: GYAE6OF02IJ3PU.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgatgaggaagcctggggctcagtgagcgttgcctgcaagccttctaggatacatcttcactacttattctgtactaagttgggtccgacacggtcccctaggaacaacggccttgactacagtgggataggatacaacgaccgacaacgtacgggaacccctactagtccgacccgacggtccttacgacgacgggtcgttttacgtcttcaccagtcggtacttaccgttgtcgggtaccgggtacggtactttactccgtagtaccgaagtaaccgtaaaaccctaccctttacaaaccgttcgaaaccgtaaccacgtttagtttaccgttttaattttacggaaacgtagtaggttcccgttacgttacgttacgtacgtaacggttagaaactttcggtactaccgggtcgggaccggtaacggtaacccgtaggtcctacccgtcttcctaccgtaccgtaccctaaccgtaccgacgggtacccc

SEQ ID NO: 211004 - DNA, 761 bp, Homo sapiens
  misc_feature: GYAE6OF02FET7L.7.78.H01.1.454.CMB.1.raw
  modified_base (243)..(243): a, c, t, g, unknown or other
  misc_feature (243)..(243): n is a, c, g, or t
tcagcgtgtctctacacgaccggtgctcgatttagtgtgagtagtttgggtttggggacccaacaaccacacccctcctaagaagaagccctagaccacagctccacaccatggactggacctggagatcctcttcttggtggcagtagcaacaggtgcccatcccaggtgcagctggtacagtcgtggtctgaattgaggagccgtggggctcgagtgagtcgttcgactgacacgtccttnggtatacattccttactacttactttacttcgtagtacgtaacgtttcgggacctacgccggtccgtaggaacgtacggtccttacgtactacgtagtagggtatacggtaactaccgaaccgtaccgacgtaaccggtaaccggaacccctacgtacgtccggacctacggtccttacgacggtagggtttcctttacgtacctcgacgtacgttaggtaaccttacccggttcggtacggtaccgggtacgttcgttactcgtagtaaccgtaaccgtaaccttaacccgtaacctaaccgaacggtacgtacctaacgttaccggtttacgtttacgttttaggttaccgggtaacgacggtccgtaccgtttcgtacgttacgtacggtaagttacgtcggtttacgaccggttacggtaccgggtaacccggtaacgggttcccgtaccgtaacccgttcccgttaccgttccgaccgtacccgtaccctaacccggacgtaaccccggtccg

SEQ ID NO: 211005 - DNA, 655 bp, Homo sapiens
  misc_feature: GYAE6OF02FJ1W2.7.78.H01.1.454.CMB.1.raw
  modified_base (448)..(448): a, c, t, g, unknown or other
  misc_feature (448)..(448): n is a, c, g, or t
tcagcgtgtctctacacgaccggtgctcgatttagtgtgagtagtttgggtttggggacccaacaaccacacccctcctaagaagaagcccctacgaccacagctccacaccatggactggacctggaggatcctcttcttggtggcagtagcaacaggtgcccactcccaggtgcagctggtacagtctgggtctgaattgaggaagcctggggcgtcagtgagcgttgcctggcaagccttctggatacatcttcactacttattctgtacaagtttgggtcccgacacggccccctggactaaggcccttagacttaacgagtgggtatggatacaacgacccgacactacgggaaccccactactgcccaggtcccttcacgaggggtcggtttcgtccttcgcctagtcggactcccgtctggtaccggggacgtctagttcncggactacgtactaaacccgtaaccttcgaacccgttgaaccgactacttcggttaccttttagttttacggacgtaagtacgtcgttccgttcgtcgtacgtaggttagtagttagaccgttacggtcgggacccgtaaggtacccgtaggtccgtaacccgtctacccgtcgacccgtaccgacccgaccggtaaccggtccccg

SEQ ID NO: 211006 - DNA, 820 bp, Homo sapiens
  misc_feature: GYAE6OF02HSZ4C.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagtcgttgcctgcaagccttcgtaggatacactcttactacttacttattcgtgtactaagttcgggtacccacgacggaccccgtaggaacgtaacggtccctttaggaaccttaacgaaggttggggaagttacgggaacttaccgaaaacccgtaaccgaaccgtaaccggtaccgggaaaccccctacgtacgccgacccgtacggtacccttacgaacggtacggggttacggttttcgtccgtttacgtacctagttacggtaacttacccggttcgtacgggtaccggggtaacggttacccgtttaagtccgttacggaaccgtaaacgtaaaaccgttaaaccccgtaaacctttacccgaaacccggttacgaaacccgggttaaccctacggtttaccggtttaccgtttttaaggttttacggacgtacggtacggttccgtacgttcgtacgttacgtacggttacgtaacgttacgtaaccgtacgggtccgggaaccggtaaccggtacccgtaccggtaccctaccgttaccgttccgtaccgtacccgtacccgtaaccccgaaccgggtacccgtacccgg

SEQ ID NO: 211007 - DNA, 735 bp, Homo sapiens
  misc_feature: GYAE6OF02IQGU4.7.78.H01.1.454.CMB.1.raw
  modified_base (255)..(255): a, c, t, g, unknown or other
  misc_feature (255)..(255): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctggtctgaattgaggagcctggggcgtcagtgagtcgttcggcctgccaagtcccttcgtggatacntcttacactacttattctcgtcaattcgggtccgacacggtccccgaggtaacgaacggtccttagactaacgagtgggagtggatacaacctaaccgacgtaccgtacgggaaccccctaactacgtcgccctacggtccttacacgtacggggtcggttttcgttccttcgtccagtacggacttaccgttcgtcggtcgggaccggttctttacgtcgtgtcgtaagtaactaaaccctaaccttaacccaacgttcgaaccgtacctaccgttcgttaacccgtttttattttacgtaacggttagtaccgtcggtttacgttccgttcgttacgtaaggttacggttaacttaggtaccgttacgggtaccgggtaccgggtaaccgggtaaccccgttgggtaccccgtacccgggttaccttacccgttaccctaccggtcccctaacccgtacccggtaccgggtacccccg

SEQ ID NO: 211008 - DNA, 810 bp, Homo sapiens
  misc_feature: GYAE6OF02H79NN.7.78.H01.1.454.CMB.1.raw
  modified_base (439)..(439): a, c, t, g, unknown or other
  misc_feature (439)..(439): n is a, c, g, or t
tcagcgtgtctctacacgaccggtgctcgatttagtgtgagtagtttgggtttgggggacccaacaaccacacccctctaagaagaagcccctagaccacagctccacaccatggactggacctggaggatcctcttcttggtggcagtagcaacaggtgcccactcccaggtgcagctggtacagtctgggtctgaattggaggaacgccgtgggggccgtcaggtgagtcgttgcctggcaagtccttctggatacattcttcacttacttattctgtcaagttcgggtaccgacgacggtcccctggacgaaggtactagactacagtcgggatggactaccaaccgaccgacaccgtacgggaacccccacgtactccggcccgacggtcccttacgtaaccggacggggtccggttttcgtcttccgttacccngttacggaccttaccgtcgttcgggtacggggaccgtcgtttacgtcgtagaccgtaagttaacgtaaaccctaaccctttacctaaaccgttccgaacccggttaaaccgtaccgttaccggtttaccggtttttaactttttacgggtaaccggttacggttaaccggtcccggttttaccggttcggttacgggtttacctacggggttaggttaaaccgttacgggtaacccgttacgggttccgggggtaacccggtaaccggggggttaaccccgttaccgggtacccggttaaccccgttcccgttacccgttacccgtacccggtaccccctaccgggttacccccggacccggggtaccccc

SEQ ID NO: 211009 - DNA, 618 bp, Homo sapiens
  misc_feature: GYAE6OF02H3I16.7.78.H01.1.454.CMB.1.raw
  modified_base (242)..(242): a, c, t, g, unknown or other
  misc_feature (242)..(242): n is a, c, g, or t
  modified_base (433)..(433): a, c, t, g, unknown or other
  misc_feature (433)..(433): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttcnggatacatcttcactacttattctgtcaattgggtccgacaggcccctaggacaaggccttgactacagtgggatggatcaacgaccgactacgtacgggaaccccacctacgtcgcccacggtccttcgacgtacgggtcggttttgtcttctctagtgactactcgtgtccggggacgtcttatctcgnacgtaactaacctaccttacaaccgtgacgacctatcgttacgttttacttgtacgagtacgtccgttacgtcgttcgtactagtaggtaagttcgtaacgtcggttcggggaccggaacggtacccgtggtaccgtacccgttcgttccgtacgccgtacccgtaccacccggtacggtacccc

SEQ ID NO: 211010 - DNA, 563 bp, Homo sapiens
  misc_feature: GYAE6OF02IY8UT.7.78.H01.1.454.CMB.1.raw
  modified_base (242)..(242): a, c, t, g, unknown or other
  misc_feature (242)..(242): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttcnggatacatctcactacttattctgtcaattgggtccgacaggcccctggacaaggccttgactacatgggatggatcaacaccgacactcgggaaccccactatcgcccaggccttacacacgggtcggtttcgtcttctccagtcggatacctctgtcgggacgtcttatctgcagataaccacttcacctgacgacactgtccgtttattttgacgagtacgtcgtacgtctgtctagtggtaattcgactacgtcgggaccacgggtaaccctgggtcctaccgtctacctcgtacgtccctaccgaccgacggtccc

SEQ ID NO: 211011 - DNA, 764 bp, Homo sapiens
  misc_feature: GYAE6OF02HK6H1.7.78.H01.1.454.CMB.1.raw
tcagcgtgtctctacacgaccggtgctcgatttagtgtgagtagtttgggtttgggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcacttacttattctgtactaagttcgggtccgaacgacggccccttagggaaccgtaacggaccctttggaaccttaacgagtaggggactcgggaactacctaacacccggtactaaccggtaccggggaaacccccctacgtacgtcggacccgtacggtcccttcgaacggtacggggttaccggttttcgtcctttccgtaccgtaagtacgggtaacttaccccgtcggtttcgggtacggggtacccggttcttacgttaccgtcggtaccaacgtaacttaaaccctaacccgttacctaacccgtacgaaccgtacctacgttaccgttacgttttacgttttacggtacggtaggtacgttccgtacgtccgttgtacgtaggttcgtaacgttcgtacgtacgggtaccgggtaccggtaaccgggtaccgtcggttacccgtaacccggttcctacccgtcgtacccgacccgtaacccgaccggtaacccggtacccg

SEQ ID NO: 211012 - DNA, 638 bp, Homo sapiens
  misc_feature: GYAE6OF02FZHEO.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtcaattgggtccacaggcccctggacaaggccttgactacatgggatggatcaacaccgacacgtcgggaaccccactatcgcccaggccttcacgagggtcgtttgtcttctcctatggtactacctccgtggtccggggtacgggtactttacgtcgtacgtcgaacgtaactaaacccgtaaccttacccgaaacctcggaaccgactacgttcgtaccgtttttagttttacgacgtagtacgtcgttcgttcgtacgttacgaggtcggtaattgaccgttacgtcgggaccgacgggtaaccctgggtccctaccgttcctaccgttcccgaacgtccccgtacccgaccgtacccgggtccc

SEQ ID NO: 211013 - DNA, 673 bp, Homo sapiens
  misc_feature: GYAE6OF02HFEQD.7.78.H01.1.454.CMB.1.raw
  modified_base (242)..(242): a, c, t, g, unknown or other
  misc_feature (242)..(242): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagcccttntggatacatctcacttacttattctgtctaattgggtccacgacggcccctaggactaacggccttacgactaccgagttagggatcggatacaaccacgacacgtacggaacccctactagtcgcctacggtccttacggcggggtacgtttcgtccttaccgtccgtaacgtcggtaacttacccgttcgtacgggtaccgggggtaccgtctttaacgtcgttacgacgtaaacggtaaactaaacctaaccctttaccaaccgttcgaaccgtacctacgtcgttaccgttttattttacggaccgtagtcgacgttcgtacgttgttcgagtagtaacgttcgacgttacggcgggactaccgggaaccctggtacctaccgttcgccctacggtacctacccgacctaaccggacggtccctcgg

SEQ ID NO: 211014 - DNA, 716 bp, Homo sapiens
  misc_feature: GYAE6OF02H2OH3.7.78.H01.1.454.CMB.1.raw
  modified_base (625)..(625): a, c, t, g, unknown or other
  misc_feature (625)..(625): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtcgtgggtctgaattggaggaagccgtggggcgtcaggtgagcgttgcctgaccaagtccttggggtagactacattccttacacttactttattcgtgtactaagttcggggtaccaacacgggtccccctaggaactaacggtcctttagaccttaacgagtgggatggaactacaaccgtacgaccgtacgtaccggaacccctaccgtagtccgacccgtacgttcccttacgaaccggtaggggttcggttttctaccttaccgtccgtagtacggtaccttacccgtcggtttcgggtaccggggaccgtcgttttacgtccggtgaaccgtacgttaaccttaaacccgtaccctttaccgaaccgtacgaaccgtactacgttcgtttaccgttttatttcggacgtacgcgttcgtcgtgtctagtaggnttaacgtcgtacgtaccgggttcgggaccgtaaccggtacttggtaccctaccgtctaccggtccaccgtcccaacgaccgtaccgtcccg

SEQ ID NO: 211015 - DNA, 772 bp, Homo sapiens
  misc_feature: GYAE6OF02IG4XP.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggctcagtgagtcgttgccctgcaagcctttctggactacatcttcacttacttattcctgtctaaagttcgggtccgacacgggtccccctgggaacaaggtccctttagacctaacgtagtggggtactgggactacaaaccgaccgaacacgttacgggaaaccccctactaagtcgacccgaggtcccttacggaccggggtcggtttactacgtttcaccgtagtcggtaacttaccgtcgtgggttccggggaaccgtctttactccgttagaccgtaagtaccgttaaaaccctaaaccgttacctaaacccgttaggtaaccgtaaccgtacgttaccggtttaccgtttttaagttttacgtaaccggtaacggtacggttaccgttcgtaccgttcgtaccgtaggttacggtaaacgttaggtaaccgttaacggtaccggggtacccgtaacggggtaaccccgttacggtacccgtacccgttcctaacccgttccgaaccgttacccccgtaacccgtaacccggacccgggtacccctaaccggg

SEQ ID NO: 211016 - DNA, 662 bp, Homo sapiens
  misc_feature: GYAE6OF02IL8LC.7.78.H01.1.454.CMB.1.raw
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (523)..(523): a, c, t, g, unknown or other
  misc_feature (523)..(523): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgattgaggaagcctgggcgtcagtgagcgttgcctacaagccttctgatacatcttcactacttattctgtctaagttgggtccgacacggcccctaggacaacggtccttgactacagtgggatggatcaacaccgacacgtcggaacccactatcgccagcctnacgngggtcgttgtctctctagtcgtactacctcgtcggtcgggacgtcgtttactcgtcgactacgaactaaccctaaccttacgtaacccgtacgaaccgtacgtacgttcggttaccgtttttaagtttttcgaacggtcgtaacggtccgtttacgtnttacggttacgtaggttcgtaaagtttccgtaagttaccgggtacgggtaccggtaaccggtacccggttacggcccggtaccgtttaccgtcccgtaccgccgtacccgttaccccaacgtaaccggccccgtaaccg

SEQ ID NO: 211017 - DNA, 825 bp, Homo sapiens
  misc_feature: GYAE6OF02GD1LB.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcacttacttattctgtcaagttggtccgaacacggtcccccgtggaccaacgggtccctttgaaccttaacgacgtggggtacttagggataccgaaaccacccgaacgaccgtacgggaacccccacctagtcggaccccaggtcccttacgacgtacggggtcggtttttcgtcctttaccgtaccctaagttacggtaacttacccgttcgttcgggtacggggtaccggtctttagttccgtggtacctaacggtaaaccttaaaccccgttaaacccttacccgtaaaccctacgggtaaccctaaccgtaacccgtttacggttaacccgtttttttaacgtttttacgggttaacccggtaaggttaccggttccggtttaccggttccgttacgggtttaccgtaggttacgggttaaacgtttccgaaccgtttacgggtaccgggggtacccgttaaaccgggggtaccccgttcgggttacccccgttaaccggttcccgttacccgtacccgtaacggtaccccccggttacccgtaaccccgggaaccgggttcccccg

SEQ ID NO: 211018 - DNA, 740 bp, Homo sapiens
  misc_feature: GYAE6OF02HQ4HC.7.78.H01.1.454.CMB.1.raw
  modified_base (222)..(222): a, c, t, g, unknown or other
  misc_feature (222)..(222): n is a, c, g, or t
tcagcgtgtctctacacgaccggtgctcgatttagtgtgagtagtttggggtttggggacccaacaaccacacccctcctaagaagaagcccctagaccacagctccacaccatggactggacctggaggatcctcttcttggtggcagtagcaacaggtgcccactcccaggtcgcagctggtacagtcgtgggtctgaatggaggaagccgtggggcgtnagtgagcgttgcctgactaagccttcgtggatacatcttcattacttattctgtacaagttggtccgacgacggcccctaggactaaggtcccttagactacagtggggatggactacgaacaccgtacaacgtcggaaccccactatcgaccgtacggccttacgacgtaggggtccgttttcgtcttcgtacctagtacggtacttaccgtcgtcgggtacgggtacgtactttactcgtcgacgaacgtaactaaacccaaccttaccgaaaccgtacgaacgtacctacgttacgttaccgtttttaacgttttacgggaacgtaggtaacggttccggttactttccggttacgtacggttaaggttacggttaagttcgttaacgtaccggggttcggggaacccggtaacggggttaaccccttgggttaaccccggttacccggttcccgtttcccgacccggttaccgtacccccgttaaccgaccccgggttaacccggggtaccccg

SEQ ID NO: 211019 - DNA, 848 bp, Homo sapiens
  misc_feature: GYAE6OF02HVR3W.7.78.H01.1.454.CMB.1.raw
  modified_base (836)..(836): a, c, t, g, unknown or other
  misc_feature (836)..(836): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagcgtggtacagtcgtggtctgtaattggaggaagccgtggggcgtcagtgagtcgttgcctgacagtccttcgtaggatactacttcttaccaacttaactttactttcgtacgttacgtaagtttcggggtaccgaccgtaccggtaccccgtagggtaaaccgtaacggttcccgtttacggtaacctaacggtaggtacggggtaagttacgggtaacttaaccgaaacccgtaacccgtaccgtaaccgggtaacccgggtaaaacccccctaaccgttaacgtaccggaccccgtaacggttaccccgttaacggtaaccgggtaacggggttccggtttttacgttacccgttttacccgtaccggttaacgttaccgggtaacctttaccccgttcggttaccggggttaccggggtacgtttacctttaacgttccgttaacggaaccgtaacgttaaaacccttaaaccccgtaacctttaaccgaacccgttagaacccgttaacgtacgttacggttttaaccgtttttagtttaccggaacgtacggtacgttccgttagttccgtacgtacgttaggtagtattcgacggtacggtcggtaccgaacggtccgttgaccgttccgtctcgtacgccgtccccgtaacnccggaccgtccg

SEQ ID NO: 211020 - DNA, 669 bp, Homo sapiens
  misc_feature: GYAE6OF02HQ7C8.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcagtgagcgttgcctgcaagccttctggatacatctcacttacttattctgtacaagttcgggtccacgacggccctaggaccgtaaggtccttgacctacgagtgggatggatacgaacaccgacacgtacgggaaccccaccgtatccgacccgacggtcccttacgacgtacggggtacggttttcgtccttacgtcctaagtcggtaacttcccgtacgtcgggtacggacgtcttagtccgtgacgaagtaacctaaacctaccttacaacctgtaaccgtacgacttcgttacgtttttattacgtacgtacgtacggttcccgtcgtctacgttcgtagggttacgtatcggtacgtaccggtcgggtcccgaacggtacccgttaggtcccctaaccgttcccttaccgaccgaccgtccccgtacgacccggtaacggtcccc

SEQ ID NO: 211021 - DNA, 825 bp, Homo sapiens
  misc_feature: GYAE6OF02IUJLD.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtactaagttcgggtaccgacacggtccccctaggaacaacgggtccctttaggacctacgagtgggatggactaccgaacgaccgactacgtaccgggaacccctacgtacgtcgccccaggtcccttacgaccggtacggggtcgtttttcgtcctttctacccgagtacgggtaccttacccgtcggttggtcccgggggaacgtcctttagtccgtaggacgtaacggtaaacctaaacccgttaacccgtttaccaaacccgttacggaaacccgtaacccgttaccggttacgtttacccggtttttagtttttacgggtaacgtaaggtacggtacccggtttcgtccgtttacggttaccgaagggtttacggtaacgtttacggtaacccggtttacgggttcccgggggtaccccggtaaaccgggggttacccccgtttacggggttaccccgttaacccccggtttcccgtttaccccgtaacccgggtaaccgttacccccccgggtaaccgtaacccccgggtaacccgggggtttacccccc

SEQ ID NO: 211022 - DNA, 665 bp, Homo sapiens
  misc_feature: GYAE6OF02H85FY.7.78.H01.1.454.CMB.1.raw
  modified_base (639)..(639): a, c, t, g, unknown or other
  misc_feature (639)..(639): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattggaggagcctgggggcgtcaggtgagtcgttgcctgcaagccttctggatactatcttcacttacttattcctgttcaagtttcgggtaccgacgaccggtcccctaggacaacgggtccttagacctactagtggggatggatccaaccgaccgacacggtacgggaacccctactagtcgccacggtcccttacgaacgcgggtcgtttcgtcttctcagtcgtactaccctggttcggtccggggtacgtctttacgtcgtgtacgtaacgtaactaaccccgtaaacctttaccgtaaaccgttacgaccgtacctacgttccgtttaaccgtttttagttttacgacggtagtacggtcgttcgtcttgtacgtagttgaacttcgacttacggcgggaccgtaacggaccgttggtacctccgtcctcctacnccgtcctacgacccggtaggtacccc

SEQ ID NO: 211023 - DNA, 864 bp, Homo sapiens
  misc_feature: GYAE6OF02JOSB8.7.78.H01.1.454.CMB.1.raw
  modified_base (244)..(244): a, c, t, g, unknown or other
  misc_feature (244)..(244): n is a, c, g, or t
  modified_base (539)..(539): a, c, t, g, unknown or other
  misc_feature (539)..(539): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaatgaggagccgtggggctcaagtgagcgttgcctgcaagccttacgnggatacattccttcacttaaccttattctgtactaagttcggggtaccacgacggccccgttaggaaccgaacgggtcctttaggaacctacctaggtacggggtactgggtactaccgaacgaccggtaactaccggtaccgggtaaacccccacgttactaccgacccgtacggtacccttaccgaacggtacgggggttacgggtttcgtacctttccgtaccgtaagttcgggtaaccttaaccccttcgggttacgggttaccgggggtaaccggttacgtttttaaacnccggttaggtaccgtaaacggttaaaccttaaacccccttaaaaccgttttaccaaaacccggtttggaaacccgttaaacccgtaaccggttttaccggttaacccggtttttttaacgttttaccggtaacggtaacggtaaccggttccggtttaccggtttaccgttagttaccgtagggtttaaacggtaacttcgggtaacccgtttacggggttaaccggggaccctaaccgggggtaaccctttacgggggtaccctaccggtttaccctcccgtacgtaaccgtccccgtaacccggtaccccgaggggtaccccc

SEQ ID NO: 211024 - DNA, 842 bp, Homo sapiens
  misc_feature: GYAE6OF02JELIR.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatgaactggacctggagatcctcttcttggtgcagtagcaacaggtgccccaactccccgaggtcgcacgcgtaggtactaggtccgtcgggtctagtaattggaaggacgccggtggggctcgagtgacgtcgttcgacctgacgtaacgtcccttcgtaggactaccgtactttccttaccgtaactttacctttaagttccttacgtaacgtaacggttccgggtacccggaacgcccgggtcccccgtagggaaccgtaacgggttcccgtttaaggaaccgttaaccgtaggttaggggtaacgttacgggtaacttaacccgaaaccgtaacccggaaccgtacccggtaacccgggtaaacccccctacgtagtaccccgaccgtaaccggttcccttacggaccggtacggggttccgttttcgtaccttccgtacctagtacgtacctcccttggtccggttacgggcttacgttactacgtcgaaccagtaacctaacccgtaacgttaccaacggtactacgaccgttacgtttaccgttaccgttttttagtaccggtactacgggtacccgttcgtacgttccgttagtcgttaggtacgttaaacgtcgttaccttacgggccggaacccggttaaccgggtacccttcggtaaccccgttacccgttccgtccgacccggtccgaccccggttacccgaaccgggtcccgtaccgg

SEQ ID NO: 211025 - DNA, 688 bp, Homo sapiens
  misc_feature: GYAE6OF02FH24H.7.78.H01.1.454.CMB.1.raw
  modified_base (219)..(219): a, c, t, g, unknown or other
  misc_feature (219)..(219): n is a, c, g, or t
  modified_base (372)..(372): a, c, t, g, unknown or other
  misc_feature (372)..(372): n is a, c, g, or t
  modified_base (409)..(409): a, c, t, g, unknown or other
  misc_feature (409)..(409): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtnagtgagcgttgcctgcaagtccttcgtggactacattccttacacttacttattctgtactaagttcgggtccgacaccggcccctaggacaacggtcttcgactaacgagtgggatggatccaacgaccgacacgacggaacccctactacncgaccgaggtcctcggacgggttcggtttctccttcncgagtcgtaactccgtcgtgggtccggacgtacttacgtcgtcgacacgtaacgttaaccctaaccttaccaaccgtgaaccgtaacgtaccgttacggtttaccgtttttaacttttacggaaccggtcgttaacggtccgttcggttccgttacgttaccgtaaggtttacgtaattacggtaccgttaggtccgggaccggtaacgggtacccgtggtcccgtacccgtcgtaccctcgtaccctcccgtacccgaaccggacggtacccctacgg

SEQ ID NO: 211026 - DNA, 757 bp, Homo sapiens
  misc_feature: GYAE6OF02I734D.7.78.H01.1.454.CMB.1.raw
tcagcgtgtctctacacgaccggtgctcgatttagtgtgagtagtttgggtttggggacccaacaaccacacccctcctaagaagaagccctagaccacagctccacaccatggactggacctggaggatcctcttcttggtgcagtagcaacaggtgtcccactcccaggtgcagctggtacagtctgggtctgaattgaggaacgccgtggggctcagtgacgtcgttcgcctgccaagtccttctggatacagttcttcacgtaactttattctgtcaacttcgggtcccgacacggtcccctaggaccaacggtccttagtaacctacgaagttcggggattcgggaactaccaaaccgacccgtaaccgaaccgtacggggaaccccctaaccgttacgtccggacccgtacggtccccttagaacccggtcggggtacggttttcgtcccgtttactcccgtaagtcgggtaaccttacccgttcggtacggtcccgggggtaaccgtcgtttaactcgttaacgtcctaacggtaaccttaaacccctaaccgttaccgtaacctcggaaactacctacgttacgtttcccggtttttatttaccgggaacgtaacgtcggtaccgttcgtacgtcgttacgaggttacgtaagttcgtaacgttccgggtacgggtacctaacgggtaacccgtcggtaccgttacccgtcctaccgtcctaccggcctacccgaccggcgtaaccccg

SEQ ID NO: 211027 - DNA, 728 bp, Homo sapiens
  misc_feature: GYAE6OF02JOYJD.7.78.H01.1.454.CMB.1.raw
  modified_base (172)..(172): a, c, t, g, unknown or other
  misc_feature (172)..(172): n is a, c, g, or t
  modified_base (187)..(187): a, c, t, g, unknown or other
  misc_feature (187)..(187): n is a, c, g, or t
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
tcagcgtgtctctacacgaccggtgctcgatttagtgtgagtagtttgggtttggggacccaacaaccacacccctcctaagaagaagccctagaccacagctccacaccatggactggacctggagatcctcttcttggtggcagtagcaacaggtgcccactcccaggtncagctggtacagtcngggtctgaattgagganccgtgggctnagtgagtcgttcgcctgacaacgtcttcgnggataccngttctcacttcttattctagtctaagtttcgggaccacgaccggtcccctaggaaccaggtacctttagacgtactagtaggggattggaactaccgaaacctaccggactacgtaccggaacccctaaccgtacgtcgtacccaacggttccctacggtacggtacggggtccggttttctaaccgttccgtacgtacgtacggtactacccgttcgtacgggtccgggtacgtacctttacgtcgtaccgacgtactaaaccgttaaccaaccgttaccgaaccgttcgaaccgttaacgtcttcccggtttaaacgtttttccgttcggttaacgacgtcggtacgttccggttactcggtacgtagttacggaatttcgaaccggtgggtaacccggacgtaaccgggttacgtccgtacgtaacccgttctacccggtctaccgtcccctacccgggaactcccgtaaccg

SEQ ID NO: 211028 - DNA, 763 bp, Homo sapiens
  misc_feature: GYAE6OF02I0U2J.7.78.H01.1.454.CMB.1.raw
  modified_base (159)..(159): a, c, t, g, unknown or other
  misc_feature (159)..(159): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttctggtggcagtagcaacaggtncccactcccaggtgcagctggtacagtcgtgggtctgaattgaggaagccgtggggcgtcgaggtgaggtcgttgcctggcaagtccttcgtggatacgattcttcacttacttattctgttactaagtttggggtccgactacggccccgtaggaccgaaggtccttggacttacgagtcggggataggactaccgaaacctacccgaacgtaacgtaccgggaaacccctaccttaacgtcggaccccgaacggtcccttaaccgaaccggtacggggtttcgggttttaccgttcgtttaccgtacctacggtacgtactacccgttcgttcggtccgggggaccggtttctttacgttcgtacggtccgaaacgtaccgtaaaaccccttaacctacccgaacccgttaggaacccgtaacttccggttccgtttaacgttttttacgtttccggaaacgtagggtaaccgttccggttacgtcgttcggtagtccgggtaagttacgttagtacgtacgggtcggacggtaaccggtaaccgtcggtaccgtaccttcgacccttcgcgttaccccgtaccgaaccgggtccctaccgg

SEQ ID NO: 211029 - DNA, 851 bp, Homo sapiens
  misc_feature: GYAE6OF02IAZTS.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattggaggaacgccgtgggggcgtcgaggtggagtcgttgcctgacagtccttctaggactactattcttactacttactttattctagtactaagttcggggtaccgtaaccgacggtcccccgtagggaaccgtaacggtccctttagaaccttaaccgtaaggttggggtaacttacgggtaactaccgaaaccaaccggaacccgaacggtaccgggaaaccccctacgtaccgtaccgacccgaacgtcccttacgacggtacggggttcgttttcgtcttcctactagtcggtaccttacctcgtacgggtccgggacgttactttacgtccgtagtaccgtaagtaaaccttaaacccaaacccgtttaccgaaaccgttaccggaaccgtaaccgtaccgtttacgtttaccggttttttacgttttaaggaacgggttacgtaacggttccggtttaccgttcggttacggtaaccggtttaggtaaacggtaatttacggaacccggttaccgggtaccgggggtacccgttaaccggggtaaccccgtttaccgggttaaccccgtacccggttcccgtttcccgaaccggttaacccgtaccccccgttaacctaaaccccgggggtacccgtaacccccgg

SEQ ID NO: 211030 - DNA, 754 bp, Homo sapiens
  misc_feature: GYAE6OF02FLH1A.7.78.H01.1.454.CMB.1.raw
  modified_base (240)..(240): a, c, t, g, unknown or other
  misc_feature (240)..(240): n is a, c, g, or t
tcagcgtgtctctacacgaccggtgctcgatttagtgtgagtagtttgggtttggggacccaacaaccacacccctcctaagaagaagccctagaccacagctccacaccatggactggacctggaggatcctcttcttggtggcagtagcaacaggtgcccactcccaggtgcagctggtacagtctgggtctgaattgaggagcctggggctcagtgagcgttgcctgcaagccttcngatacatcttcactacttatctgtcaagttcggtccgacacggcccctaggacaaggccttgactacagtgggatggatctaacgaccgacacgtacgggaaccccctacgtactccgacccgacggtcccttcacgacggggttccggttttagtcctttaccgccgtaagtcggtacttacccgttcgtcgggtccgggtaccgtctttacgtcgtagacctagtaaccttaaacccgtaacccttaccgtaaccgtcgtaaccgaaccgttaccgttaccgttaccgtttttaagtttttacggaaccggtacggtacggttacccgttccggttacgttcggttacccgttagggttaacggttaacgtttacggtaaccgttaccgggtacgggggtacccggtaacggggttaaccccttcggggttaacccgttaacccggttcccggttacccgttaccggtaacccgttccccgtaccccggtaccggtaacccgggtacccccg

SEQ ID NO: 211031 - DNA, 742 bp, Homo sapiens
  misc_feature: GYAE6OF02HLHYG.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacatcttcacttacttattctgtacaagttcgggtaccacgacggcccctggaacaaggtccttgactacagtgggaatggactcaaccaccgacacgtacgggaaccccactagtcgaccaggtcccttacacgtacgggtcgttttcgtcttactcagtcggactaccgtcgtggtaccgggacggtctttaagtccgttagactaacgtaaccgttaaaccctaacccgtttacaaacccgttcggaaaccgtaccctaacgttcggttaacccgtttttttaagtttaccggtaaaccggtacggtacggttacccgtttcgggttaccttaggttaccgtaagggttacggttaaaccgttttcgaaccggttacggttaccgggggacccgtaaaggggtaacccccttggggtaccccgtaacccgttccgttaccccggttacgacccggttaccccgttaacccgaccccgggtaaacggtcccccg

SEQ ID NO: 211032 - DNA, 763 bp, Homo sapiens
  misc_feature: GYAE6OF02H9BSW.7.78.H01.1.454.CMB.1.raw
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacagggtgcccactccccaggtgcagctggtacagtctgggtctgaattggaggagccgtggggcgtcagtgagtcgttgcctgcagtccttcgtgactacatctcacttacttattctgtctaagttcgggtccgacacggccctggaccaggtccttgactacagtgggatggatacaaccaccgacaccggtacgggaaccccaactcgcgcccgtacggtcccttacgacgtcggggtcgttttcgtccgttactcccgtaagtcggtaaccttcgttacgtcggtacggggccgtctttacgtacgttgacgtaagtacctaaacccgtaaccttaccctaaacgtccgtaaccgtaaccgttacgttaccggttttaccgtttttacgtttttccggtaaacggttaacggttaaccggtttcccggttccgtttcgttaccggttacggtacggtttaggtaacgttcggtaccgttacgggtccgggtaaccggtaaccgggttaccccgggttcgggttaaccccggttaccccggtcccttacccgttacccggtacccgttaccccttaacccggacccccgggtaacccgggtaccccg

SEQ ID NO: 211033 - DNA, 596 bp, Homo sapiens
  misc_feature: GYAE6OF02FI7VH.7.78.H01.1.454.CMB.1.raw
  modified_base (239)..(239): a, c, t, g, unknown or other
  misc_feature (239)..(239): n is a, c, g, or t
  modified_base (346)..(346): a, c, t, g, unknown or other
  misc_feature (346)..(346): n is a, c, g, or t
tcagcgtgtctctacacgaccggtgctcgatttagtgtgagtagtttgggtttggggacccaacaaccacacccctcctaagaagaagccctagaccacagctccacaccatggactggacctggaggatcctctcttggtggcagtagcaacaggtgcccatcccaggtgcagctggtacagtctgggtctgaattgaggaagcctggggctcagtgagcgttgcctgcaagccttcnggatacatcctcactacttattctgtcaattgggccacaggcccctggacaaggccttgactacatgggatggaatcaaacaccgacacgtcgggaaccccactacngaccctagccttcgacaggggccggtttagtcttccgtcctagtggtacttacctactgtcgggtacggtctatctggcagataacccaaccttacacctgaccgataccgtgtccgttttaatttttcgacgtagacgtacgtcgtctacgtcgagttcggtaattcgtacttcgcggggtccgtaagggtaaccctggtacccgaccgttactcctacgacgtcccgtcccgacctaacggtaccccg

SEQ ID NO: 211034 - DNA, 780 bp, Homo sapiens
  misc_feature: GYAE6OF02I7J06.7.78.H01.1.454.CMB.1.raw
  modified_base (174)..(174): a, c, t, g, unknown or other
  misc_feature (174)..(174): n is a, c, g, or t
  modified_base (213)..(213): a, c, t, g, unknown or other
  misc_feature (213)..(213): n is a, c, g, or t
  modified_base (362)..(362): a, c, t, g, unknown or other
  misc_feature (362)..(362): n is a, c, g, or t
tcagcgtgtctctacacgaccggtgctcgatttagtgtgagtagtttggtttggggaccgaacaaccacacccctcctaagaagaagcccctagaccacagctccacaccatggactggacctggaggatcctcttcttggtggcagtagcaacaggtcgcccactcccgaggngcagctggtacagtctgggtctgaatgagagctgggctnagtgagcgttgctgcagtccttcgtggatacacttcttacacttactttagtaccttgtctaagttcgggtaccgtacgacggtccccgtggaacacggtccttagaccttacgagttgggaattcgggaatacgtaaaccgacccganaaccgttaccgggaaaccccacttaccgcggcccacggtccttaccgacgggtacggttcggttttcgtacctccgtctaacgttcggaccttacgttacgtcggtaccgggtaccgttactttagtcgtcgaaccgttacggtaaaccctaaacccgttaaccgtttccaaaacccggttacgaacccgtacgtttaaccggttcgttttaaccgttttttacggttagaaacccgttgggtaccccgtttaacgttggttacccggttacgttacgggtaggtttccgttaaagttccaaaccgggttttcgaccggggtttaccgaaaccggggttaccctaggggttcccctaacccgggtttcccggttaccgaccgggttaccccaccgggtaacccggccggttaaccccg

SEQ ID NO: 211035 - DNA, 660 bp, Homo sapiens
  misc_feature: GYAE6OF02HIBFV.7.78.H01.1.454.CMB.1.raw
  modified_base (481)..(481): a, c, t, g, unknown or other
  misc_feature (481)..(481): n is a, c, g, or t
  modified_base (516)..(516): a, c, t, g, unknown or other
  misc_feature (516)..(516): n is a, c, g, or t
  modified_base (544)..(544): a, c, t, g, unknown or other
  misc_feature (544)..(544): n is a, c, g, or t
  modified_base (633)..(633): a, c, t, g, unknown or other
  misc_feature (633)..(633): n is a, c, g, or t
tcagcgtgtctctacacgaccggtgctcgatttagtgtgagtagtttgggtttgggggacccaacaaccacacccctcctaagaagaagcccctagaccacagctccacaccatggactggacctggaggatcctcttcttgggtggcagtagcaacagggtgccccactccccgaggtgcagctggtacagtctggggtctgaattggaggaacgccgtggggctcgagtgagcgttgccgtgcgaagtccttcgtggatactacttcttcactacttattctgtactagttcgggtaccgacgacggcccgtaggacaggtccttgactacaggtcgggatggactacgaaccaccgtaccgacgttaccggaaacccctactacgtcgacccgacggtcctacgaacgtaggggttccgtttacgtcctccgtacgtagttacggacttcgtcgtcgggtaccgggtcgtactatcgngtacgaactacgtaacctactcaacctcacgtacncgttctcgtttatttacgcgtagtacgngtacgtcgtagtcgaggttagacgttactagtacggtcgggaaccgtccgggtaacccgtcggtaccgtaccgtacttaccggtaccgnttacccccgactaccggtaccgacccg

SEQ ID NO: 211036 - DNA, 612 bp, Homo sapiens
  misc_feature: GYAE6OF02JHQ3R.7.78.H01.1.454.CMB.1.raw
  modified_base (312)..(312): a, c, t, g, unknown or other
  misc_feature (312)..(312): n is a, c, g, or t
  modified_base (397)..(397): a, c, t, g, unknown or other
  misc_feature (397)..(397): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcgaacaggtgcccactcccaggtgcagctggtacagtctgggtctgaattgaggaagcctggggctcgagtgagcgttgcctgcaagccttctggatacatcttcactacttattctgtcaattggtccgacacggcccctggacaaggccttgactacgntgggatggatacaaccgtaccgactacgtcgggaaccccctactaatcgacccaggcccttcgacgagggtcggtttgtccttcnccatacggtactacctcgtacggtccgggacgtcttatcgtcgacagtaactaacctaccttacaacctgacgactactcgtccgttttatttcgacgactagtcgtcgtcgtgtcagttagattcgactacgtcggaccgtaacgggaccgttggtcccgtaccggttcctacccgtacgtaccgtcccgtacccgtaccgtacgggtaccccg

SEQ ID NO: 211037 - DNA, 716 bp, Homo sapiens
  misc_feature: GYAE6OF02JOO37.7.78.H01.1.454.CMB.1.raw
  modified_base (290)..(290): a, c, t, g, unknown or other
  misc_feature (290)..(290): n is a, c, g, or t
  modified_base (369)..(369): a, c, t, g, unknown or other
  misc_feature (369)..(369): n is a, c, g, or t
tcagcgtgtctctacacgaccggtgctcgatttagtgtgagtagtttgggtttggggacccgaacaaccacacccctcctaagaagaagcccctagaccacagctccacaccatggactggacctggaggatcctcttcttggtggcagtagcaacaggtgcccactcccgaggtgcagctggtacagtctgggtctgaattgaggaagccgtggggctcagtgagtcgttgcctggcaagccttcgtggatacattctacactacttatctgactaagttggtaccacncggtcccctaggaacacggtccttagacttacagtgggactggactacgaacaccgacaccgtcgggaaccccacgtancgtacccgacggtccttacgaagtacgggggttcgttttacgacctttaccgtactacgttacgggtaccttacccgttcggtttacgggtaccgggggtacgtacgtttatccgtacgtacgaacggtaactaacccgtaaccttaccgaacgtcgaaccgtacgacgttacggttaccttttagttttcggaaccgaggtacgttccggtttcgtacttcgtacgtaggttagtaacgttgtaaccgtcggttaccggggaccgttaaccgggacctttacgggacccttacccgtacgttccgaccgtacggtccccgtaacccgtaccggaaccggttacccg

SEQ ID NO: 211038 - DNA, 730 bp, Homo sapiens
  misc_feature: GYAE6OF02HF4JJ.7.78.H01.1.454.CMB.1.raw
  modified_base (252)..(252): a, c, t, g, unknown or other
  misc_feature (252)..(252): n is a, c, g, or t
  modified_base (387)..(387): a, c, t, g, unknown or other
  misc_feature (387)..(387): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtgggctcagtgagtcgttgcctggcaagcccttcgtggactacnttcctacaccttacttattctgtactaagttcggggtaccactacgggcccccttagggactaacggtcctttaggaacctagtacggtgggtaatgggactccaaccgaccgacgaccgtacgggaaccccccncctagccgcccaggtcccttcacgtcgggtcgttttgccttctcgagttcgacttacctcgtacggtcggagtcctttagtctggactacgaacttaacccacttaccaacctgaaccgtacacttcgttaccgtttttatttaggacgaggttacgtaccggtttcttacgttcgggtaccttagggtggttaaaacctttgggaaccgtttaccgggtaccgggggtaacccgtaaaccggggttacccgttacgggttacccccggtaccgttttacccgacccgttcccggtaaaccctccccgggttaacccccgaccggggttaacccggtcccccg

SEQ ID NO: 211039 - DNA, 731 bp, Homo sapiens
  misc_feature: GYAE6OF02GVHNZ.7.78.H01.1.454.CMB.1.raw
  modified_base (366)..(366): a, c, t, g, unknown or other
  misc_feature (366)..(366): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaagttgggtccgacacggcccctgggaccaaggtccttaggactacgagtgggatcggatacaacaccgacaccgtacgggaaccccctacgtacncggaccccaacggtcccttacgaacgtacggggtcggttttcgttccgttacctccgtaagtcggtacttacccttcgtcggtccggggaccggtctttacgtccttggacgtaacgtaactaaaccctaacccttacgaacctaggaccgtacctacgttcgttacgtttttacttttaggtaaccgtaggtacggtccgtttacgttcgttacgttacgaggttcggtaaagtttcggaacgtttacgggtacggggaccccggttaacggggtaaaccccgttcgggtacccttacccggtttacttccccggtacgtaacccggttaccccgtaccctaaccccgggtacgggtacccccg

SEQ ID NO: 211040 - DNA, 785 bp, Homo sapiens
  misc_feature: GYAE6OF02JPSYU.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtcgtgggtctggaattggagggaacgccgtgggggcgtcaggtgaggcggtttgcctgacaacggtcccttcgtggatacacttcttcacttactttattctgtactaagttcgggtccgactaccggcccctaggactaacggtccttaggtactacacggtgggaactggaactacgaaccgaccgtaaccgacggtaccgggtaaaccccctaacgtttacgaccgacccggaccggtccgttaccggggtaaccggggggttcggttttacgggttaccctttccgtaaccttacgtacgggttacccttacccgttaggttccggggtccggggtaacggttcgtttaccgtacgttacgtaccgtaacgtaaccgttaaaccctaccggtttaaccctaaaccgtcgtaaccgacttaccgttacgtttaccgttttttacggtttacgagttcggtacgttcgttagtccgttagacgttagtggttaccttaggctttacggtcggaccggtaggtaccccgtaggtcccgttcccgtaccggttcctaccggtaccggcctaacccggtacgacccggtccgttacccgg

SEQ ID NO: 211041 - DNA, 824 bp, Homo sapiens
  misc_feature: GYAE6OF02II0J4.7.78.H01.1.454.CMB.1.raw
  modified_base (163)..(163): a, c, t, g, unknown or other
  misc_feature (163)..(163): n is a, c, g, or t
tcagcgtgtctctacacgaccggtgctcgatttagtgtgagtagtttgggtttggggacccaacaaccacacccctcctaagaagaagcccctagaccacagctccacaccatggactggacctgggaggactcctcttcttgggtggcagtagcaacaggtncccactcccgaggtgcagctggtacagtctgggtctgaagttgaggacgccgtggggcgtcgagtgagtcgttgcctgacaacgtcccttctggactacactccttctacttacttattctacgtctaagtttccggtaccacgtaccggccccgtggtaaccgaacggtcccgttacgacgtaacgacgtcgggtagtcggtaactacgaacctaaccggtaccaacgtacccgggaacccctacgttacgtacgcccgaccggttccctacgtaccgggttacgggttcccggttttacgttacccgtttcctaccgtaacgtagggtaaccctttacccggttcggttacgggtaccggggttacggttaacctttacggttccgtacgggtacctaagttaaacccgtaaaaccccgttaacccttaaccgtaaccgttaaccgtaaccggtccgtttaaaccgttcccgggtttttaaacccgtttttagttttaacgggtaaccggttacgttaccgggttactacggtttccttggtaaccgttggtaaacgttacgtacgtaccggtaggtccggtacccgggaaggttacccgtacgtccgtaacccgttcgtacccttacgacccgttccaacccggttcgaaccgtaccg

SEQ ID NO: 211042 - DNA, 633 bp, Homo sapiens
  misc_feature: GYAE6OF02F9E76.7.78.H01.1.454.CMB.1.raw
  modified_base (476)..(476): a, c, t, g, unknown or other
  misc_feature (476)..(476): n is a, c, g, or t
  modified_base (510)..(510): a, c, t, g, unknown or other
  misc_feature (510)..(510): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacattctcactacttattctgtcaattgggtaccgacaggcccctggacaaggccttgactacagtgggatggatcgaacaccgacacgtcgggaacccctactactcgacccgaggcccttcgaccgaggggtcggtttgtcctttcgtaccgagttcggacttacccgtctggtacggggacggtcttagtcctgacagtactaacccaaccttcaacctgaccacnctcgtcttttagttttgacaggtagtcgttcgtnttcgtactaggtagtaacttgaccttacggcggggtaccgaacggggtaacccttgggttacccgaacccggtttctacccgtaccgaccgtacccctcccggtaacccgacccgggtacccc

SEQ ID NO: 211043 - DNA, 617 bp, Homo sapiens
  misc_feature: GYAE6OF02GIOBG.7.78.H01.1.454.CMB.1.raw
  modified_base (471)..(471): a, c, t, g, unknown or other
  misc_feature (471)..(471): n is a, c, g, or t
tcagcgtgtctctacacgaccggtgctcgatttagtgtgagtagtttgggtttggggacccaacaaccacacccctcctaagaagaagccccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgcaagccttcgtggatacatcttcactacttattctgtctaagttgggtccgacgacggcccctggaccaaggccttgactacagtggatggatcaacaccgacacgtccgggaaccccaccgtatcgacccgagtccttcacgacggggtcgtttgtcttctcctagtcggtactaccgtcgtcggtacgggacgtcttacgtctgcagacctaacctaccttacaaccgtgacgacncgttacgtccgttttattttcggaacgtagtagtcgtcgtcgtgtcgtagtcggtaagttcgacgttcgtacgggccgtaacgggaccctgggtacctaccgtacttaccgttccctcccgacgtcccctacccgaccgaacccgg

SEQ ID NO: 211044 - DNA, 752 bp, Homo sapiens
  misc_feature: GYAE6OF02G2W6X.7.78.H01.1.454.CMB.1.raw
  modified_base (476)..(476): a, c, t, g, unknown or other
  misc_feature (476)..(476): n is a, c, g, or t
  modified_base (491)..(491): a, c, t, g, unknown or other
  misc_feature (491)..(491): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagcgttgcctgacaacgtccttcgtggatacatccttcaccttacttattctgtctaagttcgggtacccgacgacggcccccgtaggaaccgtaacgggccctttagaccttaaccgacgttaggggtactgggaataccgaaacctaccggaacctaaccgtaccgggaaccccctacgttacgtcggccccgaacggtcccttacgacgaggggttccggttttgtaccttccgtctagtcgtactaccgtntcgggtacgggcgtntttacgcgtgacgtacgaactaaccgtaaccctttacaacctgaaccgtacctaccgttgttaccgtttttattttccggaacgtagtaccgttccggttacgttcgttcggtcgttacgggttagtaacgtttacgacccggtttacggttacggggaccccggtaaccgggtacccgtttcggtaccccgttacccggttcccttaccccggttacgaccccgggttccctaaccccgggacccgtaaccggtcccccg

SEQ ID NO: 211045 - DNA, 737 bp, Homo sapiens
  misc_feature: GYAE6OF02FSSTX.7.78.H01.1.454.CMB.1.raw
  modified_base (184)..(184): a, c, t, g, unknown or other
  misc_feature (184)..(184): n is a, c, g, or t
  modified_base (241)..(241): a, c, t, g, unknown or other
  misc_feature (241)..(241): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacngtctgggtctgaattgaggagcctggggctcagtgagcgttgcctgcaagccttcgnggatacatcttcacttattattctgtctaagttgggtaccgacgacggccccctagggaaccaacggtcccttagaacctacgtagtggggatgggtactacaaccacccgaactacgtaccgggaaccccctacgtacgtccggacccaggtacccttacgacgacggggttccggttttgtcctttcgtccgtagtcgtacttccgtcgtcggtccgggacgttcgttacgttcgtacgcgtaacgtaacttaaacccgtaaccgttaccaaccgtacgaaccgtactacgttaccgtttaccgttttacgtttttacgacgtacggtacggttccggttacgtttccgttcgttaccgtaggttacggttaacgttacgtaaccgtttacggtccggggtaccggtaaccgggtaacccggttcggtacccgtacccgttccgttacccgtcgtacccggttaccccacccgtaacccggtaccggtccccgg

SEQ ID NO: 211046 - DNA, 703 bp, Homo sapiens
  misc_feature: GYAE6OF02FX23B.7.78.H01.1.454.CMB.1.raw
  modified_base (185)..(185): a, c, t, g, unknown or other
  misc_feature (185)..(185): n is a, c, g, or t
  modified_base (242)..(242): a, c, t, g, unknown or other
  misc_feature (242)..(242): n is a, c, g, or t
  modified_base (315)..(315): a, c, t, g, unknown or other
  misc_feature (315)..(315): n is a, c, g, or t
  modified_base (360)..(360): a, c, t, g, unknown or other
  misc_feature (360)..(360): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacngtctgggtctgaattgaggagcctggggcgtcagtgagcgttgcctgcaagccttcnggatacatcttcactactttattctgtctaagttcgggtccgacacggcccctggacaacggtcttgactacngtgggatggatcaacaccgacaccgtacgggaacccctacgtacncgacccacggtcccttacgacgtaggggttcggttttcgtccttcgtcctagtggtaccttaccgtcgttacggggtccggggtacgtcgtttagtcgtacggctacgtaaccgttaaacccgtaaccttacctaacccgttcggaaccgtacctacgttccgtttaaccgtttttatttttcggaacgttaccggacggtccgtttaccgttcgtggttacgtagttacggtacgttacggacgttacgggcgggtacccggttaacgggtacccttcggggtaccctttaccggccttcccggtactcccgtacccgtcccgaacccgtacgggtaccccg

SEQ ID NO: 211047 - DNA, 773 bp, Homo sapiens
  misc_feature: GYAE6OF02H59FD.7.78.H01.1.454.CMB.1.raw
  modified_base (254)..(254): a, c, t, g, unknown or other
  misc_feature (254)..(254): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatccttcttcttggtgcagtagcaacaggtcgcccactcccaggtgcagcgtggtacagtcgtgggtctgaattggaggagcgtggggctcgagtgagtcgttgcctgcagtccttcgtgatacntccttcacttattattctgtctaaggttcgggtaccgacgaccggtccccgtaggaacgtaacggtccttagaaccttacgagttagggatcggaactccgaaaccaccgacgaccgtaccggaaccccctaccgtacgtccgacccgtcggtacccttacacggtacggggtcgttttgtaccgtttccgtctagtcggtactaccgtcgttacggggtccggtacgtcttacgttcgtacggactaacgtaacgttaaaccctacctttaaccgacccgtaacgtaccggtaaccttaccgttacggtttttacccgtttttaaggttttaaccggcggttaacggttaggttcccgttcggttctagttaccggttaggttaacgttagttacggtaaccgttccgggtacggggtaaccggtacccgggtttaacccggtcggttacccgttaccccgtccgttacccgttaccggaacccgttccccgaacccggtacccggtaccggtccccg

SEQ ID NO: 211048 - DNA, 691 bp, Homo sapiens
  misc_feature: GYAE6OF02G44L7.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacagggtgcccactcccaggtgcagctggtacagtctgggtctgaattgaggacgccgtggggcgtcagtgagcgttgcctgcaagtccttcgtggatacattcttcacttacttattctgtactaagttgggtccgacgacgcccccgtaggaaccaagggtcccttaggaacctacgagttgggactagggactaccgaaccaccgtaactaccgtaccgggaaccccctactacgtccgacccgacggtcccttacggacggggtcgtttcgtcttcctactagtcgactaccgtcgtggtccgggtacgtcgttactcgtgactaacgacttaaaccctaccttacaaccgtcgaaccgtactaccgttcgttaccgtttttagtttacggaaccgtagtcgtaccggttcgtcgttacgtcgtaggttacgtattacgacgttacggtcggggaccctaacgggtacccgtcggtaccctccgttacctaccgtccgacgtccctaccgaacccggtaccggtcctaacccgg

SEQ ID NO: 211049 - DNA, 946 bp, Homo sapiens
  misc_feature: GYAE6OF02JXO8X.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacgaccatggactggacctggaggatccgtcttcttggtggcagtagcaacaggtgcccactcccaggtgcagcctggtacagtctggtctgaattgaggagccgtggggctcagtgagcgttgcctgacaagtccttcgtggatacactcgttcaccttacgttattcgtgtacgtaagttacgggtccgaacgaccggccccgtaggtaccgaacggtccgttacggaaccgtacgtacggtgggtaacgtcgggtaactaccaaacggaccgaaccgtaacggtaccgggaacccctaacgtacggtaccgacccggtacgacccgttaccaacggtcggggtaccggtttcggtccgttaccgtacgtacgttacgtaaccggttaccgttccggttacggttaccggggtacccgggttactttacggttaccggttcggtaccgtaaaccggttaaacccgttaaacccgttaaaccggtttaacccgttaaacccggttacggaacccggtttaaccgttaaacccgggttttccgggttaaaccgtttttttaacggtttttaccgggtaaacccggtaagggttacccggttaaccgggtttcccgttaccggggtttacgttaaccggggtttacgggttaacgggttaaaaccggggttttaccgttaaaaccgggttttccgggtaccggggggttaaaccccgggtaaccgggggttaaacccggtttcccgggttaaaccgggttacccgttcccggttaaccccgtttcggtaaccccggtttcccccggtaaacccgtacccgggtaacccgggtttaaccccg

SEQ ID NO: 211050 - DNA, 620 bp, Homo sapiens
  misc_feature: GYAE6OF02GMNR5.7.78.H01.1.454.CMB.1.raw
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (436)..(436): a, c, t, g, unknown or other
  misc_feature (436)..(436): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttcnggatacnttctcactacttattctgtcaattcgggtccacgacggtccccctggacaacggccttggaactacagtgggatggatcaacaccgacaccgtcgggaacccccactacgtcgccccgtaggcccttcgacgacgggtcgtttagtccttctcgagtgtacttcctcgtcggtcggacgtcttacnctgacagactaaccactaccaactgacgtacactcgtaccgtttatttcgacgagtagtcgtcgtacttgtacgtaggtcgtaagttcgacgttacgcggggaccgtaacggggaccccttgggtacccgtaccggttccgtacgtaccgtaccggacccttccgaacccgggaccgtaccccg

SEQ ID NO: 211051 - DNA, 724 bp, Homo sapiens
  misc_feature: GYAE6OF02JAWW6.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggctcagtgagtcgttgcctgcagccttctggactacatctcacttacttatctgtctaagttcgggtccagaccggccccgtggaaccgtaaacgggtcccttacggtacctacgtagttaggggtagtcggtaacttccaaaccggtacccgaaccgtaacggtacccggggaaaccccctaaccggtaacctacggtacccccgaggtccccttcgtaaccggacggggttccggttttacggtccgtttactaccgtagtacggtacttacccgttcgtacggtacggggtaccgttacgttactccgtcgagtaacgtacctaaccgtaaccttaccaaccgtacgtaacacgtacgttcgttaccttttagtttacgagtacgtcgacgttcggtactcgtacgtagtacgttagtcgtactcgggacggtaccggaacgggttaacccttacggtcccgtaccgtctacccggtctaccgacctacccgacccggtacgtcccg

SEQ ID NO: 211052 - DNA, 680 bp, Homo sapiens
  misc_feature: GYAE6OF02IVNB5.7.78.H01.1.454.CMB.1.raw
  modified_base (243)..(243): a, c, t, g, unknown or other
  misc_feature (243)..(243): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
  modified_base (504)..(504): a, c, t, g, unknown or other
  misc_feature (504)..(504): n is a, c, g, or t
  modified_base (562)..(562): a, c, t, g, unknown or other
  misc_feature (562)..(562): n is a, c, g, or t
  modified_base (568)..(568): a, c, t, g, unknown or other
  misc_feature (568)..(568): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtgcagtagcaacaggtgcccactcccaggtgcagctggtacagtctgggtctgaattgaggaagcctggggcgtcagtgagcgttgccctgcaacgccttntggatacagtcttctactacttattctgtcaagttcggtccgacgacggcccctagggaacgaaggtccgttagaactaccagtgggatggatcgaacgaccgacaccgtacgggaaccccacgttcncgacccgnggtacctacgacgtacgggtacggtttcgttaccttctaccgtagtacggacttccctagtcgggtacgggaccggtctttacgtcgtgacgtaagtaacctaaccgtaacctttaccaaaccgngtaacggacctacgttcggttactttttacggtttgaacggcggtaacgtccggtttntccgtntaccgtaagtcgtaagtttgacccgttaggcgggtaccacggggtacccttggtccgtaacccgttccaccggtactacccggtacctccccggaaccggtacggtaacccg

SEQ ID NO: 211053 - DNA, 591 bp, Homo sapiens
  misc_feature: GYAE6OF02GBSCZ.7.78.H01.1.454.CMB.1.raw
  modified_base (490)..(490): a, c, t, g, unknown or other
  misc_feature (490)..(490): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacattcttcacttacttattctgtcaattcgggtccgacacggcccctaggacaaggccttgactacagtgggatggatcaacaccgacacgtacgggaaccccacctatcgcccacggccttacacgacggtcggtttcgtcttctcatggtactacctcgtcgtcgggcgtacttatcgtcactagactaacctaaccttccaacctgaacgtacacgttcgtcgttttatttcgtacgngtacgtcgtcgttctcgtcgtagtgtattgacttcgcggtccgtaacgggaccctggtacctaccgttctcctcgacgtccctaccgaccggacggtcccg

SEQ ID NO: 211054 - DNA, 786 bp, Homo sapiens
  misc_feature: GYAE6OF02GWHFQ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtcgtgggtctgaattggaggaacgccgtggggctcgagtgagtcgttcgcctgaccaagtcccgttcgtaggtaactactacttccttacctaacttactttacttcttacgtacctaagttcgggtaccgaccgaccggtcccccgtaggaacgtacggtccttagaacctacaggtgggactggactaccgaaccaccgacgacgtaccggaacccctaccgtagtccgacccgtacgtacccctacgacggtacggggttccggttttcgtccttaccgtacgtacgttacggtaccttacccgttcgtacgggtccggaaccgtttctttaccgtcgttacgacgttaacgtaacccgttaacccttaaccttacccgtaaccgtacggaaccgtaaccgttaccgttacgttttaccgtttagttttacgaacggttaggtaccgttagttcccgttgttaccgtcgttaacgttacggtaacgtttcgtacccgttacgggtaccggggtacccggtaaccggttaaccgttccggaaccgtttacccgtcctaccgccgtacgtcccccgtaacggaccgtaccgggtacccc

SEQ ID NO: 211055 - DNA, 683 bp, Homo sapiens
  misc_feature: GYAE6OF02JCNE0.7.78.H01.1.454.CMB.1.raw
  modified_base (247)..(247): a, c, t, g, unknown or other
  misc_feature (247)..(247): n is a, c, g, or t
  modified_base (377)..(377): a, c, t, g, unknown or other
  misc_feature (377)..(377): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgtaattgaggaagccgtggggcgtcagtgagcgttgcctgacaacgtccttntggatacatcttcactacttattctagtactaagttcgggtccgacgacggtccccgtaggacgaacggtccttgactacagtgggatggactcaaccaccgacacgtacggacccctactactcgaccnggacctcgacgtcggtcgtttctacgttcacgtagtcggtaactccgttcgtcgggtaccgggacgtactttacgtctacggaccgtaataaacccgtaaacccgtaaccttaccgtaaccgtcgtaaaccaccgtaccgttcggtttacgtttttttaccgtttacgaacggtagtaccgtcgtacgtcttagtacgtagtagtaacgttagtaccggtacgcgggaccgtaacgggtccgttcggtacccacgttccgtaccgcggtaacccgtcccctaaccggaccggtaacccgggttccc

SEQ ID NO: 211056 - DNA, 791 bp, Homo sapiens
  misc_feature: GYAE6OF02FV8B9.7.78.H01.1.454.CMB.1.raw
  modified_base (135)..(135): a, c, t, g, unknown or other
  misc_feature (135)..(135): n is a, c, g, or t
  modified_base (174)..(174): a, c, t, g, unknown or other
  misc_feature (174)..(174): n is a, c, g, or t
  modified_base (242)..(242): a, c, t, g, unknown or other
  misc_feature (242)..(242): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctnttcttggtggcagtagcaacaggtgcccactcccaggtncagctggtacagtctgggtctgaattgaggacgccgtgggctcagtgagcgttgcctgcaagccttgngatacattcttcaacttacttattctgtactacgttcgggtcccacgtacggtccccctggaaccaacgggtcccttgtaactacgaacggtcggggaagttcggactaccgaaaccgacccggtaacgtaaccgttaccgggaaaccccctaccttaccgaccgaccccgtacggttcccttaccggaaacccggtcgggggtttaccggttttcggtcccttttaccggtaccgtaacgttcggttaacctacccgtttcgtacgggttaccggggtaccggttacctttcgtaccgttacggtactaacggtaaccttaaaccccgttaacccttaccgtaaccgttacgtacccgacttaaccgtttaccgtttaccgtttttaaggttttaccgacgtacggtcgtacgtttcgttcgtcgtacgttaggtagtaacgttcgacgttacgggcgggtacccgtaacgggtacccgttaggtcccgtaccggtttccgacccgtaccgttacggccccgtaaccgtacccgtacgggtacccccg

SEQ ID NO: 211057 - DNA, 815 bp, Homo sapiens
  misc_feature: GYAE6OF02G3HNV.7.78.H01.1.454.CMB.1.raw
tcagcgtgtctctacacgaccggtgctcgatttagtgtgagtagtttgggtttggggacccgaacgaaccacacccctcctaagaagaagccctagaccacagctccacaccatggactggacctggaggatccttctttcgttgggtggcgagtagcaacaggtcgcccacctccaggtcgcagtctggtacacggttcgtgggtctagtaagttaggaggaacgcccggttggggcgtacgaggtgaggcgtttcgccgttggacaacgtcccttcgtaggaataacctattcctttaccgacttaactttacttcgtacgtactaagttcggggtaccgaacgaccgggttccccctagggaacctaacgggtccctttagaaccttaacgacggttagggacgtacggacgttacccgaaaccgacccgaacgtaccgaccgggtaaaccccacgtacgtccgacccgacggtaccttcgacggtacggttcggtttcgttaccttcgtacctacgtcggtacctaccttcggtacggtaccggggtacctcgtttaacgtcgtacacggtactaaaacttaacccgttaacctacctaaacgtgaaccacgttacgtactttacgtttttattaccggtaagaacgtcggtaccgtttccgttaacgttcgtaccgtaaaggtttcggaaactttcgggtaacccgtagggtcgggaacccggttaacggggacccctttagggtcccgtaaccgtttcaccccggttcgaacccgttcccgttaacccgaaccggtaccgggtaccccc

SEQ ID NO: 211058 - DNA, 852 bp, Homo sapiens
  misc_feature: GYAE6OF02F51Z8.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtgcagtagcaacaggtgcccactcccaggtgcagctggtacagtctgggtctgaattgaggaagccgtggggcgtcagtgagtcgttgcctgctaagtccttctggactacacttccttacctaaccttacgtttacttctacgttacgtaagtttcggggtcccgtaacgtaccggtccccctagggaaccgtaacgggtcccctttcggaacctaccgtaggttagggtaacgtacgggtaactaaccgaaacccggtaacccgtaccggtaaccgtacccggggtaaaccccctaaccgttaacgtacccgtaccccgtaccggtacccgtttaaccgacggtaaccgggggtttccggttttacgttccgtttccgtacccgtaagttacggtaaccgttaccgtttccggtacgggttacccggggaacgtttccgtttaacgttcgtcgtaacggtaacgtaaaccttaaacccgtaaccttaccgaacctaccggtaacctaacttaccggtccgttaaccgtttttacgtttacggacgaacggttccgttacccgtcgtttacgttcgtacgttaggtacgtaagttccgtaccggttcgggtaccggaacccggttaacgggtacccgttcggtaccccgttaccgttcccgtacccggttaccgtcccgtcccttaacccggacccgtaccggtacccg

SEQ ID NO: 211059 - DNA, 805 bp, Homo sapiens
  misc_feature: GYAE6OF02GTEGU.7.78.H01.1.454.CMB.1.raw
  modified_base (720)..(720): a, c, t, g, unknown or other
  misc_feature (720)..(720): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggctcaggtgaggtcgttgcctgcaagcccttgaggatacattccttcacttacttattctaggtacctaagtttcggggtacccaacgtacgggccccttgggaaccgtaacgggtcccttggaaccttaacgacgtggggaattcggactaccgaaccgaaccgtactaaccggttaccgggaaaccccctaccttaagtccgtaccccgtaaggtcccctttacgaccggtaggggttccgtttcgttaccttcgtaccgtaagtcggtaaccttcctccggttagggtccggggtaaccggttctttacgtccgttacggacctaaggttaaccctaaacccttaacccggttacctaaccggttacggaacccggttaaccttacggtttaccgtttaccggttttttaaatttaccgggaacggtaccgggtaacggtcccggtttaccggttattcccggtaagtacgggttaacggtaacttagggtacccttaccgggngggtacccgtaacgggtacccttcggaccctttaccgggtccttccgtccaaccggtccctaaccggaacccggtacgtccccgg

SEQ ID NO: 211060 - DNA, 775 bp, Homo sapiens
  misc_feature: GYAE6OF02IEISQ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactccccaggtgcagctggtacagtctgggtctgaattgaggaagccgtggggcgtcagtgagcgttgcctgcaagtccttctggactacatcttcactacttattctgtactaattgggtccgacacggcccctggacaaggtccttgactacgagtgggatggactacaaccaccgacacgtaccggaaccccactactacgaccacggtcccttacacgagggtcgtttgtctctcagtcgactccgtcgtcggtcgggtacgtctttatccgtagacgtaacgtaacttaaacccgtaaaccttacctaaacccgtcgtaaaccgtaactaccgtttaccggttttacccgttttttaatttttaccgggaaccgtaaggtaccgggtccgtttaccgggttacgttacggttaccgttaaggttacgggttaaaaccgtttcgtaacccgttaccgggttaccggggggtacccggttaaacccgggggtaacccccgtttccggggtaacccctttaccccgggttacccttaccccggttaacgtacccccggtaaccccccgttaacccgtaaaccccccggggtacgggttaaccccccccgg

SEQ ID NO: 211061 - DNA, 620 bp, Homo sapiens
  misc_feature: GYAE6OF02IVU54.7.78.H01.1.454.CMB.1.raw
  modified_base (585)..(585): a, c, t, g, unknown or other
  misc_feature (585)..(585): n is a, c, g, or t
  modified_base (593)..(593): a, c, t, g, unknown or other
  misc_feature (593)..(593): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattggaaggaagccgtggggctcagtgagcgttgcctgcaagtccttcgtggatacatcttcacttacttattctgtctaattcgggtccacgacggcccctggacacggccttgactacagtgggatggatcaacgaccgacaccgtacgggaaccccacctagtccgacccgacggtcccttacggaccggggtccggtttcggttccttcctccgtagtcggtactaccgttcgtcgggtccgggacggtcttacgtccgtgacacgtactaaccgtaacccttacaaccgtacgaaccactacttcgttccttttagtttcgacgtacgtggtccgtgtctgtcagtcgtactgtacgtcggcggacggacggtacctcggtcnccgttccncgtcacgccctacacgtacgcctaccg

SEQ ID NO: 211062 - DNA, 648 bp, Homo sapiens
  misc_feature: GYAE6OF02GIHF9.7.78.H01.1.454.CMB.1.raw
  modified_base (242)..(242): a, c, t, g, unknown or other
  misc_feature (242)..(242): n is a, c, g, or t
  modified_base (325)..(325): a, c, t, g, unknown or other
  misc_feature (325)..(325): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagcccttnggatacattcttcacttacttattctgtcaattgggtccacaggcccctggacaaggccttgactacatggactggatcaacnccgacacgtacgggaaccccactatcgcccacggccttcacgtagggtcgtttgtcttctcctatggactacctcgtgtcgggacgtctttacgtctagctaacgtactaaaccctaacctttaccaacccgtcgaaccgtacctacgttagtacccgtttttaagtttttcggaacgtaggtacgttccgttcggttaccttggtacttacggtaggtaatttacgacgttacgtcggggaccgtaacggggtaacccttcgggtaaccctacccggttccttacccgtctaccgtcccctaccgaaccggaccgggtaccc

SEQ ID NO: 211063 - DNA, 872 bp, Homo sapiens
  misc_feature: GYAE6OF02FPWRR.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagtccttctggatacatcttcacttacttattctgtcaagttggtccgacaggcccctggacaaggtccttgactacagtgggatggactacaacgaccgacacgtacgggaacccctaccgtactcggaccctaggccctttacaaccggtacgggggttccgggtttttacggttacccttttcccgtacccgtaacgttacggggtaaccttaccccgttccgttacgggttacccggggggtaccgggttaccttttaacgttccgtacggtaccgtaaacggtaacctttaaaacccccgtaaaccctttacccgaaacccgttaacgggtaaacccgtaaccgtaaccgttccggtttacccgttttttaaacgttttttacggaaccggtaacggttacggttacccggttccggtttacttaccgggtttacgtaaacgggtttacgggtaaacgtttccggggtaaacctttacccgggtacggggggtacccccggttaacgggggtaaacccccgtttacgggggttaaccccttaaccccgggttaccctttaccccggttaccggtaacccggttacccccggttacccccggtaaacccgggaacccggggttaaccccccg

SEQ ID NO: 211064 - DNA, 594 bp, Homo sapiens
  misc_feature: GYAE6OF02H5KHG.7.78.H01.1.454.CMB.1.raw
  modified_base (524)..(524): a, c, t, g, unknown or other
  misc_feature (524)..(524): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttctggtggcagtagcaacaggtgcccactcccaggtgcagctggtacagtctgggtctgaattgaggaagcctggggctcagtgagcgttgcctgcagccttctggatacatcttcactacttatctgtcaagttgggtccgacacggcccctggacaaggccttgactacatgggatgggatcaacaccgacacgtcgggaaccccactatcgcccaggtcccttcacgagggtcgtttagtcgttcctcatggacttacctcgtcggtacgggacggtcttatcgtagcgagtactaacctaactcaactgacgactactagttaccgttttatttagtacgagtacgtcgttcgtcgtgttcaaggttgaagttcgacgttacgnggggacctacgggtaaccctgggtacctaccgtctacctcgtaccgtccctaccgtaccgagggtacccc

SEQ ID NO: 211065 - DNA, 687 bp, Homo sapiens
  misc_feature: GYAE6OF02JTL32.7.78.H01.1.454.CMB.1.raw
  modified_base (364)..(364): a, c, t, g, unknown or other
  misc_feature (364)..(364): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
tcagcgtgtctctacacgaccggtgctcgatttagtgtgagtagtttgggtttggggacccaacaaccacacccctcctaagaagaagcccctagaccacagctccacaccatggactggaccgtggaggactcctccttcttggtggcagtagcaacaggtgcccactcccaggtgcagctggtacagtcgtgggtctgaattgagacgcgtgggcgtcaggtgagtcgttgccctagcaacgccttgtggatacattctcacgtacttagttctgtactaagttggtccgacacggccctcggacgacggtcttgacctacagtgggatggatcgaaccaccgcactccgggaacccacacncnccgngacccttnaacgtacggtcggtttacgtcttactaccgtatcggtaactaccgttacgtcgggtaccgggtacggttccgtttaactccggttacgctaaacggtaactaaaccgttaaaccctaccgtaacgtaaccggtacctacgaccgttacggtacctttttacgtttacggttaacgttacggaacgttaccggtgttaccgttcgttacgttagtcgttaatacgtaccgtagtaccgggtacggacgtaaccggtcgtacgtaccctcgtccggtacctccgtaccgtacccgaccgtaccgtaacccg

SEQ ID NO: 211066 - DNA, 749 bp, Homo sapiens
  misc_feature: GYAE6OF02GRT3T.7.78.H01.1.454.CMB.1.raw
  modified_base (244)..(244): a, c, t, g, unknown or other
  misc_feature (244)..(244): n is a, c, g, or t
  modified_base (364)..(364): a, c, t, g, unknown or other
  misc_feature (364)..(364): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttcnggatacatcttcacttacttattctgtcagttcgggtccgacgacggcccctaggacaacggccttgactacagtgggatggataccaacacccgacaccgtacgggaaccccacgtacncgacccgacgtcccttcgaacgtaggggttacggtttgttacctttacgtccgtaagtcggtaacttacccgtcgttcgggtaccggggaccggtctttaagtccgttagaacgtacgtaaaccgttaaccctaaaccttcccaaaccgtacgaacccgtaaccttacgtacggttacccgtttttagttttacggaaccgtaggtacgtccggtttcgttccgttagtaccgtaaggttacggttaaattcggttaaccgttaccgggtcgggggtaaccctaaccgggggttaacccgttacgggttaaccccgtaccggtttcccgtacccgtaccggtaacccgtacccgtaaccccgacccggtaacccggggtaccccc

SEQ ID NO: 211067 - DNA, 740 bp, Homo sapiens
  misc_feature: GYAE6OF02FTBVZ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattggaggaagccgtggggcgtcagtgagcgttgcctgacaagccttcgtggatacatcttctacttacttattctgtactaagttcgggtaccgacgtacggtcccccgtaggaaccgaacgggtccttacggacctaaccgtagtggggagtgggaactaccgaaccgaacccggactacggtacccgggaaaccccctaccgtactcgaccccgacggtcccttcgaaccgtacggggtcggttttcgtccttaccgtccgtagtacggtacttacccgttcgtcgggtacggggtaccgtcttagtcgtcgacgtagacctaaacccgtaaccttaccaccgtacgaaccgaccgtacgttccggttaccgtttttattttaccgggacggtacgtaggttcccgttcgttacgtcgttacgtaggttacggtaagttcgaccgttacgggcgggacccgtaacgggtacccttggggtacccctcccgttcgttcccgtacgtccgtacccctacccgaccggtacccggtaccccgg

SEQ ID NO: 211068 - DNA, 807 bp, Homo sapiens
  misc_feature: GYAE6OF02I8OLZ.7.78.H01.1.454.CMB.1.raw
  modified_base (261)..(261): a, c, t, g, unknown or other
  misc_feature (261)..(261): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtcgtgggtctgtaattggaaggaagccgtgggcgtcagtgaggtcgttgcctagcaacgtccttcgtggtaatacncttcttctacctttactttattcttcgttcgttaacgtttcgggtacccgaacgaccggtccccgtaggacaacggtccgttacgacttaacgagtgggtagtggactacgaaaccgtaccgacgtaaccgtaccgggaaaccccacgtacgaccgacccgacggtcccttacgacggtaggggttccggtttactccgttctacgtgtacgtacctaccgttccggttcggtccgggttaccgttcttacgttccgtacgtacgaacgttaacctaaaccccgtacctttaaccgaaccctacggtaacccgtaaccgttaccgtttacgtttaaccgttttttacgtttaaccggtaacggttacgtaccgttaccggttaccgtttcggtaacgttacggtaacgttacgggttaaatttaccgggtaccgttaccggggttcgggacccgggttaaccgggttacccgttacggttacccgtaccgtttcccgtaccgttaccgacccgttacccgtacccggaccggtaaccccgtcccgg

SEQ ID NO: 211069 - DNA, 657 bp, Homo sapiens
  misc_feature: GYAE6OF02GXKMH.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggctcagtgagcgttgcctgcaagccttctggatacatcttcactacttattctgtactaagttcgggtccgacgacggcccctggacaacggtccttgactacagtgggatggactacaacacgacacgtcgggaaccccactacgcgccaggtcctacacgtacgggtcgtttgtcttctctagtcggtactaccgtcgtcggtccgggacgtcttagtcgtgactagtaactaaccgtaaccttaccaaccgtcgaacctaccgtacgttccgttacgtttttacttttcggacgtaaggtacgtccgttacgttctcggtacgtggttagtaacgttcgtaaccgttacggtcggggaccgtaaccgggtacccgttggtacccgttaccgttactccccgtacgtacccgtccctaaccggacccgtaaccggtccccg

SEQ ID NO: 211070 - DNA, 730 bp, Homo sapiens
  misc_feature: GYAE6OF02GMJVA.7.78.H01.1.454.CMB.1.raw
  modified_base (191)..(191): a, c, t, g, unknown or other
  misc_feature (191)..(191): n is a, c, g, or t
  modified_base (266)..(266): a, c, t, g, unknown or other
  misc_feature (266)..(266): n is a, c, g, or t
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
  modified_base (557)..(557): a, c, t, g, unknown or other
  misc_feature (557)..(557): n is a, c, g, or t
  modified_base (565)..(565): a, c, t, g, unknown or other
  misc_feature (565)..(565): n is a, c, g, or t
  modified_base (585)..(585): a, c, t, g, unknown or other
  misc_feature (585)..(585): n is a, c, g, or t
tcagcgtgtctctacacgaccggtgctcgatttagtgtgagtagtttggggtttgggggacccaacaaccaccacccctcctaagaagaacgccctagaccacagctccacaccagtggactggacctggaggatcctcttcttgggtggcagtgcaactggtgcccactcccgaggtgctagctggtacngtcgtgggtctagaattggaggacgccggtgggggcctcgtaggcgaggtcgttcgacctggacagtcccgttanggaactacacttcttcgacttgttactctagttctaaggttcggaccgtacaccggtccctaggacgacggtccgttacgactaggnggttagggtcgnggtaacaaccgtaacgacccgttaacgacggtacccgggaacccctacacggttaccacccgtacggtcccgtacgtacggacggggttcgtttttcgactttccgacgacttcggtaaccttccgtaccgtacgggtcggaacgtttctagtacgtcacgtaataacctaaccgacttaccgaaccgttanaacccgtntaacgttcgtttaacgtttntttaacggacgagttacggtcctttaacgtcgtctttaaggcgttaagaacgtttggaacccggtggttacggacccggtaaacgtaccctcgggtacccttcggtcccacggtacccttagacccctaccggccgaacgtcccg

SEQ ID NO: 211071 - DNA, 713 bp, Homo sapiens
  misc_feature: GYAE6OF02H9ADP.7.78.H01.1.454.CMB.1.raw
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (256)..(256): a, c, t, g, unknown or other
  misc_feature (256)..(256): n is a, c, g, or t
  modified_base (313)..(313): a, c, t, g, unknown or other
  misc_feature (313)..(313): n is a, c, g, or t
tcagcgtgtctctacacgaccggtgctcgatttagtgtgagtagtttgggtttggggacccaacaaccacaccctcctaagaagaagccctagaccacagctccacacatggactggacctggaggatcctcttcttggtggcagtagcaacaggtgcccactccaggtgcagctggtacagtctgggtctgaattgaggagccgtggggctcagtgagcgttgcctgcagtccttgngatacatntcattacttnttctgtcaagttggtccacgacggtccctggacaaggtccttagactacagtggganggatacacacgcacgtcggaaccccatatcgccagtccttacaacgtggggtacgtttcgtcgttactccgtaagtcggtactaccgttgtacggtcgggtacgtactttgtctacggactaacgtaaacgtaaaccctaacgttaccgtaaccgtaggaaccgtaactacgttaccgttaccggttttttaacgtttaccggtaacgacggttaaccgtccggtttacccgtacggtttacgtacgttacgggttaaacggtcggtttaaacggttaccggtaccgggtttacggggaaccccggtaaaggggttaaccccgttcggtaaacccggttccccgttaacgttcccgaccggttacctacccggtaccgttaaccccggtagggtaccccc

SEQ ID NO: 211072 - DNA, 876 bp, Homo sapiens
  misc_feature: GYAE6OF02H9MF0.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtgcagtagcaacaggtgcccactcccaggtgcagctaggtacagtctgggtctgtaagttggaggaacggccgtcggggcgtcgtagtgaggtcgttgccgtcgctaacgtccttctaggtactaaccgtacttccgtttacaccttaacctttacttcgttacgtacctaaggtttcgggtaccgaaccgtaccgggtcccccgtagggaaccgacggtcccttagtaccgtacgaggtgggtagtacggtataccgaaccgaccgtaaccgacggttaccgggaaccccaccgttactaccggacccgtacggttacccttacgacggtacgggggtcgttttacgttcgtttccgtaccgtacgtagtaccgtacctcggtttcgggtacgggtaaccggtcctttaacgtcgtacgtcgtaacgtaacttaaacccttaacccgtaacctacccgttacgtaaacccgacgttaaccggtttaccggtttacccggtttttttaagtttacccggtaagtacggttaccgtcgggtttacgtacccgtttcggtaacgttacggttaacgggttaaacgtttccggttaaaccggtacccgggttaccggggttaacccggtaacgggtttaaccccgggttgggtaacccccgtttcccgggaacttttcccccggacggtccccggtaaccccttaccccggtaacccggtacccgggttacccccgg

SEQ ID NO: 211073 - DNA, 723 bp, Homo sapiens
  misc_feature: GYAE6OF02HGZSA.7.78.H01.1.454.CMB.1.raw
  modified_base (230)..(230): a, c, t, g, unknown or other
  misc_feature (230)..(230): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttncctgcaagccttctggatacatcttcactacttattctgtactaagttgggtccgacacggccccctggaccgaaggtccttgactacgacgtgggatggatcaacaccgacactacggaaccccactatcgaccacggtcctcgacgagggtcgtttacgtcttctctagtggactaccgttcgtggtcgggtacggtactttactcgtacgctaacgtaactaacccgtaacccttccaacccgtacgtaccgaaccgttacccgttacggtttacccgtttttacgttttttacggaacgtacgggtaacgtcccggtttacgttcgttacggttaccgttagggtttacgaacgtttacgtaccgttaccggttacgggggtaccccgtaaccggggttaaccccgttcgggtaccccttaacccggttccccgtttccgtacccgaccgttaccccggtacccgtaacccgggtacccgggtaccccg

SEQ ID NO: 211074 - DNA, 857 bp, Homo sapiens
  misc_feature: GYAE6OF02HXJND.7.78.H01.1.454.CMB.1.raw
tcagcgtgtctctacacgaccggtgctcgatttagtgtgagtagtttgggtttggggacccaacaaccaccacccctcctaagaagaagcccctagaccacagctccacaccatggactggacctggaggatcctcttcttggtggcagtagcaacaggtgcccactccaggtgcagctggtacagtctggtctgaattgaggagccgtggggcgtcagtgagtcgttgccgtgactaagtcctttcgtaggatacgtattccttctacgttacttatttccgttagtactaagttcgggtcccgtacgaccggtccccgtaggtaacgtaacggtacccgttttacggaacccgttaacgtaggttacggggtacgtacggtactaaccgaaaccgtaaccggacctaaccggtaccggaaacccccgtaaccgttaacgtaccggaccccgaacggttccccgttaacgacggtaccggggtttccggtttttcggttcctttaccgtaccgtaacgttacggtacgtttacccgttcgggttcggtaccgggggttaacctaccggtttacttacggtcgtaaccgtaagtaaccttaaacccgtaacctttacgtaaccgtacgtaacggacctacgttaccggtttacgttttaacgttttacggtaaacggtacggttacgttccggttacgttaccggttaggttccggtaaagttacggttaacgttaccggtaacttacccggggtacggtaacccggttaaccgggtccccttaagggttccccttacccggtccgtacccgttcggtacccctacccgtttaaccggacccgtaaccggttccccg

SEQ ID NO: 211075 - DNA, 701 bp, Homo sapiens
  misc_feature: GYAE6OF02GWH95.7.78.H01.1.454.CMB.1.raw
  modified_base (247)..(247): a, c, t, g, unknown or other
  misc_feature (247)..(247): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcgagtgagtcggttgcctgcaagccttcgnggatacatcttcacttactttattctgtactagttcgggtccgacgtacggcccctggactaacggtccgttagactacgatcgggagtggatcgaaccgaccgaaccaccgtacccggaaccccctacctaacgtccgacccgtacggtcccttacggtaccgggggttcggtttcgtttccgttcccgtaccgagttacggtactaccgtccggttcgggtaccgggacggttaccttactccgtagcgaagtaacctaaaccttaacctacgtaacctacgacgtactacggttgttaccttttagttttacgagtacggtcgtacgttcgttgtcgttacggtagttagtagttacggtaccttagggtccgggtaccgtaccgggtaaccgttcggtaccgtcgttacctccgtccacggtccctaacccgaccgtacgtaccctacgg

SEQ ID NO: 211076 - DNA, 713 bp, Homo sapiens
  misc_feature: GYAE6OF02GO9MS.7.78.H01.1.454.CMB.1.raw
  modified_base (249)..(249): a, c, t, g, unknown or other
  misc_feature (249)..(249): n is a, c, g, or t
  modified_base (496)..(496): a, c, t, g, unknown or other
  misc_feature (496)..(496): n is a, c, g, or t
tcagcgtgtctctacacgaccggtgctcgatttagtgtgagtagtttgggtttggggacccaacaaccacacccctcctaagaagaagccctagaccacagctccacaccatggactggacctggaggatcctcttcttggtggcagtagcaacaggtgcccactcccaggtgcagctggtacagtctgggtctgaattggaggagccgtggggctcgagtgagtcgttgcctgactaacgtccttcgnggatactacttccttacacttactttattcgtgtactaagtttgggtaccaacgacgggccctaggaacgacggtcctttcgaacttacgagtggggacttaggactaccaacgaccgactaccggtaccgggaacccctaccgtagtccgacccgtacggttacccttaccgggacggggttcggtttacttccttccgttacagtacggtactaccctggtcggtccgggacgtacttacgttcncgactacgacctaaacctaccttaccaaacgtacgacctaacgtacgttacgttaccttttacgttttagtacggtaagtcgtcccgttacgttcgttacgtacgttagtacgtaagttcgtacgttacggcgggaccgtaaccgggtacccgtacggtaccgtacgtccgttaccctcggtcccgaccgttcccgacccgtaccggtcctacccgg

SEQ ID NO: 211077 - DNA, 797 bp, Homo sapiens
  misc_feature: GYAE6OF02IU6S8.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctggtctgaattgagagccgtgggctcagtgagtcgttgcctgacaagtccctttcgtaggtactacagttccttactaccttactttattcgtgttactaagtttcggggtaccgaacgtacggtccccctaggaacctaaacgggtccctttaggaaccttaacgtaagttacgggggtattacgggtactaaccgaaaccgtaaccggtaaccgtaaccggttaaccggggaaaccccctaccgtacgttccgaccccgtacggtcccttaccgacgtaacggggtcgttttacgtcctttaccgtccgtacgtcgtaactacccgttcgttacggtaccggggtaaccgtcgtttacgacgttacgacctaagtaaaccgtaaaccctaaccctttaccgaacccgttaggaacccgtaacctaccgttagttacccgtttttaattttacggacgtaacggtagtccgttcgtacgtcgtagtaaggttcgtaattcgtaacgtcggtacgggtacccggtaacgggttaacccctcggtaccgtacccgttccgtaccgtaccgtacccggtccccttaacccggacccggtaccggtaccccg

SEQ ID NO: 211078 - DNA, 730 bp, Homo sapiens
  misc_feature: GYAE6OF02JSQJC.7.78.H01.1.454.CMB.1.raw
  modified_base (186)..(186): a, c, t, g, unknown or other
  misc_feature (186)..(186): n is a, c, g, or t
  modified_base (243)..(243): a, c, t, g, unknown or other
  misc_feature (243)..(243): n is a, c, g, or t
tcagcgtgtctctacacgaccggtgctcgatttagtgtgagtagtttgggtttggggacccgaacaaccacacccctcctaagaagaagcccctagaccacagctccacaccatggactggacctggaggatcctcttcttggtggcagtagcaacaggtgcccactcccaggtgcagctggtacngtctgggtctgaattgaggaacctgggctcagtgagcgttgcctgcaacgtccttcnggactacatcgttcactacttatcgtgtcctaagttcgggtaccgtacgaacggtcccccgttaggaaccgtaacgggccttacggtaacctacagtagggtacgtcggactaccaaccgccgaacgtaccgtccgggtaaccccctacttacgtccgtacccgaacggtccctttacgaacggtcgggttcccggttttagttcccgtttaccgacccgttaaggttacggtacccttaaccggtccgttacgggttacccggggcgttactttaacgtccgttgaccgttaacgtaacgttaaccctacggttacctaaccgtcgtaaccgtacgtacttcgttacgtttagtttacgtacggtacgtacggtcgttacgtactcggtcgtacgttacgtacgtcgtactacggtacggtacgcggtaacccgtggtacctaccgtcttaccgacgccgtacctaccgccgtacgcccgtaacgg

SEQ ID NO: 211079 - DNA, 666 bp, Homo sapiens
  misc_feature: GYAE6OF02GRQ60.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaacgccttcgaggatacatcttcacttacttattctgtcaagttgggtaccacgacggcccctagggaccaacggtcccttagaccttacgaggtgggatgggactacaaccgaccgacaccgtacgggaacccccacgtactccgccctacggccttacgacggacgggttcgtttagtcttctactagtgactacctcgtcggtcgggtacgtcttactgtcacgagtaactaaccctaactaccaaccgtcgaccgactacgttacgtaccgtttttgttacgtacgaggtacctcggttcgtgttacgtcgtaggtacgtaacgttcgtacgtccgggtagggtacccgtaacgggtaacccgtcggtacccgttacccggttcttaccgtaccgtaccgttccctaacggacccgacggtaccccg

SEQ ID NO: 211080 - DNA, 727 bp, Homo sapiens
  misc_feature: GYAE6OF02I7VEX.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctgggaggatcctcttcttggtggcagtagcaaacgaggtgcccactcccaggtgcagctggtacagtctgggtctagaattggaggagccgtggggcgtcagtgagtcgttgctgacaagccttctggactacatcttcacttacttattctgtcaatttgggtccagaacggtcccctaggaaccaggtccttggaactacgagttacggggattcggaatacaacgtaccaacgtacgtaccgggtaaacccctacttaacgcgacccaggttccctacacggtacgggtcggttttagccttttaccaccgtaagtcggtaacttacctcggtggtaaccgggtacgggtactttactcgtcgtaacgtacgtaaacgtaacccttaaccttaccgaaccgttacgaacgtaaccgtaccgttaccggttaacgtttttactttagggttaccgaaacgtcgggttacgtaccgttcgttacgttacgttaagaacggttactacgtacggtagttcggggtaccgaacggggtaaaccgttcggtaaccgacggtacctcgttacccgcgtacccttaaccggacccgttaacgggtccc

SEQ ID NO: 211081 - DNA, 762 bp, Homo sapiens
  misc_feature: GYAE6OF02GPW44.7.78.H01.1.454.CMB.1.raw
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
  modified_base (334)..(334): a, c, t, g, unknown or other
  misc_feature (334)..(334): n is a, c, g, or t
tcagcgtgtctctacacgaccggtgctcgatttagtgtgagtagtttgggtttggggacccaacaaccgacacccctcctaagaagaagcccctagaccacagctccacaccatggactggaccctggaggatccctcttcttggtggcagtagcaacaggtgcccactcccaggtgcagctggtacagtctgggtctgaattgaggaanccgtgggctcagtgaggcgttgcctgcaagccttcnggatacatcttacacgttacttattctgtacaagttcggtaccgacgcggtcccctggaccagtccttacgactacagtggagtggancaaccgaccgacacgtccggaacccctactacgtacgcccgaggtcccttcaacggtacgggtcggttttcgtccttccgtaccgtaagtcggtaccttacccgtcggtacggttccggggaaccgtcgtttacctcgtacggtactaacgtaaaccgtttaaacccaaccctttaccgaaccgttcggaaaccgtaaccttacgtaccgtttaccgttttttagtttacggtaaccggtacggtaaccgttccggtaccggttttcgtaacgggttacctaacgggtttacggtaaagttttccgaaccgtttaccggtaccggggtacccgtaaaccggggttacccttacgggtaccccttaccgttaccgtttcccgtcccgtaaccgtccccgttaacccgaccgtaaccccgggttaccccg

SEQ ID NO: 211082 - DNA, 764 bp, Homo sapiens
  misc_feature: GYAE6OF02GB9CQ.7.78.H01.1.454.CMB.1.raw
  modified_base (246)..(246): a, c, t, g, unknown or other
  misc_feature (246)..(246): n is a, c, g, or t
  modified_base (272)..(272): a, c, t, g, unknown or other
  misc_feature (272)..(272): n is a, c, g, or t
  modified_base (723)..(723): a, c, t, g, unknown or other
  misc_feature (723)..(723): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctagaattgaggaagccgtggggctcaggtgagtcgttgcctgcaagtccttnggatacattctcacttacttattctntctaagttgggtcccgaacgacggtcccctagggaacctaacgggtccttggaacctacagtgggtagttggaacgtaccaaacgacccgactaacggtaccgggaaccccctacgtagtccgcccgaacggtcccttacgacggtacggggttcgttttcgttctttcctcgtacgtaggtaccttaccgttcgttacgggttccgggaacggttcctttaagtccgttggtaacgtaaccgtaaccttaaaacccgtacctttaaacctaaccggttaacggtaaccgacccgttaacttcggttttaccggtttttaacgtttttaccggacggttaacggcgtttccggtcgtttacgttcggttacgtaaggtttacggtaatttacggtacgttccggtacgggaccgtaaccggggtaccgtacgggttccgtaacccgttccncccgttacgtccgaccccggtactaacccgaccggtcccgg

SEQ ID NO: 211083 - DNA, 876 bp, Homo sapiens
  misc_feature: GYAE6OF02FXI8P.7.78.H01.1.454.CMB.1.raw
  modified_base (274)..(274): a, c, t, g, unknown or other
  misc_feature (274)..(274): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagtcgttgcctgcaagtccttctggatacattccttacacttacttattctntactaattgggtaccgactacggcccctggacaaggcttagactacgagttgggatcggatacaaacaccggacacgtacggaaccccgtacttactcggacctacggcccttacgacgacggggtcgttttcgtacttctcctaagtcggaacttaccctttcgtcgggttaccggggtaccggtacgtttaacgtccgttacgtaccgtaaagtaaccttaaaaccccgtaaccctttaacccgtaaacccgttaccgggtaaccgtaaaccgttaacggtttaccgtttaaccccggtttttttaagtttttttaaccggggtaaccgggtttaaacggtaaccgggtttccgggtttacccggtttaccggtttaccggtttacccgggttaagtttaaccggggttaaacgttttaaccgggttaaccgttaaccggggttaaccggggtacccgggttaaacccggggttaacccccggttacgggttaccccggttaaccccggtttaccccggttaccccggtttaccccaaaccccgggtttacccccgtaccccggtaaaaccccgggtaacccggggggttaacccccccg

SEQ ID NO: 211084 - DNA, 780 bp, Homo sapiens
  misc_feature: GYAE6OF02GBA3B.7.78.H01.1.454.CMB.1.raw
  modified_base (418)..(418): a, c, t, g, unknown or other
  misc_feature (418)..(418): n is a, c, g, or t
tcagcgtgtctctacacgaccggtgctcgatttagtgtgagtagtttgggtttggggacccaacaaccaccacccctcctaagaagaagcccctagaccacagctccacaccatggactggacctggaggatcctcttcttggtggcagtagcaactaggtgcccactcccaggtcgcagctggtacagtcgtgggtctagattgaggagccgtggggctcagtgagcgttgcctgacaagccttcgtggtactacattcttacgacttactttacttctagtaactaagttcggggtacaccgtacggccccgtggaacgaacggtccttgaactacgtagtagggcttaggactaccaacacgacgtacgtccggaaccctccgtaagtccgtaccgacggtccctacgtaccggnggttaccggtttaccgttctaccggtctacgtccgtaactcccgtacgacggtccgggtacgtacgttacgtctcggtaccgtaacgaccttaaccgtaaccgtacgtaaccgtaccgtaccgtacgaccgttacgttaccgttttacggttttcgtaacggttaccggtaaggttcccggtaccgtttaccgtacggttacgttaaaccgttacgggttaaagtccgggttaaccgtacgttaccggggtaacccgttaacccggggtaacccggttaccggtaccccggtacctttaccccggttaccgttacgtaaccccgtaccgtacccggtaaccccggtaacccggttaccccgg

SEQ ID NO: 211085 - DNA, 755 bp, Homo sapiens
  misc_feature: GYAE6OF02IOODT.7.78.H01.1.454.CMB.1.raw
  modified_base (417)..(417): a, c, t, g, unknown or other
  misc_feature (417)..(417): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactcccaggtgcagctggtacagtctgggtctgaattgaggaagccgtggggctcagtgaagtcgttagcctgacaacgtccttacgtggaactacattcttaccacttaactttattctagtacctaagttcgggtaccacgacggtccccgtaggacgtaaacggtccttaggaccttaacgagtaggggtaagtacggtactacgtaaaccaaccggaaccgtaacgtaccgggaaacccctaaccggttanaccggacccgtacgtacccttacgaacgtagggtcggttttacgttcgttacctaccgagttcggaacttaccctagtcgggtaccgggacggttactttaaagtccgttacgacgtaagtaacctaaaccgtaaacctttaaccgaacccgttaagaaacccgaacgttacgttacgtttaaccgtttttaagttttacggtaacggtaacgtacggttaccgtacgttacgttacgtacgtagtacgttaagttacacgtacggtcgggacgtaaccggtaaccgtggtacctaccgtctacctacgtccgtaccctaccgaccgtacggtacccg

SEQ ID NO: 211086 - DNA, 625 bp, Homo sapiens
  misc_feature: GYAE6OF02GW73B.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcacttacttattctgtcaattgggtccgacaggcccctggacaaggccttgactacatgggatggactacgaacaccgacacgtacgggaacccccactaagtcgcccgaggcccttacaacgagggtcggtttgtcttcgtaccatggactaccgtcgtcgtcgggacgtcttagtctgacagactaacctaaccttacaacctacgaacacctacttcgtacgttttattttgtacgtagtacgtcgtcgttctgtcgtaggtacgtaagttgacttaccgtcggggaccgtaacggggtaacccgttgggtacccgaccgttccgtacccgtcctacggtacccgtaccgacccgaacgggtaccccc

SEQ ID NO: 211087 - DNA, 809 bp, Homo sapiens
  misc_feature: GYAE6OF02HZI2I.7.78.H01.1.454.CMB.1.raw
  modified_base (177)..(177): a, c, t, g, unknown or other
  misc_feature (177)..(177): n is a, c, g, or t
  modified_base (238)..(238): a, c, t, g, unknown or other
  misc_feature (238)..(238): n is a, c, g, or t
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (747)..(747): a, c, t, g, unknown or other
  misc_feature (747)..(747): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtgcaacaggtcgcccactcccgaggtgcngctggtacagtctggtctgattgagagcctgggcgtcagtgagtcgtgcctgcagtccttntggactacntctcactattnttctgtnagttcggtcgancgccctaggacacggcttagacctacngtaggtncggatacaccgaccgacaccgtacggaaccccacgtatccgaccgtacggtcctacaccggacgggttccggttttcgtcgtccgtcgaagttcggtacttacccgttcgttcgggtcgggtacggttccttacgtaccgtcgtaacgtacgttaaaccgtaaacccgttaacttccctaacccgtaggttaacctacccggttacggtttacgttacccgtttttttaacggttttacgtaaccgggttaggttaaccgtccggttttacccgttttacggttacgggttaaccgtttagggtaacccgggttttaactaggtttaaacccccgggtgggttaccccgggggggtacccgtttaaaacgggggcccccgtttaaacgggggtttaaccccttacccccggggttttccgtacccccgggtttaanaacccccgggtttccccccgtaaaccccgggtttaaaccccggacccggtttaacccccggg

SEQ ID NO: 211088 - DNA, 869 bp, Homo sapiens
  misc_feature: GYAE6OF02I0VUY.7.78.H01.1.454.CMB.1.raw
  modified_base (218)..(218): a, c, t, g, unknown or other
  misc_feature (218)..(218): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgattggaggagccgtggggctgngtgagcgttgctgacaagtccttcgtagaactacatcttacacttactttacttcgtagtacctaagtttcgggtaccgaccgtacggtccccccgttaggaacgtaaccggtaccctttacgaaccttaaccgaggttaggggagtaggaacctacgaaaccgtaacccgtaacgtaaccgtaccccggggaaaccccctacgttacgtacccggaccgtaaccgggtcccttaccggaaccggtacggggtttccgggttttactcccgttttccgtaacccgtagttaccggtaacgtttacccgtacgtttaccggtaccgggggaacgtttacgtttaacgttccgtaaacgtcgaaacggttaaaccttaaaccccgtaaccgttaccgaacccgttaacggttaacccgacccgttaaccgtttccggttttaaaccggttttttacgtttttaaccgggacggttaacggtaccggttaccgtttaccggttccgtacgttaaccggttaaggttaacggaagttttaccgaacgttccgtaccggggtacccggtaaccgggtaacccgtttccgggacccgttacccgtttcccgtcgtacccgtaccgtccccgtaaccggaccggtaaccggtccccgg

SEQ ID NO: 211089 - DNA, 829 bp, Homo sapiens
  misc_feature: GYAE6OF02GMR20.7.78.H01.1.454.CMB.1.raw
  modified_base (235)..(235): a, c, t, g, unknown or other
  misc_feature (235)..(235): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgnaagcttctggatacagttcctcacttacttacttctgtacctaagtttcggggtacccgtaacgacgggtcccccttagggaaccgtaacggtccctttacggaacccgttaacctaggttacggggtaacgttacgggaacttaacccgaaaaccgtacccggaaaccgtaaccggttacccggggtaaaacccccctaccgttacgtaccggccccgaaaccgggttccccttaacgaaccggtaacggggttccggtttttacggttcccttaccgttcccgtaagttccggtaactttacccggtccgtttcgggtaccggggtacccggttactttaacgtccgtaacgccgtaaggtaaacctaaacccgtaacccgttacctaaaccgtcgaacctaccgtaccgtcgtttaccttttagtttttacgaccgtaacgtcgttaccgtttccgttacctaggttccgtaaggttcggtaaagttccgtaaccgttacggcggggtacgaccgggggtaaacccttcggtaaccgtacccgttccgtacctcgtaccgtccttaaccccggaccggtaccggtaccccg

SEQ ID NO: 211090 - DNA, 776 bp, Homo sapiens
  misc_feature: GYAE6OF02HYAX7.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctctttcttgggtggcagtagcaacaggtcgcccacctcccaggtgcagctggtacagtcgtgggtctgaattgaggaagtccgtggggctcaggtgagtcggttgcctgacgaatccttgaggactaactatcttcacttacttattcgtgtactaatcggggttaccgactacggccccgtaggaacctaacggtccttagaacgtacacgttggaatggaatacaaccaccgactacgtacggtaaccccactacgacgccgacggtccttacgaacggtacgggtcgttttcgtacgttccttaccgagtacggtcttacctcggtccggttaccggggtacgtacgtttacgttcggtacgaccgtaagttaaactaaacccgtaaccgttacctaaacctacggaaccgttaactaccgttacgttttaaccggttttagttttaacggaacgtaaacggtaccggttacgttccgttacgtaccggttaagttacgggttacgttaaacgtacgtaaccggtacgggacggggttaccggtaaccggggtaacccttcggggtaaccctacccgtttctaccccgggtaagtccccgttaaccggttaccccggaccgggttaaaccccggtcccgg

SEQ ID NO: 211091 - DNA, 993 bp, Homo sapiens
  misc_feature: GYAE6OF02JS52U.7.78.H01.1.454.CMB.1.raw
  modified_base (255)..(255): a, c, t, g, unknown or other
  misc_feature (255)..(255): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcgaacaggtgcccactcccgaggtgcagctggtacagtctgggtctgaatgagagccgtgggctgagtgagtcgttgacctgactaggtccttgtaggactacncttctcacgttaacttctttccgtgtagtaacgttcggggttaccgaacgtccggtacccctagggaaccgtaacgggtcctttacgaaccgtaccgtaggttggggaacgttcgggtaacttaccgaaaccgacccggtaacctaaccgggtaaccggggtaaccccctaccgttaaacggtccgggaacccctaaccgggtccttaccgacgggtaaccggggtttccggttttcggttacccgtttaccgtaccgtaacgtttaccgggaaccgtttacccgtttaacgtttccggggttaaccgggggtaccggttaaccgtttttaaccgccggtttacggtaacccgtaaacggttaaacccgtaaacccgtttaaacccgggttacccttaaaccgggtaaccggggtaacccgttacccggttaaacccgtttccgggtttaacccgtttttaaacggttttaccgggttaaacccggtagggttaccgtaccccgggggttttcttaaacccgggttaggtttacccgggttaaagggttaaaggtttccgtttaaccggggaacggggttttacccgggtacccggggtaaacgggggttaaccccggttaaaccccggttttcggtaaaccccgggtttccccgggttttccccaacccgggtttaccgggtaacccttaccccccgttaacccggggtaaaccggttaccccggttaaccccgggg

SEQ ID NO: 211092 - DNA, 792 bp, Homo sapiens
  misc_feature: GYAE6OF02JUIZW.7.78.H01.1.454.CMB.1.raw
  modified_base (88)..(88): a, c, t, g, unknown or other
  misc_feature (88)..(88): n is a, c, g, or t
tcagcgtgtctctacacgaccggtgctcgatttagtgtgagtagtttgggtttggggacccaacaaccacacccctcctaagaagaancccctagaccacagctaccacaccaatggactggactggaggactcctcttcttggtggcgagtagcaacaggtcgcccacctcccgaggtgacgagctaggtacagtcgtaggtctgaagttggaaggaacgcgtacggggctcgaagtggagaccggttcgcctacggacaacgtccgttcgtaagacttaacacgttacgttctaccttaagttattcgtgtacgtaagttcggtacgacgacgtcccgtaggacaaggtcttacgacacgtagtagggtactacggtaactaccgaaccgaacccgaacgtacgtaccgggtaaaccccctacgaacgttccgaacccggtcgtacccgttaccgaacgggtacggttaccggttgttaccctacgtaccagttacgtaactccctacggtacggttcggtaccgtaacggttctctaacgacgtacgtaaactaaccaccgttaacgtaacctcggaacctaccgtttaacgtaccgtttaagtttaaccggtttaggttaacacgggttaccgtacggtttactacgttacggttaactagggttaacgttaagtaccggtaacgtaccggtccggggtaaacccgtacgggtaccgttacggtacgtaacccgtttccgtacccgttacgaaccccgtttacccaaccgaccggtaaccgttcccgg

SEQ ID NO: 211093 - DNA, 758 bp, Homo sapiens
  misc_feature: GYAE6OF02HYSMP.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagtctggtacagtctgggtctgaatgaggagctggggctcagtgagcgttgcctgactaagccttcgtaggtactacatctacctacctactttaagttcctagttactaacgttcggttaccgactaccggaccccgtaggaaccaacgggtcctttaacggacttaaccgtaaggttggggaactgggtaactaaccgaaacccgtaccggtactaaccggtaccggaaaccccctacgtaacgtacgcccgtaacggtcccttaacgaccggtacgggtccgtttaggtaccttacgtaccgaaggtctaacgttaccgtcgttcgggtaccgggaccggttccttaacgtcgtagccttaaggaaaccctaaaccgtaacctttccgaaaccgtacgaacgtaactacgttacgttaccgtttagttttaccgggaagtaacggtacgtaccgtttcctaacgttacgtacgttaggtaacgtaattacccgaggttaccgtcggggaaccgtaacggtcccgtaacgtccacccgttacgtaccgtacgaccgtaaccaccgtaccggacgtaacccg

SEQ ID NO: 211094 - DNA, 671 bp, Homo sapiens
  misc_feature: GYAE6OF02G7HU4.7.78.H01.1.454.CMB.1.raw
  modified_base (268)..(268): a, c, t, g, unknown or other
  misc_feature (268)..(268): n is a, c, g, or t
  modified_base (481)..(481): a, c, t, g, unknown or other
  misc_feature (481)..(481): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcagtgagtcgttgcctgcaagtccttctggactacatcttcacgttacttnttctgtactaagttcggtccgacacggtcccgtggacgaacggtccttaggactagacgtgggagtggataccgaactaccgacgtaccgtaccggaaccccacgtaccgtaccgcccgtacggtccctacgacggtacggggtcggttttacgtccttacgtacctagtcggtacttaccgtcgtcgggttcgggacggtactttacgtctnacgtactaaccgtaaacctccgttaaccacgttacgaccgtactacgttctttactttttagttaccgtacgacgtcgtacgttacgtcttaggccttagggtacgtattaccgagtacgcggtaccggacggtaccctgggtcctaaccggtcctaccgtagacccggtcctacgacccgtacgtaccg

SEQ ID NO: 211095 - DNA, 777 bp, Homo sapiens
  misc_feature: GYAE6OF02ILK60.7.78.H01.1.454.CMB.1.raw
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
tcagcgtgtctctacacgaccggtgctcgatttagtgtgagtagtttgggtttggggacccaacaaccacacccctctaagaagaagcccctagaccacagctccacaccatggactggacctggaggatcctcttcttggtggcagtagcaacaggtgcccacctcccaggtgcagctggtacagtctgggtctgaattggaggaagccgtggggctcagtgagcgttgctgcagcttnaggatacatnttcatacttattgtgtacaagttcgggtaccgacgtacggtcccgtacggaacgtaacggcctttagacctactacggtacggggtatacggtaactacaaccgaacgactacgtaacgggaaccccctacgtaagccgtaccgcgtaccgtacgtacgaacggggtcgtttcgttaaccttcacgtaacgttacggacgttaccgtcgtacggtaccggggtaacgtcgtttaacgtcgtcggaacgtaacgtaaccgtaaacccgtaaccttaccgaaacgttaccgaacggtaacctacgttaccgtttacgtttttaatttacgggtaacggagttacccggtaggtttccctacggtttccttaacgggtcggttaaacgttaaacgttaccgttaaccgttaccgggcggggtaacccggtaacggggtaaccccgtttacgggtaccccggttaccggttaacccgttccggttaacccgaccgtaaccccggtaacgtaccccggtaacgggtcccccg

SEQ ID NO: 211096 - DNA, 782 bp, Homo sapiens
  misc_feature: GYAE6OF02JZXZA.7.78.H01.1.454.CMB.1.raw
  modified_base (638)..(638): a, c, t, g, unknown or other
  misc_feature (638)..(638): n is a, c, g, or t
  modified_base (668)..(668): a, c, t, g, unknown or other
  misc_feature (668)..(668): n is a, c, g, or t
  modified_base (733)..(733): a, c, t, g, unknown or other
  misc_feature (733)..(733): n is a, c, g, or t
tcagcgtgtctctacacgaccggtgctcgatttagtgtgagtagtttgggtttgggggacccgaacaaccacacccctcctaagaagaacgccctagaccacagctccacaccatggactggacctggaggatcctcttcttggtggcagtagcaacaggtgcccactcccgaggtcgcagcttcggtacagtcctgggtctagaacttgaggaagccgtgggcctcagtcgtagcgttgcctgacacgtccttcgtaggattaccaattccttacgaccgttactttacgttactaggtacctaaaacgttcggggtaacccgacccgaaccgggtcccccgtacggtaaccgtaaggggttaccccttttcgaacccttaaggtccggttagggtaacgtaccgggtacgtaaccgttaaaccccggaccgtacccgaacgttaacccggggaaccccctaaaccgtttcgggaccgttaacccgacggggtttccctaccggggtaaccggggtacggtttttcggtacctacccttactaccgggtacgttaccccggttaacttcctacggggtaaccgggtccggttaactcgtacgtcgtacgacgtactaacctacgtactacgtcgtanacgtcgtagttacgtttgttacagtaccgngtcgtacgtcttacggtaccgtgtacgtacgtgccgttaggccgacgtacggtaccgtacgtacnccggtacttcgcgttacgacccgttacgaccggtaccgtacccgtaccg

SEQ ID NO: 211097 - DNA, 740 bp, Homo sapiens
  misc_feature: GYAE6OF02I5HEG.7.78.H01.1.454.CMB.1.raw
  modified_base (249)..(249): a, c, t, g, unknown or other
  misc_feature (249)..(249): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagccttctggatacntcttcactacttattctgtcaattggtccgacacggcccctggacaaggccttgactacgagtggatggactcaacaccgacacgtacgggaccctacctatcgacccgaggtcccttacacgtacggggtcggttttacgtccttctaccgtagtggtaacttacccgtcgtacggtccggggacgtactttacgtcgtcgtacgtacgtaactaaccctaaccgtttaccgaaaccgttcggaaccgtaaccgttaccgtttaccggtttaccgttttttacgtttttaccggaacgttacggtaacggttccgttacgttccgttacgtaccgttaaggttacgtaaacgttgtaaccgttacggttacggggtaacccgtaacgggggttaaccccgttcgggtaacccgttaccccgttaccgttaccccggttaccgtaacccggtaccccgtaaccccggtaaccggtaacccgggtaccccgg

SEQ ID NO: 211098 - DNA, 805 bp, Homo sapiens
  misc_feature: GYAE6OF02I0PO9.7.78.H01.1.454.CMB.1.raw
  modified_base (781)..(781): a, c, t, g, unknown or other
  misc_feature (781)..(781): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcgagtgagcgttgcctgcaacggtccttcgtggtactaactatcttctaacttacctttattcttgtacgtaagttcggggtacccgaccgtacggtcccccgtaggaaccgtaaggtcccttagtaaccgtaccgtaaggtcgggtaagtcggtactaaccgtaaaccgaaccggaaccgtaccggtaccgggaaacccctaacccgtactccggaccctacggtacccttaaccgtaccggtacgggttccggtttacgttacctttcgtaccgttacgtacggtacgttaacccgttcgtcggggtaccgggacgtccgttttacgtccgtcgtacgtaacgtaaccttaaaccgtacccttacctaacccgtagacctacgtacttaccggtttaccttttagtttaccgttagtacggtggttacgttaccgttcgttacggtccgtaaggttacgttaagttccggtaccgttaccggggtaccgggtaccggtaacccggggtacccgtaccggggtacccttacccgttcccgttacgtaccgtcccgtaaccccncccgtacccggtaccggtaccccg

SEQ ID NO: 211099 - DNA, 688 bp, Homo sapiens
  misc_feature: GYAE6OF02FK013.7.78.H01.1.454.CMB.1.raw
  modified_base (242)..(242): a, c, t, g, unknown or other
  misc_feature (242)..(242): n is a, c, g, or t
  modified_base (270)..(270): a, c, t, g, unknown or other
  misc_feature (270)..(270): n is a, c, g, or t
  modified_base (310)..(310): a, c, t, g, unknown or other
  misc_feature (310)..(310): n is a, c, g, or t
  modified_base (410)..(410): a, c, t, g, unknown or other
  misc_feature (410)..(410): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttctggtgcagtagcaacaggtgcccatcccaggtgcagctggtacagtcctgggtctgaattggaggaagcctggggctcgagtgagcgtgcctgcaagccttcgnggatacgatccttcacttattacttacngtcaagttggccacgcggccctggacaggccttagactanagtgggatggtatacaacaccgactacgcgggaaccccacgtatgacccagtccttacacgacggttcgtttagccttcgacctagtcggacttacccgngttcggtacgggacggtcttaacgtccgtacgtactaggaaccttaaaccgaacccgtttacgaacccgttagtaacccgtaccgtaacgtttccgttacccgttttaacgtttttacggtaaccggtaaggtacggttaccgtcgttcgtacgttcgtaaggtacggtaacgtttgacgttacggtcggggtaccgtaacggggtacccgtcggtaaccgtacccgttaccgttacccgtatacccggtacccgtacccgtaccggtaaggtacccg

SEQ ID NO: 211100 - DNA, 660 bp, Homo sapiens
  misc_feature: GYAE6OF02IU1B7.7.78.H01.1.454.CMB.1.raw
tcagcgtgtctctacacgaccggtgctcgatttagtgtgagtagtttgggtttgggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggctcagtgagcgttgcctgcaagccttctggatacatctcactacttattctgtcaattcgggtccacgacggcccctggaaccaacggccttaggactacagtgggactgggatacgaaaccaccggaacaccgtagggaacccctacgtaactcgccctaaggcccttacgacggggtcgtttgtcttctccgatggactacctcgtacgtacgggacggtacttagtctacgcagtaactaaacctaaccttcaaccctgaccgacacgttcgtaccgttttatttacgtacgacggagtccgttacgtcgttagtcctaaggtcggtaaactttcgaacttcgggtacggggaccgtaacggggtacccgttggtacccgtacccgttaccgtacccgtcgacggtcccctacccgaacccggtaccggtcccttaacccgg

SEQ ID NO: 211101 - DNA, 700 bp, Homo sapiens
  misc_feature: GYAE6OF02FP6HT.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattggaggaagcctggggctcagtgagcgttgcctgcgaagtcccttctaggactacgatcttacactacttattcctgtactaagttcgggtacccgacgaccggtccccgtagggaacacgggtcccttgacctacgagtgggatggactcaacgaccgtacacgtacggaacccctacgtacgtcgacccgtaggcccttacgaacggtacggggttcggttttcgttacgtttccgaccgtagttacggtaactacccgttcgtcgggtaccggggtacggtctttagtccggtacgacgtacgtaacctaaaccccgtaaccgttaccaaacccgttacgaaccgtacttaccgttccgtttaccgtttttagttttacgacgtagtccggtcgttcgtgttcgtacgtaagtcgtaacgttgtaccgtagggtccggtacgacggtacccgtggtcctaccgtcgtctacgacgtcccacggtaccaccgggtaccc

SEQ ID NO: 211102 - DNA, 728 bp, Homo sapiens
  misc_feature: GYAE6OF02IXBYT.7.78.H01.1.454.CMB.1.raw
  modified_base (220)..(220): a, c, t, g, unknown or other
  misc_feature (220)..(220): n is a, c, g, or t
  modified_base (366)..(366): a, c, t, g, unknown or other
  misc_feature (366)..(366): n is a, c, g, or t
  modified_base (428)..(428): a, c, t, g, unknown or other
  misc_feature (428)..(428): n is a, c, g, or t
  modified_base (655)..(655): a, c, t, g, unknown or other
  misc_feature (655)..(655): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtcgcccactcccaggtgcagctggtacagtcgtgggtctgaattgaggaagccgtggggctnagtgagtcgttgcctgacagtccttcgtggatacatcttacacgttacttattcgtagtacaagtttcggggaccaacgtacgggcccctagggaactaacggtccttgaacctacgagtagggtatggaactacaaccaccgaanccgtacggaacccccactagccgaccgacggtccttacaggacgggttcgtttcgtcgttcnccgtaagttcggaacttactccgtggtcggggactcgtatcgacgtcaagtacctaacctaaccgtttacgaacccgtagacggtaacctcggttccgttaaacgttttttacttacgggtaaacgacggttaacgttcccgttacggtctttaacggtaccgtaagtttaggtaactttaacgggaaccttacgggtccgggtaaccgggtaacgggttaacccgngggttaacccacccgttttaccgtccgttacgaccccggttacccgtacccggaagtaccccgggttaacccg

SEQ ID NO: 211103 - DNA, 731 bp, Homo sapiens
  misc_feature: GYAE6OF02FPHXI.7.78.H01.1.454.CMB.1.raw
  modified_base (250)..(250): a, c, t, g, unknown or other
  misc_feature (250)..(250): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagccgtggggcgtcagtgagcgttgcctgcaagccttctggatacntcttcacgttacttattctgtctaagttgggtccgacgcggcccctggacacggtccttgaactacgagtggtatggatacaacgaccgacaccgtaccgggaaccccactactcgacccgtacggtcccttacgacggtacggggttcgtttcgttccgtttacctaccgtagtacggtaaccgtttaccgttccgttacggggttaccggggtaccggttacgttactcgtcggacgtaacggtaaccttaaaccccgtaccttaacccgaccgttacgaacctaccgtacgttactttacgtttttacgtttacggtacgtagtacggtccgttacgtcgttacgtacgtagttacggtaatttcgtaccgttacgggtaccggaaccgggtaaccgggtaccgttccggtaacccgttacccgttacccgttccgtaccggtacccgtcccgtaacccgaccggacccggttacccg

SEQ ID NO: 211104 - DNA, 834 bp, Homo sapiens
  misc_feature: GYAE6OF02JG293.7.78.H01.1.454.CMB.1.raw
  modified_base (225)..(225): a, c, t, g, unknown or other
  misc_feature (225)..(225): n is a, c, g, or t
  modified_base (365)..(365): a, c, t, g, unknown or other
  misc_feature (365)..(365): n is a, c, g, or t
  modified_base (389)..(389): a, c, t, g, unknown or other
  misc_feature (389)..(389): n is a, c, g, or t
tcagcgtgtctctacacgaccggtgctcgatttagtgtgagtagtttgggttggggacccaacaaccacacccctcctaagaagaagcccctagaccacagctccacaccatggactggacctggagatcctcttcttggtggcagtagcaacgaggtcgcccacctcccgaggtcgcagctggtacagtctgggtctagaattgaggacgtccgtggggcgtcngtacgagtcgttcgacctggactaacgtccttcgtacggaactacctattccttaccaacgtttactttacttcgtacgtacgtaacgtttcggggaccgaacgtaccggtcccctaggtaaccgaacggtcccgtttanaccgtaacgtacggtagggtaacnggtaacaccaaccgaccgaccgtaccgtaaccgggaaccccttacgtacgtccgaacccgtacggtccctaacggacggttacggtccgttttacgtccttacgtccgtagtaccgtacttaccgtcggtacgggtccggtacgtttctacgttccgtacgaacgtaacgttaaaccgtaacccttaaccgtactaaccggtacgtaacgtaacccttggtttccgtttaacgtttttaacgtcggtaaacgggtacctacgggtttacccgttcgtaccgtttcggtaacgttaagggtaccgttaaaacgtttccgtacggttaccgggtccgggtaaaccggttacccggtacccggtaacggttacccaccccggtttaccgtaaccgttacccgggtcctaaacccccgggtccccggaacggtaaccccggttccccgg

SEQ ID NO: 211105 - DNA, 757 bp, Homo sapiens
  misc_feature: GYAE6OF02GTKLV.7.78.H01.1.454.CMB.1.raw
  modified_base (640)..(640): a, c, t, g, unknown or other
  misc_feature (640)..(640): n is a, c, g, or t
tcagcgtgtctctacacgaccggtgctcgatttagtgtgagtagtttgggtttgggacccaacaaccacacccctcctaagaagaagcccctagaccacagctccacaccatggctggacctggaggatcctcttcgttggtgcagtagcaacaggtgcccactccgaggtgcagctggtacagtctggtctagtaagtgaaggagccgtggggctacgtagtgacggtcgtttacgccgtgacgaacgttcctcgtggactacgtatccttcaactactttaattcgtacgtactaacgttcgggtaccacgtaaccggtcccctagggacgtaacgtccgttagaactacgtacggtagggtactaggacctacgtaaacccgtaccgagtaccggtaacccgggtaaccccaacccttagtccggacccgtaaccggtccctaacggtacgaccgggggttaccgttttcgtacctttacgtactacggtacggacctttaaccgtcgtacgggtcggggtaacctacgttttacgacccgttggtaccgtaaacgtaaaccgtaaaccccgtttaccgacccgttaaccgtcggaacctaaccgttcgttccgtttaccgtttttaacgttacggngtaacggtctaccggtttctacggttgtaacgtgtaacgtattacgcgtacgggtcgaccggtaacgtacccggtagtccgtacgttctccgcgccttaaccgccgacgtacgcccg

SEQ ID NO: 211106 - DNA, 798 bp, Homo sapiens
  misc_feature: GYAE6OF02G8BSF.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtcgcccacctcccaggtgcagctagtacagtctgggtctgaattgaagagcgtgggactcaggtcagtcgttcgcctggacaacgtcttacgtaggactatacttcttaccacgttacctttattccgtagttacctaagttcgggttaaccgacgtaccggtccccggtaggtaaccggaacgttccgttacgactacgtaggtacggggatacggtactaccaaccgtaaccgaactaacccggtcccgggtaaacccctccgtacgtccgacccgtaccggtcccttaaccgacgggttaaggtccgggttttactccgttaccgtaccgtaggttacgtaaccggttaccgttccgttacgggtccgggaacctttcgttaacgttccgtacgtacccgtaattaaaccccgtaacgttaacccgttaacttaaaccgccggttaaccgtaccgtaacgttttccggttaccgtttttaacggtttacgacggttaggtaacgttccggtaccgttgttaccgacgttacggtagtacgttacgccggttaacgccgggtaccgggaaccgttacggttccgtaccgtaccggttccaccgttaccaccgtccccgtagacccgtacccggtaccg

SEQ ID NO: 211107 - DNA, 678 bp, Homo sapiens
  misc_feature: GYAE6OF02G9XQI.7.78.H01.1.454.CMB.1.raw
tcagcgtgtctctacacgaccggtgctcgatttagtgtgagtagtttgggtttgggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggctcagtgagcgttgcctgcaagtccttctggatacatcttacacttacttattctgtacaagttgggtccgaacgacggccccctaggacaacggccttagactacagtgggatggataccaaaccaccgacaccgtacgggaaccccacctatcgcccgaggtcccttacgacgacggggtcgttttcgtcttaccgtacctagtacggtaccttaccgttccgtcggtaccggggaccgtccgtttaagtcgtaggactaagtaaccgtaaaccctaaccgttacaacctagaaccgtactacgtacgttaccgttttagttttacgaacgtagtacgtcgttcgtcgtacgtacgtaggtacgtaagttcgtactacggtcgggtaccgaacgggtaacctggtacccgtaccgttcctaccgtcgtaccgtaccctacccgaaccggacccggtacccg

SEQ ID NO: 211108 - DNA, 889 bp, Homo sapiens
  misc_feature: GYAE6OF02GV1R7.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagtcgttgcctgacaagcccttcgtggactacattcttctaacttactttattctgttactaagttcgggtaccgaccgaaccgggtccccctagggtaaccaacgggtcccgtttacgaaccttaacgaaggttgggaagtacgggaacttacgaaaccgaacccggtacaacccgtaccgggaaaccccctacctacgtcgaccccgacggtccccttacgaccggtacggggttacggtttttcgtacccttttccgtaccgtaagttacgggtaacttaacccgttccgtttcgggggttaccggggtaccggttacccgtttacgtccgtttacggaaccgttaaacgtaaacccttaaacccttaaaccccgttaaccgtaaaacccggttaacgaaacccggtacccttaaaccgttccgggtttttaaaccccgttttttgttttttaaaccggaacgggttaaacggttacggttacccgggttttacgtttaaccggttcgtttaaaccggaacggttaggtttaaccgttacggtaacccggtttacggccggggtaacccggttaacccgggttaaccggtccgggttaccccttaacggtccctttacggccctaaccggtccccttacccggaaccgacccggttaacccgg

SEQ ID NO: 211109 - DNA, 914 bp, Homo sapiens
  misc_feature: GYAE6OF02IMXTZ.7.78.H01.1.454.CMB.1.raw
tcagcgtgtctctacacgaccggtgctcgattttagtgtgagtagtttgggtttgggacccaacaaccacacccctcctaagaagaagcccctagaccacagctccacaccatggactggacctggagactcctcttcttggtgcagtagcaacgaggtgcccctactccccgaggtcgcagtccgtggtacgtacgtcgtgggtcttagtaacgtggaaggtacgtccgggtcggggtcgttacgaggttggtacggtcgttcgccgtagaccgtaacgttcccgtttagacggtaacttacgtacttccttaacctaactttaacgtttctttcgtacgttaacgttaacggtttccggaccctaccgtacccgggtccccgtaggaaccgtaacggttccgtacgtaaccgttacgtggtacggtacggttacgtaacctaacccgtaaccggtacccgaacccgttaacccgggtaacccccggtaaacccccttacgttaaccggtccccgtaccggtacccggttaccctacggtaaccggggtcgggttttccgttttaccgttccgttaccgtacgtagtccgttaaccgtaccgttcgggtccgggtacggttaccgttacgtttcgtacgacgacgtaaccgttaaacgtaaacccgttacctaaccgtaaccgttcgaaacccgtacccgttaccgttacgtttttccgttttaacggttacggacgttaccggacgtttccggttcgttaacgttaccgtgttaaacgggttacgttaccgttaccgtaaccgtagggtacccggttacccgggaaaccgtttacccggtaccttacccggaccgttcccgtttaaccggcttaacccggtccccgtaaccggacccgggtaacccgtcccg

SEQ ID NO: 211110 - DNA, 913 bp, Homo sapiens
  misc_feature: GYAE6OF02GJQ5D.7.78.H01.1.454.CMB.1.raw
  modified_base (161)..(161): a, c, t, g, unknown or other
  misc_feature (161)..(161): n is a, c, g, or t
  modified_base (212)..(212): a, c, t, g, unknown or other
  misc_feature (212)..(212): n is a, c, g, or t
tcagcgtgtctctacacgaccggtgctcgatttagtgtgagtagtttgggtttgggggacccaacaaccacacccctcctaagaagaagcccctagaccacagctccacaccatggactggacctggagatcctcttcttggtcgcagtagcaacaggtcnccactcccaggtgcagctggtacagtcctgggtctagaattgaaggtaacnccttggggccttcgagtcgagtccgtagcctggcaacggtccttctaggaatacgaattcctttgaccttaactttacttctaggtactaaagtttcggggtacccgaacaccggtccccctagggtaaaccgaacgggtccctttaggaaccgttaaccaggtttacggggaacgttacgggaacgttaccgtaaaacccgaccggtaaccgtaaccgttaccgggggaaaacccccctacccgtttaacgaaccggtcccccgtaaacggggtccctttaacccgggaaccgtaaccgggggtccgggttttttacggaccttttacccgttaccctaacggttacgggttaaccttaccccggttacgttaccggggttaccgggggttaaccgggtaccgttttaacttccgttaacgggtacctaaacggttaaccgttaaaaccccgttaaccctttaacccggtaaacccttacggtaaaccgtacccttaaaccggtttcggttaaacccgtttttacttttttaaccggaacggttaacggtaagttcccggttacgttccgttaccggttacgtacggttaccggtaagtttaccggaactttccgggtaagggtacccggaaccggtaaccgtggtacccgtaccgtccgtccttacgaccgttccgtaaccctacggaaccgtacccgg

SEQ ID NO: 211111 - DNA, 679 bp, Homo sapiens
  misc_feature: GYAE6OF02H772P.7.78.H01.1.454.CMB.1.raw
  modified_base (233)..(233): a, c, t, g, unknown or other
  misc_feature (233)..(233): n is a, c, g, or t
  modified_base (505)..(505): a, c, t, g, unknown or other
  misc_feature (505)..(505): n is a, c, g, or t
tcagcgtgtctctacacgaccggtgctcgatttagtgtgagtagtttgggtttgggacccaacaaccacacccctcctaagaagaagcccctagaccacagctccacaccatggactggacctggaggactcctcttcgttggtgcgagtagcaacgaggtcgcccacctccgaggtcgcagctggtacagtcgtggtctagaatggaggacgccgtggggcgtacgaggtgngtcgttgctggacaacgtccgttcgtaggactactacttcttactacgttactttacgttcgtagtacgtacgttacgggtaccgaacgccggtccccgtaggaaccgtacgtccgttagactagacgtggattaggaactacgaacgaccgtaacaccggtaccggaacccacgtaccgtacgcccgacgtaccctcgaaccggtcgggttcgtttcttccgtactacgaagtcgtactaccgtgtcgggcgtacgtcttgcgcacgtaanactaaccgtacctacgacgtcgaacgtcttctagttagttttacgtacggcgtaggtaccgttcgttacgtgttacgtgtaaaggtctacgtggtaacctcgggtacccggaacgttaaccggaccttcgaaccgtacgttctcctaccgacgtccctaaccgcggtactcccg

SEQ ID NO: 211112 - DNA, 982 bp, Homo sapiens
  misc_feature: GYAE6OF02H2CJG.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtcgcccacctcccaggtgcagctcggtacagtcgtgggtctgaatgaggaacgccgtggggcgtacgagtggacgtcgttgcctgaccgaagtcctttcgtaggtaactacattcttacctaccttaacttatttccgttacgttaccgtaagtttcgggtaccccgtacgtaccgggtaccccgtaggaaaccgtaacggtaccgttaccgtaaccgttaaccgtaaggtcgggtaaagttacggtaacttacccgaaaacccgtaccccgaaaacgtaacccgggtaccggtaaaaccccccgtaaccgttacgtaacccggacccggtaacccgttacccgtttaaccggtaaaccgggtacggggtttcccgggtttttacgtttacccgttaccggttaaccgttaccgttacgggttacccgttacccgttcccgggttttaacccgggtacccggggtttaaccgggttacctttaccggtttacccgttacgggtaaccgtaaaaccgttaccgttaaaaccccgttaacccccgtttaaacgaaaccggtttaccgaaacccggttaaacgttaccccgtttacgttttaccgttttttaacggttaccggttaacccgggtaggtaaccgtttccggtttaccgttacgtttaccggttacgttaaccgggttaaggtaccctttaggtaacccgttacccggggtccggaaacccgggtccggttaacccgttcggtaccccgttaacccgtcccttaccggtacccctccggtttaccccgaacccggacccgggttaacccggtaccccgg

SEQ ID NO: 211113 - DNA, 643 bp, Homo sapiens
  misc_feature: GYAE6OF02HAICD.7.78.H01.1.454.CMB.1.raw
  modified_base (331)..(331): a, c, t, g, unknown or other
  misc_feature (331)..(331): n is a, c, g, or t
tcagcgtgtctctacacgaccggtgctcgatttagtgtgagtagtttgggtttggggacccaacaaccacacccctcctaagaagaagcccctagaccacagctccacaccatggactaggacctggaggatcctcttcttggtggcagtagcaacaggtgcccactccccgaggtgctagctggtacagtctgggtctgaattgaggaagccgtgggctcagtgagctgcctgctaagcctctggatcgatcttcgacttacgttatctgtacgtagttcggtccgacgcggaccccgtaggactaggtcctgactcgtgtggagtcganacaacaccgacaccgtaccggaacccctactacgtcgaccgtacgtcctcgacgtcgggttcgtttcgtcttccgtacgtacgtacggtacttccgtcgtcggtaccgggtacgtcttacgtcgtcgtacgacgtaaccttaaccctaccgttaccgaaccgtcgaccgacgttacgttacgttcgtttagttcgacgtagtacgtccgtcgtcgtcgttacgtaggtcgttagtacgtactacggtcggtaccgtacggtaccgtcggtaccctccgtccgtccgcgtccgtaccgtccgtaccgtcgtcc

SEQ ID NO: 211114 - DNA, 764 bp, Homo sapiens
  misc_feature: GYAE6OF02I9O7M.7.78.H01.1.454.CMB.1.raw
  modified_base (171)..(171): a, c, t, g, unknown or other
  misc_feature (171)..(171): n is a, c, g, or t
  modified_base (174)..(174): a, c, t, g, unknown or other
  misc_feature (174)..(174): n is a, c, g, or t
  modified_base (191)..(191): a, c, t, g, unknown or other
  misc_feature (191)..(191): n is a, c, g, or t
tcagcgtgtctctacacgaccggtgctcgatttagtgtgagtagtttgggtttggggacccaacaaccacacccctcctaagaagaagcccctagaccacagcctccacaccatggactggacctggagatcctctcttggtgcagtagcaacaggtgcccactccaggtnacngctggacagtctggtcngaattgaggagcctggggctcagtgagcgttgcctgacagccttagtggaatacgttctcaccttactttagttctgtactaacgtttcggggtacccgtacgacgggtcccccgtagggtaaaccgtaggtacccgtttaggaaccgttaaccggtagttacggtacgtagggtacttacccgaaaccgacccggtaaccgtaccgtaacccggggtaaccccctaacccgttacgtaccggtaccccgaacggttcccttaccgaccgtacgggggttaccgtttcgttacgtttcgtaccgtacggttacggtactaccggttccgtaggtaccgggacggttaccttacggtcttcgacgtaacgtaactaacccgttaactaccgtacctggaaccgtacctacgttccggttacgttttagtttccgtaaccgtagtaccggtcgttaccgtcgttacgacgtcggtacgtaagttcgtacgtacggtacggtccggtaacgggtacccttggtaacccgtacctccgtccgtacgtacggtaccctccgaccggtaccgtacccgg

SEQ ID NO: 211115 - DNA, 739 bp, Homo sapiens
  misc_feature: GYAE6OF02GNREK.7.78.H01.1.454.CMB.1.raw
  modified_base (160)..(160): a, c, t, g, unknown or other
  misc_feature (160)..(160): n is a, c, g, or t
  modified_base (204)..(204): a, c, t, g, unknown or other
  misc_feature (204)..(204): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtncccactcccaggtgcagctggtacagtctgggtctgatgaggancgtgggcgtcagtgagcgttgcctgacaacggtccttcgtcggatacgattccttacaccgttactttacttcgtgtctaagttgggtaccgacacggcccctggacgaacggccttggaacctacgacgtgggatggataccaacaccgacacgtaccgggaaacccctacgtatcgcccacgtccttcacgacggtcgtttgtcttcgtaccgtagtacggacttccgtcgttacgggaccggggtacgttccgttaatccgtaagtaactaacgtaaccttaaacccctaaccttaccgtaaacccgtggtaaacccgaacctaccgttcgggtttacccgttttttaatttttacggaaccggtaaggtacggttcccgtacgtttcctacggtttacgtacgttaggttaacgttcgtaaccttcggggtaccgggtaccgtaaacgggtaacccgttggtaacccgtaccccgttacgtccccgttacgaccgttcccccgttaccaaccccgggtaccgggttccccg

SEQ ID NO: 211116 - DNA, 775 bp, Homo sapiens
  misc_feature: GYAE6OF02IULQ7.7.78.H01.1.454.CMB.1.raw
  modified_base (155)..(155): a, c, t, g, unknown or other
  misc_feature (155)..(155): n is a, c, g, or t
  modified_base (260)..(260): a, c, t, g, unknown or other
  misc_feature (260)..(260): n is a, c, g, or t
  modified_base (366)..(366): a, c, t, g, unknown or other
  misc_feature (366)..(366): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaanaggtgcccactcccaggtgcagctggtacagtctggtctagattggagagccgtggggctcgagtgagcgttgcctgcaacgtccttcgtggactactattcctnactacttattctgtcagttggtccactcggcccgtgacaggtccttacgactacagtggagtggtactaccgaaccgacccgtacgaccgttaccgggaaaccccnccgtaacgtcgacccgtaacggcccttaccggaacggtaccggggttcgttttcgtccttttccgtaccgttacgtacggtacttacccgttcgttacggtacggggtaccgtctttacgtcttacgtccgtaacgaactttaaaccccctaacggttacgtaaaccttagaaacccgttcccttaccgttacccgtttaaccggttttttctttttaacggaacccgtaggtacgtaccccggtttcgttacgttcggttaactcggggtttaagttaagttccgtaaccggtccggggttacggtaccgggtaaaccggttcccgtccggttaaacctcccggtttacctccgggtttaaccggcccgacccctttaacccggggaacccaacccgggttacccccg

SEQ ID NO: 211117 - DNA, 668 bp, Homo sapiens
  misc_feature: GYAE6OF02IPZ5U.7.78.H01.1.454.CMB.1.raw
  modified_base (247)..(247): a, c, t, g, unknown or other
  misc_feature (247)..(247): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttcgcctgcaagcctttcgnggactacatcttcacttacttattctgtactaagttggtccgagacggcccctggacaaggccttagactacagtgggatggatacaacaccgacacgtcgggtaaccccacctatcgccgacggtcccttacgacggggtccgtttgtcttccgtccatcgactaccgtcgtggtaccgggacgtcttacgtcgtcgacgagtaacttaacctaaccttacctaacccgtacgaaccgtacctacgttacgttaccgtttttacgttttacgtacgtagacggtccgttcgttaccgtgtacgtagttacggtaattagtaccgttacggtacggggtccgtaacgggtaacccttcggtacctaccgttccttaccgtacgtaccgtcccgtaccgaaccgtaccggtaccctaaccgg

SEQ ID NO: 211118 - DNA, 858 bp, Homo sapiens
  misc_feature: GYAE6OF02FH4GZ.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctggtctgaattggagagcctggggctcagtgagcgtttcggcctgctaaacgtcctttcgtacgggattaacattcctttaccgaaccttactttaactttccgtgtacctaaagtttacggggttacccgaaccacgggtccccccgttaggaacccgaacgggtaccctttcggaacgttaccctaatcggggtaatgggtaacgttacaaacccgaacccggaccgtaaccgtaccggggaaacccccctaaccgtaactcgaccccgaggtccccctttacgaaccgtaacggggtccggttttacgttccgtttcctactacgttacggtactaccctacgttcggtacggggtaccgtctttaacttccgtacggtaccacgtaaacgtaaaccccttaacccgttccaaacccgttccgaaaccgtaaccttacgttaccggttaccgtttttacgtttttacggttaacggtacgttacggtaccgttaccgtttccgttaacgttcgtaaacggttacggttaaagttccgtaaccgttaccggtacggggtacccgtaaaccgggggttaacccgttccgggttaaccttaccccggttccgtaccccgtttcccgaacgttccccgtaaccccgtacccggttaaccggtaacccccgg

SEQ ID NO: 211119 - DNA, 841 bp, Homo sapiens
  misc_feature: GYAE6OF02GUWLK.7.78.H01.1.454.CMB.1.raw
  modified_base (248)..(248): a, c, t, g, unknown or other
  misc_feature (248)..(248): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaacgccgtggggctcagtcgagcgttgcctgacaagtccttcgnggtactacgattcttcaaccttacttattctgtactaagttcgggtcccgaacgacggtcccctaggaccaacgggtcccttaggaaccctacgtacggtggggtaacgtacgggtactaccgaaaccgacccgtaaccgtaaccgtacccggggaaacccccctaccgtaacgtccggaccccgtaacgggtccccttaccggaacgacggggtttccgggttttcgtcctttaccgtacctaagttcgtaaccgttacccgtcggtttaccgggtaccggggtaccgtacctttacgtccgtaacgtctaaacgtaacttaaacccctaaccctttacccaaacccggttacgtaacccgaaacccgttaccggttacgtttaacccgtttttaggttttacggttaaccggtaacgggtaccgttaccggtttcgtacgtttcggacgttaacggtaggttaacgttacgtaaccgttacgggttacggggacccggtaaccgggttaacccgttcgggtaaccccgccggtttacccgtacccgttaccgaccgttccccgtacccgttaacccggaccgggtaccccg

SEQ ID NO: 211120 - DNA, 738 bp, Homo sapiens
  misc_feature: GYAE6OF02IUZNI.7.78.H01.1.454.CMB.1.raw
tcagcgtgtctctacacgaccggtgctcgatttagtgtgagtagtttgggtttgggggacccaacaaccacacccctcctaagaagaagcccctagaccacagctccacaccatggactggacctggaggatcctcttcttggtggcagtagcaacaggtgcccactcccaggtgcagctggtacagtcgtggtctagaattggaggaagccgtggggctcagtgagcgttcgctgacaacgtccttgtggataacattctcaactacttattctgtctaagttgggtaccacgacggtacccctggaaccgtaacggtcctttacgaactacgagtggggtataggtaactaccaaccgtaacccgaacgtacccgtaaccgggaaacccccctaaccgtactaccgtacccgtaacggtcccttacgaaccggttaggggttccgttttcgttcccgtttactcccgtaagtcgggtacctacctcggttcggtcggggaccgttctatccgtagcgtaacgtaactaaaccctaaccctttaccaaccgtaccgaacctacttacgttacgtttacctttttagtttaccggtagtacgtacggttcgtacctacggttgtaccgttaggtaacggttattacgtaaccggtcggtcccggggaaccgtacggggtacccgtggtaccccgtacgttcccgtacctcgaccgtcccaccgtacccgaacggtccc

SEQ ID NO: 211121 - DNA, 815 bp, Homo sapiens
  misc_feature: GYAE6OF02G5OUN.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacgaggtcgcccactcccaggtgcagctggtacagtctgggtctgtaattggaggaagtccgtggggccgttcgaaggtgagtcgggttcgccgttggctaaacgtccctttgtcggaatacattccttctaacttactttagttccttgtacgttaagttcgggttaccacgtacggcccccgtagggaaccaagggtccccttagtaacctacgtaacgtgggtaacgtaggactaaccgaaaaccgtaaccggtaacgaacccgttacggggaaacccccctaacggtaaccgttccgccccgtaacggtccccgttaccggggaaccgggggttcgttttaccggtacctttccgtaacccgagttaccggttaaccgtaccgtttccgggttacgggtaccgggtaccggttacttaccgtcggtacgtacgaccgtaacttaacccggtaaccttaccgaaccgttagaccgtaactacgttccgttacgttttaaccgtttgaacgtacgtacggtaccgttcgtacgttacgtacggtacgtaagtacgtttacgcgttaacggtacgggaaccgtccgggtaaccggtccgtaccgtaaccgttccgttcgtacccggacttaacccgtccgtaccgaccggttcccgtccgg

SEQ ID NO: 211122 - DNA, 888 bp, Homo sapiens
  misc_feature: GYAE6OF02JMHNI.7.78.H01.1.454.CMB.1.raw
tcagcgtgtctctacacgaccggtgctcgatttagtgtgagtagtttgggtttggggacccaacaaccacacccctcctaagaagaagccctagaccacagctccacaccatggactggacctggaggatcctcttcttggtggcagtagcaacaggtgccactcccaggtgcagctggtacagtcgtggtctgaattgaggagccgtgggcgtcagtgagcgttgcctgcaagtccttcgtgatacacttcttctacttactttattctcgtacgtagttcgggtaccgacgtaccggtccccgtaggacgtaacggtccgttacgactaacgacgttaggggacgtaggactaaccgaaccgacccgtaacgaccgtaccgggtaacccctaacgttacgtaccgccgtaaccggtcccgttaccgtaccggtacggggtttcggttttcgttccgtttaccttacgtaacgtttacgtacgttcccgttacggtccgggtaccgggtacgttactttacgtcgttacgacgtaacgttaaaccctaacccgttaaacccttacccggtaaaccgtttaccggaaaccgttaacccgttacccgtttaccgggtttttaacccgtttttttaaagtttacccggttaaacgggttaccggttaacggttacccgggttttcccgtttaaggtttaccgttaaccggtacgggtttaacgtttaaccgttaccggtaaccgggtttacgggttacccggggttaaccgggtaacccggggtttacccggttccggttaaccccggttcccggtttacccccgtacggttaccgtaccccgggtcccccgttaaacccggaaccggggttaccccggttaacccccgg

SEQ ID NO: 211123 - DNA, 694 bp, Homo sapiens
  misc_feature: GYAE6OF02FLHHX.7.78.H01.1.454.CMB.1.raw
  modified_base (248)..(248): a, c, t, g, unknown or other
  misc_feature (248)..(248): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggactcctcttcttggtggcagtagcaacaggtgcccactcccaggtgcagctggtacagtctgggtctgaattgaggagccgtggggctcagtgagcgttgcctgccaacgtcccttcgnggactacattccttcacttacttattcgtcgtctaacgttcgggtccgacgacggcccctggaacaacggtcccttggactacgtaagtcgggtactggataccaaccaccggacacgtaccgggaaccccctaacctactcgaccccgtacggtcccttacgacgtacggggttccggtttcgtcttccgtacgattcgactcctcgtcggtccgggacgtnttacncgtacgacgataacctaacctaacctcaaccgttgaccactacgtcgtacgtttttctttacggacgtaggtacgtccgtcgttacgtggttaccgaagttacggtaactttcgggtacctacggtccgggtaccggtaaccgggtaaccgttacggtaccgttacccggtccgtaccgttacccaccgtccctacccggaaccggtacggtaccccg

SEQ ID NO: 211124 - DNA, 799 bp, Homo sapiens
  misc_feature: GYAE6OF02HNFQ9.7.78.H01.1.454.CMB.1.raw
  modified_base (158)..(158): a, c, t, g, unknown or other
  misc_feature (158)..(158): n is a, c, g, or t
  modified_base (221)..(221): a, c, t, g, unknown or other
  misc_feature (221)..(221): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagatcctcttcttggtgcagtagcaacaggtncccactccaggtgcagcgtggtacagttcgtggtctgtaagttggaaggagccggtgggctgngtgagtcgttgcctgactacgcctttgagatacattctactacttagttatcgtgtactagttcgggtaccacgaccggtcccgtaggacgtaacgtccttacgacttacgcgtagggtactggtaactacaaccggtaaccgtacgtaaccggtaccgggtaaccccctaacgttaacgtcccgtaccggtaacggttccccttaccgacgggttaacggggttcccggtttttacgttaccgtccgttaaccgtacggttaccggtacttaacccggttcggttacgggtaaccggggtcccgttagttttaacccgcgtaggtaacccgttaacgtaaaccgtttaacccgttaaacccgttaacgtaaacccggtcgtaaacccgtagttacccgtttaaccggtttacgtttttttagttacccgtaagggtacgacggtttaccgtttccgtaacgttcggtacgtaaggtttacggattaaccgtcgtaccgggtagtaccggaaccggtaccgttcgtacccgagttcccgttacgcgtacccgtccgtaacccaccgggacgttccccg

SEQ ID NO: 211125 - DNA, 663 bp, Homo sapiens
  misc_feature: GYAE6OF02HLA5N.7.78.H01.1.454.CMB.1.raw
  modified_base (213)..(213): a, c, t, g, unknown or other
  misc_feature (213)..(213): n is a, c, g, or t
  modified_base (455)..(455): a, c, t, g, unknown or other
  misc_feature (455)..(455): n is a, c, g, or t
tcagcgtgtctctacacgaccggtgctcgatttagtgtgagtagtttgggtttggggacccaacaaccacacccctcctaagaagaagccactagaccacagctccacaccatggactggacctggaggatcctcttcttggtggcagtagcaacaggtgccccactcccgaggtgcagctggtacagtctgggtctgaattgaggaagccgnggggctcagtgagcgttgctgcagccttctggatacatctcactacttattctgtactaagttcgggtccacgacggtccccgtggaacaacggtccttgactacgagtgggatggactcaaaccacgactacgtaccggaaccccctactaacgtcgacccgagtaccctcacggtacgggtcgtttcgtcttactccgtatcggtacttaccttcggtcggcgggtaccggtcttagtcngactagtaaactaaccctaaccttacaaccgtacggacgtacctacgtcgttccgtttttaattttcggaacgtacgacgtcgtacgttccgtgttaccgaggtacgttaacttagtaccgttacgggcggggtaacccaacgggtaccggtccgtaccgaccggtttcctacccgtctacccggacctaccccgaacggtaacccgg

SEQ ID NO: 211126 - DNA, 850 bp, Homo sapiens
  misc_feature: GYAE6OF02HS4NB.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttgggtggcagtagcaacgaggtcgcccactcccaggtgcagctggtacagtctgggtctgaattggaggacgccgtggggcgtcaggtgagtcggttcgccgtgacaacggtccttcgtggactacacttcttcacttacttattctgtactacgttcgggttaccagaccggcccctagggacgaacggtccgttacgacctaacgagttgggatggtactaccaaccaccggactaccggtaccgggtaacccctacgtcgaccggtacccgaccggttaccctcgtaacgggtcggggtttccggtttttacgttccgtttaaccgtcccgtaagttaccgggttaaccgttacccgtttccgggtacggggttacccgggggtaccgtttaccgttttagtacccggttcggtaaccgtacgaaacccgtttaacccctaaaccgttacccgaaccgtaccgggtaaccggtccctaacggttttcccggtttaaccggttttttagtttaaccgggtaacggaaggtttaccggtccgtttaccgttacgttaccggttacggttacgttaggttaacctttacgggtacctacggggtttccgggacccggtaaacgtttccccggggtataccccggttacggtcccttaccgtaccgtacccggttcccggtaaacccgtacccggggttaactcccccgggg

SEQ ID NO: 211127 - DNA, 709 bp, Homo sapiens
  misc_feature: GYAE6OF02INE3H.7.78.H01.1.454.CMB.1.raw
  modified_base (251)..(251): a, c, t, g, unknown or other
  misc_feature (251)..(251): n is a, c, g, or t
  modified_base (352)..(352): a, c, t, g, unknown or other
  misc_feature (352)..(352): n is a, c, g, or t
tcagcgtgtctctacacgaccggtgctcgatttagtgtgagtagtttggggtttgggggacccaacaaccacacccctcctaagaagaagcccctagaccacagctccacaccatggactggacctggaggatcctcttcttggtggcagtagcaacgaggtgcccactcccgaggtgcagctggtacagtctgggtctgtaattggaggagccgtggggacgtcaggtgagtcgttgcctgcagtccttnggtatacgatcttacacttagtttactcgttctacgtagttcgggtaccgacgtaccggcccgtaggaccgtaaggtcccgttaggactacgaggtagggntacggactaaccaacgaccgaaccgtacgtaccggaaccccgtatacgccgtacgaccggtcccttacgacgggtacgggttaccggtttacgtccttacgtacgagttacggtactaccgttacgtcgggacggggtacctcgtttacgcgttaggaccttaaggtaactaaacccttaccgtacgacgttacgactacgttaccgtcgtttaccgtttgtttaacggacgttcggtacggtccttacggtgttagtccgtaggtactacgttagaccggtcggtacggaccggtaacggtccgtaccgtaccgtccgtactcgtaacgcccgtacgtaaccgaccggacgtaccg

SEQ ID NO: 211128 - DNA, 686 bp, Homo sapiens
  misc_feature: GYAE6OF02GHE8L.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacatcttcactacttattctgtcaagttgggtccacgacggccccctggaacacggtccttgactacagtggatggatacaacaccgacacgtacggaacccctactactccgcccgacggtccttacgaccgtacgggtcggttttcgttcctttacctaccgtaagtcgggtaaccttacccgtcgtcgggtcggggtaccgtctttacgtcgtcgacgtaacgtacgtaaaccctaccgtttaaccaccgtagaacccgtacctacgttaccgttcgttttacgttttaggaccgtaaggtcgtccggttcgtcgttgtaccgtagtacgttaagttcgaacgttcggtacggggaccgtaacggtacccggtgtcccgttacccgttactacccggtacgacccgtaccgtccccgtaacccgggacgtccccg

SEQ ID NO: 211129 - DNA, 939 bp, Homo sapiens
  misc_feature: GYAE6OF02G8Y4E.7.78.H01.1.454.CMB.1.raw
  modified_base (230)..(230): a, c, t, g, unknown or other
  misc_feature (230)..(230): n is a, c, g, or t
  modified_base (264)..(264): a, c, t, g, unknown or other
  misc_feature (264)..(264): n is a, c, g, or t
tcagcgtgtctctacacgaccggtgctcgatttagtgtgagtagtttgggtttgggggacccaacaaccacacccctcctaagaagaagcccctagaccacagctccacaccatggactggacctggagatcctcttcttggtggcagtagcaacgaggtgcccactcccaggtgcgtagctggtacagtcgtgggtctagaattggaggaacgccgtggggcgtcaggngacgtcgttgcctgacaagtccttgtagactacntactctacttacttacgttcgtgtactaagttcgggaccgtacgtacggtaccccgttaggaaccgtaacggtaccgttacgtaaccgtacggtacgttacggggaagtacgggtaacttaaccggtaaaaccgaccccggtaaaccgtaccgggtttaaccccggggaaacccccttaaccgttaacggttaccccggtcccggttaaaccggttacccggttaactaaccggggtaaccggggttcggggtttttactttaacccgtttccgttaaccggtaagttaccggtaaccttacccgttacgggtttacccggggtaccggggtaccggttaaccgtttaggttcccgtaagggtacccaacggttaaacctaaccccggttaacccttaacccgtaaccgtaccgtaacgaaccgtttaccgtaccggtttaccgttttttaacgtttacggaaacgggttaccgtaccggttacggttaccggtttacgtacgtttacgggacggttaaaccggtaatttaccgggtaacccgtttacggggtaccggggtaacccggttaaccggggtaacccttttccggggtacccgttaaccccgttcccgttaaccgttaacccggtaccgaacccccgttacccggtaccgggtaaaccccgtcccggg

SEQ ID NO: 211130 - DNA, 798 bp, Homo sapiens
  misc_feature: GYAE6OF02HH5QJ.7.78.H01.1.454.CMB.1.raw
  modified_base (173)..(173): a, c, t, g, unknown or other
  misc_feature (173)..(173): n is a, c, g, or t
  modified_base (184)..(184): a, c, t, g, unknown or other
  misc_feature (184)..(184): n is a, c, g, or t
tcagcgtgtctctacacgaccggtgctcgatttagtgtgagtagtttgggtttggggacccaacaaccacacccctctaagaagaagcccctagaccacagctccacaccatggactggacctggagtatcctcttcttggtggcagtagcaacaggtgcccactcccaggtncagctggtacngtctgggtctagaattgaggagccgtaggggctcagtgagtcgttgcgtgactaacgtccttgtaggactacgtattcttaccgtacttacttacttctcgttactaagttcgggtccgaccgaccggtccccgtaggaaccgtaacggtaccctttcgactaacgaaggttcgggacgttacggtacttccgaaaccgaccgacgtaaccggtccgggtaaaccccctacgttacgcccgtaccgaaccggttcccgttaccgtaaacgggtcggggtttaccgggttttcgttaccctttaccgtaccgtaacgtacggtaccgttacccgttcgggttccggggtaaccggggtaccgttaccgttttacgtacgtaccggtacgtaaacgtaaccttaaaccccttaccgttaacccgaaaccgttcggaaacccgacgttaactttccggtttacgtttttaacggttacggtacgaacggtcgttaccggttcctacgtcggtactacggttagtaacgttataccggttcggacgggtacccgtaacggtaccgtggtaccctaccggttctacccgcgtaccctaccgtcccgacgtcggtacccg

SEQ ID NO: 211131 - DNA, 777 bp, Homo sapiens
  misc_feature: GYAE6OF02IZCVT.7.78.H01.1.454.CMB.1.raw
  modified_base (714)..(714): a, c, t, g, unknown or other
  misc_feature (714)..(714): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtcgcccactcccaggtgcagtctggtacagtcgtggtctagtaattcggaggacgtccgtggggctacgagtgaggtcgttgccgtacgactaacggtcctttacgaggtaatactcttctactacttacgtttacttcgtacgtacttaagttcgggtccaacgtaccggtcccgtaggaaccgtaacggtcctttaccgaaacttacgtaggtacgggtacttaggacctaaccgaaccgaaccggtactaaccggtaacccggtaaccctacgtacgtaccgcccggtacgtacccgtacgacggtaccgggtttcgtttactcccttacgtacgtagtacgtacgttaccgtcggtaggtaccggagttacttaggctcgaaagtacgttaaccaacgttaccctacgtaacgcgtaacccgattaaccgggttctttaaccgttttaggtacaacgggttaagccggtttactccggttacgttaaggttaccgtacgggtaaattcgacccggtgttacccgggtaccgggaacggtaccggttaacccngttaccccgtaccgttacggttacccacgggtttccaaccccgtaccaccggggtccctaccg

SEQ ID NO: 211132 - DNA, 745 bp, Homo sapiens
  misc_feature: GYAE6OF02GCUQ8.7.78.H01.1.454.CMB.1.raw
  modified_base (711)..(711): a, c, t, g, unknown or other
  misc_feature (711)..(711): n is a, c, g, or t
tcagcgtgtctctacacgaccggtgctcgatttagtgtgagtagtttgggtttggggacccaacaaccacacccctcctaagaagaagcccctagaccacaggggctccacaccatggactggacctggagatcctcttcttggtggcagtagcaacaggtgcccactcccaggtgcagctggtacagtcgtgggtctgaacttggaggaacgccgtggggcgtacaggtgacgtcgttacgccgtgactaacgtccttgtcggatacgtacttcgtcaaccgttacttattctagttactaacgttcggggtacccgaacgtaccgggtcccctagggaaccgtaacggtccttagaacctacgaggtgggagtcggactaccgaaaccgccgtaacgtaccggtaccgggaaaccccctaacgttcgccgtacccgacggtccctcgaacggtcggggttcggtttactcgttaccacgtgtacgaacttacccgtcgtagggtaccgggctacgttacgtcgtacgacgtaagtaacctaaaccccgtaccttaaccaaccgttcggaaaccacgttaccgttaccggttttacttttacgtttcggaaacgtggaccgttccggtactcgttcgtacgttaggacgtttaacgtgtaacccgttgggtacgggacccgtaacggggtaaccgtcgtccgtacccgtntaccgtcgaccgttcccaccgacggtacccgtcc

SEQ ID NO: 211133 - DNA, 791 bp, Homo sapiens
  misc_feature: GYAE6OF02GX684.7.78.H01.1.454.CMB.1.raw
  modified_base (247)..(247): a, c, t, g, unknown or other
  misc_feature (247)..(247): n is a, c, g, or t
tcagcgtgtctctacacgaccggtgctcgatttagtgtgagtagtttgggtttggggacccaacaaccacacccctctaagaagaagcccctagaccacagctccacaccatggactggacctggaggatcctcttcttggtggcagtagcaacaggtgcccactccaggtgcagctggtacagtctagggtctagaattgaggaagccgtgggctcagtgagcgttacgctcgacaacgccttacnggactacatcttcacttacttatcgtgtactaacgttcggtaccacgacggtcccctaggaactaacggtcctagactacgagtggtatggataaccgaacgtaccgacgtaccgtaccgggtaacccctacgtaactccggaaccctacggtaccttacgaacggtaacgggttcgtttacgtaccgtttcctaccgtaagtacggtaacttacccgtacgtacgggtaccggaccgttccgttaaacgtccgtaggaaccgtaacgtaaaccgttaaaccctaaccctttaaccgtaaacccgtacgtaacccgtaaccttaaccggtttacgtttaccgtttttaacgttttacggacggtaagttaaccgtccgttaccggttacgttcgtaaccgtaagggttacgtaacgttccgtaaacggttaccgggtaccgggaaccgttaaccggggtacccgtttaaggtccccgttaacccgttccgtacccgttacggaccccggttacccgtaacccggtaccggaacccgttacccgg

SEQ ID NO: 211134 - DNA, 837 bp, Homo sapiens
  misc_feature: GYAE6OF02FYROK.7.78.H01.1.454.CMB.1.raw
  modified_base (163)..(163): a, c, t, g, unknown or other
  misc_feature (163)..(163): n is a, c, g, or t
  modified_base (809)..(809): a, c, t, g, unknown or other
  misc_feature (809)..(809): n is a, c, g, or t
tcagcgtgtctctacacgaccggtgctcgatttagtgtgagtagtttgggtttgggggacccaacaaccacacccctcctaagaagaacgcccctagaccacagctccacaccatggactggacctggaggatcctcttcttggtggcagtagcaacaggtcncccactcccgaggtgcagcgtggtacagtctggtctgattgagagccgtgggctcagtgacgtcgttcgacctgacaacgtccttctaggatacattccttacaacttacgttacttccgtagtacgtaggttacgggtaccgacgtaccgggtccctagggaacgtaaccggttccttcgaacctaaccgaggttcggggtaatacgggtataaaccgtaaaccggacccgtaaaccgtaccgtaaccccggggtaaccccctaacgttaaccgcccggtacccgtaaccgggttacccttaacggtaaccgggtacgggggttttaccggttttttcccgttaccgtttcccgtacgtttaacgggttccggttaaaccctttacccggttccgggtttacggggtaccggggtaccgtttactttacggttccgtacgaacggttaaaccgtaaacctttaaccccgtaaccttaacccgaaccggttacgtaaacccgctttaccggtttacggtttaccttttttacgttacggtaacgtgtaccgtcggttccgtagtcgttacgaggttccaagttcgtaacgtcgggtcggaacgtaccgggtacctaccggttacgtacccgttccgtacgtacccncggtaccctacccggaacgccggtcccg

SEQ ID NO: 211135 - DNA, 602 bp, Homo sapiens
  misc_feature: GYAE6OF02IVM24.7.78.H01.1.454.CMB.1.raw
  modified_base (99)..(99): a, c, t, g, unknown or other
  misc_feature (99)..(99): n is a, c, g, or t
  modified_base (267)..(267): a, c, t, g, unknown or other
  misc_feature (267)..(267): n is a, c, g, or t
  modified_base (402)..(402): a, c, t, g, unknown or other
  misc_feature (402)..(402): n is a, c, g, or t
  modified_base (479)..(479): a, c, t, g, unknown or other
  misc_feature (479)..(479): n is a, c, g, or t
  modified_base (514)..(514): a, c, t, g, unknown or other
  misc_feature (514)..(514): n is a, c, g, or t
tcagcgtgtctctacacgaccggtgctcgatttagtgtgagtagtttgggtttggggacccaacaaccacacccctctaagaagaagcccctagaccanagctccacaccatggactggacctggaggatcctcttcttggtggcagtagcaacaggtgcccactcccaggtgcagctggtacagtctgggtctgaattgaggaagcctggggctcagtgagcgttgcctgcaagccttgtcgatacatcgtcactacttattcgtntacaacgttcggtccgaacacggtcccccgtagaccgtaaaggtcccttagaactacagttagggtataggactacacgaaccgactacgtacgggaaccccacttatcgcctacgcctacaccgtaggcgtttntccttcgtaccagtcgattccgtctacgggtcggacgtcttagctagctagacgtacctaactacactcgacgaacnctcgttactttatttcgagtacgtagtcgtccgtnttcgcgtacgtagtaacgtgacttacggtaggtcgacggtaaccgtgtaccgtccgtactcgtacacgtccctacacgtacgtacccg

SEQ ID NO: 211136 - DNA, 881 bp, Homo sapiens
  misc_feature: GYAE6OF02FYMMT.7.78.H01.1.454.CMB.1.raw
tcagcgtgtctctacacgaccggtgctcgatttagtgtgagtagtttgggtttgggggacccaacaaccacacccctcctaagaagaagcccctagaccacagctccacaccatggactggacctggaggatcctcttcttaggtggcagtagcaacaggtgcccactcccaggtgccagctggtacagtctggggtctgtaattgaggaagccgtaggggcgtcagtgagcgttgccgtgcaaggtccttctggtatacattacttactactacgttattcgtgtactaagttcgggtaccgacgacggtccccgtggaacgtaacggtccttagacctacgaggttcgggtaagtggtactaccgaaacctacccgaactacggtaaccgggaacccctacgtactccggacccgtacggtacccgttccggtaccgggggtaccggttttacggttcccgtttaccgttaccgtaacggttacgggtaaccgttacccgttacggttcgggtaccggggtaacccgttccgttttaacggtcccgtaggtaacccgtaacgttaaccgttaaaaccccgttaacccgtttaacccgaaacccgttcgggaaacccgtaaccgttaccggttccggttttaaccgtttttcgtttttaacgggaacccgttaagggtaccgggttacgttccggttacctttacggggtaccgttaagggtaagttaaacggtttcgaacccgtttagggtacccgggggtaactaacccgggggttacccggttaaccggtaccccgttaacccggttaccgttacccgttaccggtcccggttaccccaccccggtaacccggttacccggtacccccggttaccgg

SEQ ID NO: 211137 - DNA, 658 bp, Homo sapiens
  misc_feature: GYAE6OF02G2R7B.7.78.H01.1.454.CMB.1.raw
  modified_base (241)..(241): a, c, t, g, unknown or other
  misc_feature (241)..(241): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgagagcctggggcgtcagtgagcgttgcctgcaagccttcnggatacattcttacactacttattctgtactagttggccacgacggcccctaggacaacggcttcgactacagtggatggactacgaacgaccgacacgtacgggaaccccacctatcgccgacggtcctacacgcgggtcggtttgtcttactacctagtcggtactaccgttccgtcggtaccgggacgtcttacgtctcgactaagtactaacctaacccttaccaacctcgaaccgtactacgttcgttacgttttactttttacggacgtacggtacgtcggttaccgttcgtcgttacgtacggttaggttaacgttacgtacgtacggtcgggtacccgaaccgggtaccgtacggtaccgaccgttccctcctacggtaccgtaccctcccgtaaccggacgtaccccg

SEQ ID NO: 211138 - DNA, 796 bp, Homo sapiens
  misc_feature: GYAE6OF02H0T3I.7.78.H01.1.454.CMB.1.raw
  modified_base (285)..(285): a, c, t, g, unknown or other
  misc_feature (285)..(285): n is a, c, g, or t
tcagcgtgtctctacacgaccggtgctcgatttagtgtgagtagtttgggtttggggacccaacaaccaccacccctcctaagaagaacgcccctagaccacagctccacaccatggactggacctggaggatcctcttcttggtgcagtagcaacaggtcgcccactcccaggtgcagctagtacagtcctggtctgtaattgaggagccgtggggctacgagtgagtcggttgcctgacaagtccttctaggactactagttcttactacttaacgtttattntcgttacgtagtttaccgggtcccgtaacgaccggtccccgtaggtaaccgtaacggtcccttagaccgtaaccgttagtcggggtaattagggaactacgtaaccgaaccgaccgtaacccggtaacccggaacccctacgtaacgtccgacccgtacggtcccttacgaccggtagggtttcccgtttacgttccgtttaccgttaccgtaggttccgtaaccgttaccgttaccggtttcgggtaaccgggtaacgttccgtttagttcccggtacgtaccgaagttaaacccttaacccgtaacccttaccgtaacccttacggaacctaccgtacgttaccgtttcgttttacgtttaacggtacgttaacggccgttacggttaccgttagtacgttcgtagttcggttaattcgaaggttaccgggtcggtaccggaacggtacccgttggaaccccttacgcccttaccgcctaccgccccgtaacgaccggtacccgacccg

SEQ ID NO: 211139 - DNA, 781 bp, Homo sapiens
  misc_feature: GYAE6OF02F7Q2C.7.78.H01.1.454.CMB.1.raw
  modified_base (241)..(241): a, c, t, g, unknown or other
  misc_feature (241)..(241): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggaggatcctcttctggtggcagtagcacaggtgcccactcccaggtgcagctggtacagtctgggtctgaattgaggaagcctggggctcagtgagcgttgcctgccaagccttcnggatacatcgttcactacttacttctgtcaattcgggccgacacggccccctgggacaaggccttcgaactacgagtgggatcggtataccaaaccaccggacacgtacgggaaccccctaccttacaccgaccctacggcccttacgaccggtacggggtccgggttttgttccttcgtcctacgttggtaccttaccgtcgtttcgggtcgggtaccggtactttacgtcgttcggactacgtaacttaacctaacccgttaccaaccgtacggaacgaacccgttacttacccggtttaccgttttttacgttttttacggtaaacggttaacggtacggttacccgtttaccggttaccgttacggttacgttacgggttaaggtaacggttaccggtaacgttacggggtaccgggggtaacccgtaaccggggggttaaccccgttcggggttaacccgtccccgttacccgtttaccccggtaccgtacccgttccccgtaaccccgggttaacccgacccggggttaccccg

SEQ ID NO: 211140 - DNA, 871 bp, Homo sapiens
  misc_feature: GYAE6OF02GIZYM.7.78.H01.1.454.CMB.1.raw
  modified_base (180)..(180): a, c, t, g, unknown or other
  misc_feature (180)..(180): n is a, c, g, or t
tcagcgtgtctctacacgaccggtgctcgatttagtgtgagtagtttgggtttgggggacccaacaaccacacccctcctaagaagaagccctagaccacagctccacaccatggactggacctggaggatcctcttcttggtaggcagtagcaacaggtcgcccacgtcccgaggtgcngctggtacagtctgggtctgtaacttggaggaacgccgtggggctcgaggtgaggtcggttgcctgtacgaacgtccttcgtggtactaccattccttacctaacttactttattctcgttacgtaacgtttcgggtacccgacggtaccgggtcccccgtaggtaaccgtaacgggtcccgttacggtaccgttaacgagggttgggtaacggttggtaacgtacctaaaccgtaacccgaacgaccggtaccgggaaaccccctacgtaacctccgacccgtacggtcccttaccggacggtacggggttaccgttttcggtactttcctacgtacggtacggttaccgttcccgtacgggttcgggttaccgggggaccggtttacttcgttcggacgtaacgtaacgtaaaccttaacccgtaactaaccgtaacgtacggaaacccgtacgtacgttacccggtttaacgtttttcgtttaacgggaacgttagggtaccgtttccggttccgggtttacgttacgggtaccgggttaaaggtttacggtaaacggtttcgtaaccccgggttagggtacccggggttaaccggtccggggtaacccggttacggtacccgttaccgtttccgtaccgttcccggtaccggttaccctacccggtaaccgggtcccggtaccccgg

SEQ ID NO: 211141 - DNA, 679 bp, Homo sapiens
  misc_feature: GYAE6OF02HDVCX.7.78.H01.1.454.CMB.1.raw
  modified_base (172)..(172): a, c, t, g, unknown or other
  misc_feature (172)..(172): n is a, c, g, or t
  modified_base (335)..(335): a, c, t, g, unknown or other
  misc_feature (335)..(335): n is a, c, g, or t
  modified_base (582)..(582): a, c, t, g, unknown or other
  misc_feature (582)..(582): n is a, c, g, or t
tcagcgtgtctctacacgaccggtgctcgatttagtgtgagtagtttgggtttggggacccaacaaccacacccctcctaagaagaagcccctagaccacagctccacaccatggactggacctggagatcctcttcttggtggcagtagcaacaggtgcccactccaggtncagctggtacagtctggtctgaattgaggagcctggggctacagtgagcgttgcctgcaacgtccttcgtaggaatactatcgttacaacttacttagttcctgtaccaagtttcggtaccgaacacggtcccctaggaacgtaaaggtcccttagaacctanacgtggggatacgggaattaccaaaccgtaccgaactaaccgttaccgggaaccccctaacgtaacgtccgacccgacggttccctacgaacgacggggtcggttttactccttactccgacgtgggtaactaccgtcgtcggtaccgggagtcttaaagtcgcgacaggtaacctaactaaccctcgaaccgtgaaccagtactcgttacgtttttagtcgtagagtcgtacgtttcgcttacgtnacgggttagtaatcggaacttcggtaggacccgtaagggtacccttggaacccgttccgtactcccgtcaaccgttccccaacgaccggccgtaccg

SEQ ID NO: 211142 - DNA, 714 bp, Homo sapiens
  misc_feature: GYAE6OF02G4511.7.78.H01.1.454.CMB.1.raw
tcagcgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggagcctggggcgtcagtgagtcgttgcctgcaagtccttactggatacattcttcacttacttattctgtacagttcggtccgacacggcccctggacacggtccttgactacgagtgggattggactacgaacgaccgacacgtcgggaacccctacgtactccgacccgacggtcccttaccgacggtacggggttcggttttacgttccttccgtccgtagtacggtaccttaccgttcgtggttaccggggtacgtactttacgtcgtcgacaaggtaaccttaacctaaccgttaccgaaccgtacgtaaaccgtaccttaaccgttccggtttaaccgtttttacgttttacggaacggttaacgtacggttacccgtccgtttacgttacgttcgtaggttacgtaacgttacgtactaccgggtacgggacccgtaacgggtaccctggtacctacccggttccgtaccctcgtaccgtacctacccgaccggtacgtacccg

SEQ ID NO: 211143 - DNA, 769 bp, Homo sapiens
  misc_feature: GYAE6OF02HNSKY.7.78.H01.1.454.CMB.1.raw
  modified_base (754)..(754): a, c, t, g, unknown or other
  misc_feature (754)..(754): n is a, c, g, or t
tcagcgtgtctctacacgaccggtgctcgatttagtgtgagtagtttgggtttggggacccgaacaaccacacccctcctaagaagaagccctagaccacagctccacaccatggactggacctggagatcctctctggtcgcagtagacaacaggtgacccactcccaggtgcagactggtacaggtcgtgggtctagaagttggaggaacgtccgtggggcgtacgaggtcgacggtcgttcgcctagacctacgtaccgttcgtagggtaactaactacgttaccttccgtaattaccgttaattccgtagttactaaggttcgggtacccacgtaccggtccccgtaggactacggtccttagaccttagacggttacgggataggacctaaccgaacgtaccgtacctacggtaccgggtaaacccctctaggtccggcccgtaacgggtacccttacggaacgggtacgggtttccgtttaacgtcccgttcgtaccgtacgttacgaaccttaccgttacggtaccgggtacgggtcttaccttacggtacctgtaaccgtacgttaaacttaaacccgtacctaccgtaccgaggtaacctcgtaacgttccgtttaacgtttagttacggacgtacgtacggttcgtcccgtatccggtagtaacgggtatacgttacgtacgttagccgggttacaaccgggtcctacggccttaccggtctaccccgtagtcgtaccccgtanaacccggtcgtaccg

SEQ ID NO: 211144 - DNA, 507 bp, Homo sapiens
  misc_feature: GYAE6OF01DZI5N.26.26.C04.1.454.CMB.1.raw
tcagagactatactcacgaccggtgctcgatttagtctagcgactttgggtttggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgccttgaactggattcagcagagccaggccaacctccgaggcgcctaatttataagatttctaaatcgggattccggggtcccagacagattcagcggcagtgggtcaggcactgatttcacgctgaagatcagcagggtgaggctgaggatgttgcggtttatactgcctgcagagtattcactggccgtggacgttcgacgacggacggacgtaaggg

SEQ ID NO: 211145 - DNA, 527 bp, Homo sapiens
  misc_feature: GYAE6OF01AZX4S.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgccttgaactggattcagcagaggccaggccaacctccgaggccgcctaatttactaagatttctaatcgggattccggggtccagacagattcagcggcaggtggtcaggcactgatttcacgctgaagatcagcgagggtggaggctgaggatggtgtcggtttatacgtgccgtgcgagtagtattcgacgttcggcgtggacggttcggaccgaaagggaccaagggtggaaatcgaaacgaacgtaggtcggctagcacagtcgtcg

SEQ ID NO: 211146 - DNA, 553 bp, Homo sapiens
  misc_feature: GYAE6OF01CTILH.26.26.C04.1.454.CMB.1.raw
  modified_base (301)..(301): a, c, t, g, unknown or other
  misc_feature (301)..(301): n is a, c, g, or t
  modified_base (309)..(309): a, c, t, g, unknown or other
  misc_feature (309)..(309): n is a, c, g, or t
tcagagactatactcacgaccggtgctcgatttagtctagcgactttgggtttggggactgatcaggactcctcagttcaccttctcacaatgaggctccctgctcagctcctggggctgctaatgctctgggtcccagggtacagtggggatgttgtgatgactcagtctccgctctccctgcccgtcacccttggacaggcgcctccatctctgcaggtctagtcagagcctcgtacacagtgatggaacaccgccttgaactggatcagcagagcaggccaactcgagcgctaattanaagtattntaatcggattccgggtccagacagattcgagcggcagtggtcaggcactgactttcacgtactgaacgatcgagcgagggtggaaggctaggaggtagtggttgtcggttttattacgtgccgttgctaggtagtagttacacgttggccggttggtaccggttccggaccgtaaacgggaccgtaagggtaggaaagttaccgaaacgtaacgtgtacggactaggacctaccgtagttaccg

SEQ ID NO: 211147 - DNA, 660 bp, Homo sapiens
  misc_feature: GYAE6OF01DMWXB.26.26.C04.1.454.CMB.1.raw
  modified_base (325)..(325): a, c, t, g, unknown or other
  misc_feature (325)..(325): n is a, c, g, or t
  modified_base (372)..(372): a, c, t, g, unknown or other
  misc_feature (372)..(372): n is a, c, g, or t
tcagagactatactcacgaccggtgctcgatttagtctagcgactttgggtttgggggactgatcaggactcctcagttcaccttctcacaatgaggcctccctgctcagctccgtggggctgctaatgctcgtgggtcccagggtacaggtggggatgttgtgatgactcagtctccgctctccctgcccgtcacccgttggacaggccggcctccatctcctgcaggtctagtcagacgcctcgtacacagtgatagggaacaccgccttgaacgtggattcagcagaggccaggccaaccgtccgaggcgtacctaatttanaagtatttactaagtcggtacgttccgggtccagacagattcagcgnaggtggtcaggcactgtatttcgacgtcgtagaagatacgagacgtaggggtaggagggtaccgtgggaaggtagttggtttacggtacgggttttaactttacgtcggtccgtggaccgtaaggtaagttaacttaccgtaacggttcgggtcccggtagggttaacggtttcccgggaacccgtaaacggggaaacccggtaaacgggtaagggtaaaacgtaacgtaaaaccgggtaaccgttagggtacggaccgttaggacccgtaaaccgtacgtttaccgg

SEQ ID NO: 211148 - DNA, 520 bp, Homo sapiens
  misc_feature: GYAE6OF01BMWEO.26.26.C04.1.454.CMB.1.raw
  modified_base (516)..(516): a, c, t, g, unknown or other
  misc_feature (516)..(516): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcggattccgggtcccagacagattcagcggcagtggtcaggcactgatttcacgctgaagatcagcgagggtggaggctgaggtatgttgcgtttatactgcctgcaggagtattcacgtggccgtggtaccgttcggaccgaagggaccgaagggtaggaaatccaaaacgactggtacggctagcaccngtcg

SEQ ID NO: 211149 - DNA, 564 bp, Homo sapiens
  misc_feature: GYAE6OF01ECM8T.26.26.C04.1.454.CMB.1.raw
  modified_base (558)..(558): a, c, t, g, unknown or other
  misc_feature (558)..(558): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgcttgaactggattcagcagaggccaggccaacctccgaggcgcctaatttataagtatttctaagtcgggattcccggggtcccagacagattcagcggcaggtggtcaggcacgtgatttcacgctagaagatcgagcgaggggtggaggctggaggtatggttgcggttttattacgtgcgtgacagtacgttattccgagtcgggccgtagggtaccggttccgggacccgaaggggtacccgtaaagggttaggaaacgtacgaaaacgaacgtggtacggactagactaaccngttccg

SEQ ID NO: 211150 - DNA, 517 bp, Homo sapiens
  misc_feature: GYAE6OF01CP1QD.26.26.C04.1.454.CMB.1.raw
  modified_base (514)..(514): a, c, t, g, unknown or other
  misc_feature (514)..(514): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcggattccggggtcccagacagattcagcggcaggtggtcaggcactgatttcacgctgaagatcagcagggtggaggcgtgaggtatgttgcggttttattactgcctgcagagttattcacgtggccgtggaccgttcggaccgaagggaccgaaggtggaaatcgaaacgatagtggactgcaccntcg

SEQ ID NO: 211151 - DNA, 559 bp, Homo sapiens
  misc_feature: GYAE6OF01AM82F.26.26.C04.1.454.CMB.1.raw
  modified_base (324)..(324): a, c, t, g, unknown or other
  misc_feature (324)..(324): n is a, c, g, or t
  modified_base (425)..(425): a, c, t, g, unknown or other
  misc_feature (425)..(425): n is a, c, g, or t
tcagagactatactcacgaccggtgctcgatttagtctagcgactttgggtttgggggactgaagtccaaggactccctcaggttcaccttcctcacaatgaggctccctgctcagctcctggggctgctaatgctctgggtcccagggtccagtggggatgttgtgactgactcagtctccgctctccctgcccgtcacccttggacaggcggcctccagtctcctgcaggtctagtcagagcctcgtacacagttgatgggaaccaccgccttgaactggattcagcagacggccaggccaacctcgaggcgcctaatttanaagatttctaatcgggattaccgggccagacagattcagcgcagtgggtcaggcactgactttcgacgctgaagatcgagcaggggtgaggctggaaggtntggttgcggttttattatgtccgtgacagagtacttacacttggcgtggtacgttcgggaccgaagggtacccgaagggtaggaaatccgaaaacggtacgtacggtacgggactaggctaccgtagttcccgg

SEQ ID NO: 211152 - DNA, 512 bp, Homo sapiens
  misc_feature: GYAE6OF01C45UY.26.26.C04.1.454.CMB.1.raw
  modified_base (506)..(506): a, c, t, g, unknown or other
  misc_feature (506)..(506): n is a, c, g, or t
  modified_base (509)..(509): a, c, t, g, unknown or other
  misc_feature (509)..(509): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcaccccttggacaggcggcctccatctcctgcaggtctagtcagagcctcgtacacagtgatgggaacaccgccttgaactggattcagcagaggccaggccaacctccgaggcgcctaatttataagatttctaatcgggattcccggggtccagacagattcagcggcagtggtcaggcactgatttcacgctgaagatcagcgagggtggaggctggaggatgttgcggttttattctgctgcagagtattcatggcgtggtacgttcgccaagggaccaagggtagaaatcgaaacgtactggtcgctgaccncgntcg

SEQ ID NO: 211153 - DNA, 531 bp, Homo sapiens
  misc_feature: GYAE6OF01BJZ60.26.26.C04.1.454.CMB.1.raw
  modified_base (526)..(526): a, c, t, g, unknown or other
  misc_feature (526)..(526): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtggtcaggcactgatttcacgctgaagatcagcgagggtggaggctggaggtatgttgtcggtttattactgcctgcaggagttattcacgtggccgtggacgttcggaccgaagggaccgaagggtaggaaactcgaaaacgtacgtggtacggctagcctaccngttcg

SEQ ID NO: 211154 - DNA, 715 bp, Homo sapiens
  misc_feature: GYAE6OF01BEC8M.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaaccgtccgaggccgacctaatttataagtatttctaagtcgggactttccgggaccgtaccgacgacgagtactacgacggcggacgtagggtcggtacgcggactacgtagttacgttaccgacgtcgtaaggaacgtacgtacgacgtacgggtaggggtaagggacggtacggtagggtaacggttaggtttacgggtttcgggttttaacgggttttaactttaccggttccggtaccggttacggtaacggtaaggttaacgtttaccgttaaccgttacgggtaccgggttaccgggtacggggttaccggttaccccgggaacgggtaaaccgggtaaccgggtaaaggggtaaacggtaaaccgtaaacggtaaaccggtacggttgggtaccggtacgtacgacccgtacgtacg

SEQ ID NO: 211155 - DNA, 539 bp, Homo sapiens
  misc_feature: GYAE6OF01A3EK7.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgcttgaactggattcagcagagccaggccaactccgagcgcctaattataagatttctaatcgggattccgggtcccagacagatcagcggcagtggtcaggcactgatttcacgctagaagatcagcgagggtggaggctaggaggtatggttgcggtttattacgtgctgacagagtattcacgtggccgtgggaccgttcggaccgaaaggggacctaagggtaggaaacgtaccgaaaacggtaacgttggtacggactaggaccaacgtagttccg

SEQ ID NO: 211156 - DNA, 509 bp, Homo sapiens
  misc_feature: GYAE6OF01ALKWR.26.26.C04.1.454.CMB.1.raw
tcagagactatactcacgaccggtgctcgatttagtctagcgactttgggtttgggggactgatcaggactcctcagttcaccttctcacaatgaggctcccttctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtgaggctgagatgtgcggtttatactgcctgcagagtattcactggccgtggacgttcggccgaagggaccaagggtgaaatcgaaacgactgtggctgacaccatcgtcg

SEQ ID NO: 211157 - DNA, 535 bp, Homo sapiens
  misc_feature: GYAE6OF01D6OPY.26.26.C04.1.454.CMB.1.raw
  modified_base (414)..(414): a, c, t, g, unknown or other
  misc_feature (414)..(414): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggtattccgggtcccagacagattcagcggcagtggtcaggcactgatttcacgctgaagatcagcagggtgaggctgaggatgtgngtatttattactgcctgcagtagttattcactggccgtggtaccggttccggaccgaacggggacctaagggtacggaaactaccgaaaacgaacgttaggtacggctcggccaccgtacg

SEQ ID NO: 211158 - DNA, 520 bp, Homo sapiens
  misc_feature: GYAE6OF01EA4E7.26.26.C04.1.454.CMB.1.raw
  modified_base (515)..(515): a, c, t, g, unknown or other
  misc_feature (515)..(515): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctagaagatcagcgagggtggaggctggaggatgttgcgtttatactgcctgcagagtattcgacgtggccgtggacgttcggaccaagggaccgaagggtgaaatacgaaacgaactggtacggctagactaccntctcg

SEQ ID NO: 211159 - DNA, 543 bp, Homo sapiens
  misc_feature: GYAE6OF01CLL4T.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgcttgaactggatcagcagagccaggccactccgagcgactaattataagatttcaagtcgggattcccggggtcccagtaccagattcgagcggcgaggtgggtcagggcacttgactttcacgtctgaacgatcgagcgaggggtggaggcgtggaggtattggttgtacggtttattaccgtgtcccgtgcgagtagtattcgacgtcggcgtggtaccgttacggaccgtaagggaccgtaagggtaacgg

SEQ ID NO: 211160 - DNA, 529 bp, Homo sapiens
  misc_feature: GYAE6OF01B5FSW.26.26.C04.1.454.CMB.1.raw
  modified_base (524)..(524): a, c, t, g, unknown or other
  misc_feature (524)..(524): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgccttgaactggattcagcagaggccaggccaacctccgaggcgcctaatttataagatttctaatcgggattccggggtcccagacagatcagcggcaggtggtcaggcactgatttcacgctgaagatcagcgagggtggaggcgtgaggtatgttgcggttttattactgcctgcgagagttatcgacgtggccgtggtacgttcggaccgaagggaccgaaggtaggaaacgtcgaaacgtaacgtgtcggctagccaccgngttcg

SEQ ID NO: 211161 - DNA, 635 bp, Homo sapiens
  misc_feature: GYAE6OF01AENIE.26.26.C04.1.454.CMB.1.raw
  modified_base (316)..(316): a, c, t, g, unknown or other
  misc_feature (316)..(316): n is a, c, g, or t
  modified_base (626)..(626): a, c, t, g, unknown or other
  misc_feature (626)..(626): n is a, c, g, or t
tcagagactatactcacgaccggtgctcgatttagtctagcgactttgggtttgggggtacgtgatcacggactcctcagttcaccttctcacaatgaggctcccctgctcagctccgtgggctgctaatgctctgggtcccagggtccagtgggatgttgtgactgactcagtctccgctctccctgcccgtcacccttggacaggcggcctccatctcctgcaggtctagccagagcctcgtacacagtgatgggaacctaccgccttgaactggattcagcagaggccacggccaactcgagcgcctaattanaagatttctaagtcgggattccgggaccaggaccagattcgagcggcgaggtggtacaggcacgtgtagtttcgacgtctagaagtactcgagcgaagggtggaggtctaggaggtattggttcggtacggttttaagttacttggtcccttaggtaccgtaggtacgttacttaccgacggttacggtaccggttacgggtaccggttccgggacccggtaaacggggtacccgtaaaggggttacgggtaaaacgtccggaaaaacgggtaaccgttagggtaccggacgttacggccgtaaacccgngtttacccg

SEQ ID NO: 211162 - DNA, 582 bp, Homo sapiens
  misc_feature: GYAE6OF01BNSMH.26.26.C04.1.454.CMB.1.raw
  modified_base (437)..(437): a, c, t, g, unknown or other
  misc_feature (437)..(437): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtgggatgttgtgatgactcagtctccgctctccctgcccgtcacccttggacaggccggcctccatctcctgcaggtctagtcagagcctcgtacacagtgagtgggaacaccgccttgaactggattcagcagaggccaggccaaccgtcgaggcgcctaatttataagtatttctaagtcgggtacttcccgggggtacccaggaccagtacttcgagcggcgaggtgggtcaggcacgtgactttcacgctagaagntacagcgagggtggaggtcgtggaggtagttggtttaggtcggttttattacgtgtccgtgacgtaggtagttattccgtacgttcgggtcccgtacgggtaccggttaccgggaccggtaaacggggaccgtaaggggtaacgg

SEQ ID NO: 211163 - DNA, 598 bp, Homo sapiens
  misc_feature: GYAE6OF01A7X6F.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgccttgaactggattcagcagaggccaggccaaccgtccgaggccgacctaatttataagtatttctaatcgggattccggggtcccagacagattcagcggcaggtgggtcaggcacgtgtactttcacgctagaagactcgaggcgaggggtggaaggtcgtaggtagggtagttggtttaggtacggttttattaccgtgtccgtgacgtagtagttacttcgacgttggtccgtgggtaccgttccgggaccgtaaaggggacccgtaaagggtaggaaacgtaccggaaaacgtacgttacggtacgggacctaggaccctaaccgtagttcccg

SEQ ID NO: 211164 - DNA, 516 bp, Homo sapiens
  misc_feature: GYAE6OF01D3KYP.26.26.C04.1.454.CMB.1.raw
  modified_base (386)..(386): a, c, t, g, unknown or other
  misc_feature (386)..(386): n is a, c, g, or t
  modified_base (510)..(510): a, c, t, g, unknown or other
  misc_feature (510)..(510): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagntcagcagggtgaggctgaggtatgttgcggtttatactgcctgcagagtattcactggccgtggacgttcggaccgaagggaccaagggtcggaaatcgaaaacgactgtacggctagaccacntcgtcg

SEQ ID NO: 211165 - DNA, 556 bp, Homo sapiens
  misc_feature: GYAE6OF01CTIIW.26.26.C04.1.454.CMB.1.raw
  modified_base (546)..(546): a, c, t, g, unknown or other
  misc_feature (546)..(546): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctcatctcctgcaggtctagtcagagcctcgtacacagtgagtgggaacaccgccttgaactggattcagcagaggccaggccaacctccgaggcgacctaatttataagtatttactaagtcgggattccggggtacccagaccagtattcagcggcaggtgggtcaggcacgtgtatttcgacgctagaagatcgagcgagggtgaggcgtgaggtatggttgtacggtttattacgtgtcctgactagtagttactcacgttggccgtggtaccgttcggacccgtaagggtaccgaagggtagaaatacgaaacgacgtgtacggactacgactaccngttcgttacg

SEQ ID NO: 211166 - DNA, 523 bp, Homo sapiens
  misc_feature: GYAE6OF01CC2QV.26.26.C04.1.454.CMB.1.raw
  modified_base (519)..(519): a, c, t, g, unknown or other
  misc_feature (519)..(519): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtacagtggggatgttgtgatgactcagtctccgctctccctgcccgtcacccttggacaggcgcctccatctcctgcaggtctagtcagagcctcgtacacagtgatgggaacaccgccttgaactggattcagcagaggccaggccaacctccgaggcgcctaatttataagatttctaatcgggattccggggtccagacagattcagcggcagtggtcaggcactgatttcacgctgaagatcagcagggtggaggctgaggatgttgtcggtttattacgtgcctgcagagttattcgacttggccgtggaccgttcgggccgaagggaccgaagggtaggaaatcgaaacgaacgtgtcggctagctaccgntccg

SEQ ID NO: 211167 - DNA, 552 bp, Homo sapiens
  misc_feature: GYAE6OF01EHXXD.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtacagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagtatttctaatcgggattccggggtcccagacagattcagcggcagtgggtcaggcacgtgtatttcacgctagaagatcaggcgagggtggaggcgtaggaggtagtggttgtacgggttttattacgtgccgtgcagtagttattcgactgggtccgtggtaccgttcggaccgaagggaccgaagggtggaaagtcgaaacgtaacgtggtaggctaggacaccgtagttaccg

SEQ ID NO: 211168 - DNA, 535 bp, Homo sapiens
  misc_feature: GYAE6OF01EYB0T.26.26.C04.1.454.CMB.1.raw
  modified_base (362)..(362): a, c, t, g, unknown or other
  misc_feature (362)..(362): n is a, c, g, or t
  modified_base (395)..(395): a, c, t, g, unknown or other
  misc_feature (395)..(395): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctcctccctgcccgtcacccttggacaggcggcctccatctcctgcaggtctagtcagagcctcgtacacagtgatgggaacaccgccttgaactggattcagcagaggccaggccaacctccggaggcgtacctaatttactaagtatttctaatcgggattccggggtccagacagattcagcgnaggtggtcaggcactgtatttcgacgctgaagntcgagcgagggtggagctggaggatgttgtcggtttattacgtgcctgcgagtagtattcacgtggcgtggacggttcggaccgaacgggtaccgaagggtaggaaactcgaaacgactcgtacggactagcactgtacg

SEQ ID NO: 211169 - DNA, 526 bp, Homo sapiens
  misc_feature: GYAE6OF01AJTSK.26.26.C04.1.454.CMB.1.raw
  modified_base (383)..(383): a, c, t, g, unknown or other
  misc_feature (383)..(383): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagccctcgtacacagtgatgggaacaccgccttgaactggattcagcagagccaggccaacctccgagcgcctaattataagatttctaatcgggattccgggtcccagacagattcagcgcagtggtcaggcactgatttcacgctgaagntcgagcgagggtggaggctggaggtatggttgtcggttttattacgtgcctgactagtattattcacgtggccggtggaccgttcggaccgaagggaccgtaagggtagaaatcgaaacgtactggtaggctagcacgtgtcg

SEQ ID NO: 211170 - DNA, 522 bp, Homo sapiens
  misc_feature: GYAE6OF01A063T.26.26.C04.1.454.CMB.1.raw
  modified_base (515)..(515): a, c, t, g, unknown or other
  misc_feature (515)..(515): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatggggaacaccgccttgaactggattcagcagaggccaggccaacctccgaggcgcctaatttataagatttctaatcgggattccggggtccagacagattcgagcggcaggtgggtcaggcactgatttcacgctgaagatcagcagggtgaggctaggaggatgttgcggtttatacgtgcctgcaaggtgtatcatggccgtggacgttcggaccgagggaccgaagggtcggaaatcgaaaacggacgtgtaggctgaccaccngtcgtcg

SEQ ID NO: 211171 - DNA, 543 bp, Homo sapiens
  misc_feature: GYAE6OF01B7F2Y.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaattataagatttctaatcgggattccggggtccagacagattcagcggcagtgggtcaggcactgatttcacgctagaagatcagcgagggtggaggctaggaggtattggttgtcggtttattacgtgcctgcgagtagttattcgacgtgggtcccggtgggtaccggttccggacccgaacggggaaccgtaagggtaacggg

SEQ ID NO: 211172 - DNA, 546 bp, Homo sapiens
  misc_feature: GYAE6OF01CKK51.26.26.C04.1.454.CMB.1.raw
  modified_base (539)..(539): a, c, t, g, unknown or other
  misc_feature (539)..(539): n is a, c, g, or t
  modified_base (543)..(543): a, c, t, g, unknown or other
  misc_feature (543)..(543): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtacagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgacctaatttataagtatttctaaagtcgggtacttccggggtcccagacagattcgagcggcgaggtgggtcaggcacgtgtatttcgacgctagaagatcgagcgaggggtggaggcgtggaggtagttggttgtacgggttttatacgttgctgcagtagttattcgacgtggtccgtggtacgtcggaccgaagggacgaagggtagaagtacaaacgtagtgtcggactgcncgtntcg

SEQ ID NO: 211173 - DNA, 537 bp, Homo sapiens
  misc_feature: GYAE6OF01BGXCT.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagtatttctaatcgggattccggggtccagacagattcagcggcagtgggtcaggcacgtgatttcacgctgaagatcgagcgagggtggaggctggaggtagtggttggtcggtttattacgtgcctgcagtagtattcacgtggccggtggtaccgttcgggaccgaagggaccgaaagggtaggaaatacgaaacgacgtggtcggctagacactagtcgtcg

SEQ ID NO: 211174 - DNA, 514 bp, Homo sapiens
  misc_feature: GYAE6OF01BBAVO.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgtctgaagatcagcgagggtggaggcgtggggatgttgcggtttatactgcctgcagtagtattcacgtggccgtggacgttcggccaagggaccaaggtggaaatcgaaacgactgtgactgacacatctgttcc

SEQ ID NO: 211175 - DNA, 592 bp, Homo sapiens
  misc_feature: GYAE6OF01D1JSF.26.26.C04.1.454.CMB.1.raw
  modified_base (461)..(461): a, c, t, g, unknown or other
  misc_feature (461)..(461): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgccttgaactggattcagcagaggccaggccaacctccgaggccgacctaatttataagtatttactaagtcgggtattcccggggtcccagacagattcgagcggcaggtgggtcagggcagtgtatttcacgtctagaagactcgagcgagggtggaaggcgtaggaggtnttggttgtacgggttttattacgtcgtcctggacgtaaggtacgttattccgacggttaccggggtcccggttagggtaacccgggttcgggacccggtaaacgggggtaacccgtaaaggggtaaacggg

SEQ ID NO: 211176 - DNA, 534 bp, Homo sapiens
  misc_feature: GYAE6OF01D7OEO.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcgagggtggaggctggaggatgttgtcggtttattacgtgcctgcagtagtattcacgtggccgtgggacgttcggaccgaaaggggaccaagggtacggaaatacgaaaacggaacgtggtaggctacgacacctgtcgttcg

SEQ ID NO: 211177 - DNA, 680 bp, Homo sapiens
  misc_feature: GYAE6OF01DJ0O3.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtacagtggggatgttgtgatgactcagtctccgctctccctgcccgtcacccttggacaggcggcctccatctcctgcaggtctagtcagacgcctcgtacacagtgagtagggaacaccgccttagaactggattcagcaggaggccaggccaaccgtcgacggcgaccttaatttactaagtatttaccgtaagtccgggtacgttcccggggtaccaagacagtattcgagcggcaggtgggtcaggctacgtgtactttcgacgtctagaagactacgagcgagggtggaggtcgtaggaggtagttggttaggtacggttttaacgtacgtcgtcccgtggtaccgtaaggtaagttacgttaccgtacggttcgggtacccggttacgggttaaccgggtttacccggggaaacccggtaaacgggggtaaacccgggtaaaacggggttaacgggaaaaacgtttaacccggaaaaccggtaacggttacgggtacggtaccgtacggtaccctaacccgtagtttacccg

SEQ ID NO: 211178 - DNA, 581 bp, Homo sapiens
  misc_feature: GYAE6OF01A5GZX.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtccagacagattcagcggcagtgggtcaggcactgatttcacgctgaagatcagcgagggtggaggcgtggagggagttgttggtcggtttattacgtgtccctgcgagtagttattcgtacgtggtcccggtggtaccggtttcgggaccgtaaaggggacccgtaaaggggttacggaaaagtaccgaaaacggtaacgttaggtacgggacgttacggacctacccgtaagttccgtttacgg

SEQ ID NO: 211179 - DNA, 518 bp, Homo sapiens
  misc_feature: GYAE6OF01C95U3.26.26.C04.1.454.CMB.1.raw
  modified_base (513)..(513): a, c, t, g, unknown or other
  misc_feature (513)..(513): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgccttgaactggattcagcagagccaggccaactccgaggcgacctaatttataagatttctaaatcgggattccggggtccagacagattcagcggcagtggtcaggcactgatttcacgctgaagatcagcgagggtggaaggcgtgaggattgttgtcggttttatactgctgcagtagtattcactggccgtgggacgttcggaccgaagggaccgaagggtgaaagtcaaaagacgtagtcggactgacncatcg

SEQ ID NO: 211180 - DNA, 510 bp, Homo sapiens
  misc_feature: GYAE6OF01AMD86.26.26.C04.1.454.CMB.1.raw
  modified_base (472)..(472): a, c, t, g, unknown or other
  misc_feature (472)..(472): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctcccctgcccgtcacccttggacaggcgcctccatctcctgcaggtctagtcagagcctcgtacacagtgatgggaacaccgccttgaactggattcagcagaggccaggcccaacctccgaggcgcctaatttataagatttctaatcgggattccggggtcccagacagattcagcggcagtgggtcaggcactgatttcacgctgaagatcagcagggtggaggctgagatgttgcgtttatactgcctgcagagtattcnctggccgtggacgttcggaccaagggccgaaggtacgg

SEQ ID NO: 211181 - DNA, 663 bp, Homo sapiens
  misc_feature: GYAE6OF01BRYWF.26.26.C04.1.454.CMB.1.raw
  modified_base (288)..(288): a, c, t, g, unknown or other
  misc_feature (288)..(288): n is a, c, g, or t
  modified_base (357)..(357): a, c, t, g, unknown or other
  misc_feature (357)..(357): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctggtccagggtccagtgggatgttgtgatgactcagtctccgctcctccctgcccgtcacccttggacaggcgcctcatctctgcaggtctagtcagacgcctcgtacacgagtgagtacgggaaccnccgtccttaggaactggtattcgagacaaggacggcccaggcccaacctccggaggctacttaatttanaagtactttcgaagtcgggtacgttcccggggtaccagtacagtacttcgaagcggactaaggttcgggtacgaggtactacgtgtaactttaccgacgtcttagaacgtactacgacggtacgtaaggggtcggaagggtccgtaggacgggttagttggttacggtacggttttaacttaccggtcggtccttacggacgttaggtaacgttacgttcccggtaacggttcgggtacccgggttacgggttacccgggttaccgggaacccgtaaacgggggtaacccgtaaggggttaaacgg

SEQ ID NO: 211182 - DNA, 532 bp, Homo sapiens
  misc_feature: GYAE6OF01DB5A2.26.26.C04.1.454.CMB.1.raw
  modified_base (329)..(329): a, c, t, g, unknown or other
  misc_feature (329)..(329): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgcttgaactggatcagcagagccaggccaacctccgaggcnctaattataagtatttctaaatcgggattccggggtccagacagattcagcgcagtggtcaggcactgatttcacgctgaagatcgagcgagggtggaggctggaggtagttggttgtcggtttattacgtgtctgcagtagtattacgacgttcgggccgttagggtacgttacggaccgtaagggaccgtaagggtaacgg

SEQ ID NO: 211183 - DNA, 591 bp, Homo sapiens
  misc_feature: GYAE6OF01CSPXN.26.26.C04.1.454.CMB.1.raw
  modified_base (415)..(415): a, c, t, g, unknown or other
  misc_feature (415)..(415): n is a, c, g, or t
  modified_base (512)..(512): a, c, t, g, unknown or other
  misc_feature (512)..(512): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctccgtggggctgctaatgctcgtgggtcccagggtccagtggggatgttgtgatgactcagtctccgctctccctgcccgtcacccttggacaggccggcctccatctcctgcaggtctagtcagacgcctcgtacacgagtgagtcgggaaccaccgccttagaactggattcagcagacgccaggtcaaccgtccgaggccgaccttaaatttaataaagtatttactaaagtcgggtacgttcccggggtaccagacagtacttcgagcggntaggtgggtcgaggcacgtgtactttcacgtcgtagaagatcgagcgagggtggaggcgtaggaggtagttggttgtacggtttattacgtgtccgngacgtagtacgtattcgacggttcggccggttacgggtaccggttcggaaccggtaacgggaaccgtaagggtaaacgg

SEQ ID NO: 211184 - DNA, 549 bp, Homo sapiens
  misc_feature: GYAE6OF01CQ7SE.26.26.C04.1.454.CMB.1.raw
  modified_base (462)..(462): a, c, t, g, unknown or other
  misc_feature (462)..(462): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggccgacctaatttataagtattttactaagtcgggattccggggtcccagacagattcagcggcaggtgggtcaggcacgtgtatttcacgctgaagatcagcgtagggtggaggctggaggagttggtttggtcggttttattactgccttgacagtagtnttcacgtggccgtggacgttcggaccgaagggaccgaagggtaggaaactcgaaaacgtaacgtggtacggactgaccacgagttcg

SEQ ID NO: 211185 - DNA, 535 bp, Homo sapiens
  misc_feature: GYAE6OF01BZ1JH.26.26.C04.1.454.CMB.1.raw
  modified_base (525)..(525): a, c, t, g, unknown or other
  misc_feature (525)..(525): n is a, c, g, or t
  modified_base (532)..(532): a, c, t, g, unknown or other
  misc_feature (532)..(532): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagccctcgtacacagtgatgggaaccaccgccttgaactggattcagcagaggccaggccaacctccgaggcgcctaatttataagatttctaagtcgggattcccggggtcccagacagattcgagcggcaggtgggtacaggcacgtgactttcacgtctgaagatcagcgagggtggaggcgtgaggagtggttgtcggtttattacgtgtcctgctagtagtattcacgtggccgtgggtacgttcggaccgaagggaccgaaggtaggaatacgaaacgatcggtgcngctacgntcg

SEQ ID NO: 211186 - DNA, 519 bp, Homo sapiens
  misc_feature: GYAE6OF01E4O9V.26.26.C04.1.454.CMB.1.raw
  modified_base (516)..(516): a, c, t, g, unknown or other
  misc_feature (516)..(516): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagtatttctaatcgggattccggggtcccagacagattcagcggcagtgggtcaggcactgatttcacgctgaagatcagcgaggggtggaggtctggaggatgttgcggtttattactgcctgcagagtattcacgtggccgtggacgttcggaccgaagggaccgtaggtagaaactcaaacgaactgtcggctgcaccntcg

SEQ ID NO: 211187 - DNA, 616 bp, Homo sapiens
  misc_feature: GYAE6OF01DTR6S.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccaggtggggatgttgtgatgactcagtctccgctctccctgcccgtcacccttggacaggcgcctccatctcctgcaggtctagtcagagcctcgtacacaggtgagtgggaacaccgccttgaactggattcagcagacggccaggacccaaccgtccggaggaccgtaccttaaattttataagtatttacgtaaagtcgggtacgttcccggggtccagacagattcgagcggtgaggtgggtcgaggacacgtgtatttcgacgtcgtagaagtatacgagcgtaggggtggaggcgtaggaggtagtggtttggtacggttttaatacgttggccttggacgtagtacgttattccgtacgtcggtccggtgggtaaccgttcgggaaccgtaaggggaaccgtaaaggggtacggtaaagtaaccgaaaacgaacgttgggtacggtactagaccactagttcgttacg

SEQ ID NO: 211188 - DNA, 542 bp, Homo sapiens
  misc_feature: GYAE6OF01B62TO.26.26.C04.1.454.CMB.1.raw
  modified_base (538)..(538): a, c, t, g, unknown or other
  misc_feature (538)..(538): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgccttgaactggattcagcagaggccaggccaacctccgacggcgcctaatttataagtatttctaatcgggtagttcccggggtcccagacagattcgagcggcaggtgggtcaggcacgtgatttcgacgctgaagatcagcgagggtgggaggcgtggaggtatggttgtcggtttattactgctgactagagttatcgacgtggccgtggtaccgttcggaccgaacgggaccgaagggtaggaaatacgaaacgaacgtggtacgctagcaccgnttcg

SEQ ID NO: 211189 - DNA, 739 bp, Homo sapiens
  misc_feature: GYAE6OF01DL48W.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctctccctcgcccgtcacccgttggacaggcggcctccactctcctgcaggtctagtcagacgcctcgtacacgagtgagtgggaacaccgtccttagaacgtggacttcgagcgagacggccacggtccaaccgtccggacggccgtaccttaaatttataaagtacttttacgtaaagttccggggatttccccgggggtacccaaggtacctaaggttacttaccgaaggtccgggaccgtaagggttcggggtaccgaagggccctaacgttaggtacttttaccgaacggtcgtaggaaagacgttcaagggtccggtaagggggtcggagggtcgtagggacggtgttaggtttggttacggttttactacgttgaccgtgacgtaggtacgttagttccgaccggttcgggtaccgttacggggtaccggttaccgggaaccgggtaaaacgggtaacccggtaaacgggttaagggaaaaactaaacccgggtaaaacggtaaccggttacgggtaccgggtacgttaccggaaccgtaccgttaacgtttccgg

SEQ ID NO: 211190 - DNA, 797 bp, Homo sapiens
  misc_feature: GYAE6OF01C1Z2M.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctctccctgcccgtcacccgttggacaggccgcctccatcctcctgcaggtctagtcagagcctcgtacacaggtgagtcgggaaccaccggtccttagaacgtggacttcagacgaggacggacccgacgggacccaacccgtccgacgggccgtaaccttaaattttaacgtaagttacttttaccgtaaaggttccggggtacgttcccggggtacccaacggtacgtaaggtacgttccggggcggaccgtagggttacggggtacgtaacgggcctaacgtcggttaacttttccgacggtaccgtaaggaaacgtacgttacgaacggtaccggtaagggggttagggaacgggtacgtagggtaacgggtaggtttcgggttttacgggtaccgggtttttaagtttaccgtcggttcccgttaggtaccgtaaggtaacgtttaacgttaccgtacggttcggggtacccggttcgggtaacccgggtttaccggggacccggtaaacggggtaacccggtaaaggggttaaccggtaaaacgttaaccggaaaacggtaaaccggttggttacgggtaccgtacgtaccgtaccctaacgtttcgttaaccg

SEQ ID NO: 211191 - DNA, 611 bp, Homo sapiens
  misc_feature: GYAE6OF01AP66R.26.26.C04.1.454.CMB.1.raw
  modified_base (488)..(488): a, c, t, g, unknown or other
  misc_feature (488)..(488): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctcctccctgcccgtcacccttggacaggccgcctccatcctcctgcaggtctagtcagagcctcgtacacagtgagtgggaacaccgccttgaactggattcagcagacgcaggcccaactccggagcgactaattataagtatttataacgtcgggtacgttcccggggtacccagacagtattcgacggcggcgtaggttgggtacgagggtactaacgttgtactttccgacgtcgtagaacgtatcgagtacggaggggtggaggtcgtaggagggtnttggttgtacggtttattacgtgtccgtagacgtaggtagttagttacgacggtcgggtacccggttacgggttaccggttacgggacccggtaaacggggtaaaccgtaaggggtaaacggg

SEQ ID NO: 211192 - DNA, 828 bp, Homo sapiens
  misc_feature: GYAE6OF01DOAFT.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctggtcccagggtccagtgggatgttgtgatgactcagtcctccgctctccctgcccgtcacccttgacaggcgcctcatctcctgcaggtctagtcagacgcctcgtacacagtgagtgggaacaccgccttagaacctggacttcgagcgagacggaccacggacccaaacccgtccggaacggccgtaccctttaaaagttttaattaaaacgtagtttttaccttaaaggttacccggggggttaacgtttcccccggggggttacccccaaggtaaacccgtaaggtaaacgttttaccggaagggacccgggtaccgtaaacggggtttcgggggttaccaaacgggggtcccttaaaccgttggttaaactttttcccgaaccggtaccgtttaaggaaacgtacgttaccgaacgggtaccgggtaggggggttacggaaacggggttccggtaaggggtaaggggttaagtttcggggtttacggtttaaccgggttttttaacttaccggttacggtccccgttaggtacgttaacgggtaaacgttttagttaaccggtaccggttaccggggttacccgggttaccgggttacccggggtttaaccccggaaccgggtaaaaccggggaaacccgggttaaaggggttaaaaccggg

SEQ ID NO: 211193 - DNA, 532 bp, Homo sapiens
  misc_feature: GYAE6OF01AK2MG.26.26.C04.1.454.CMB.1.raw
  modified_base (527)..(527): a, c, t, g, unknown or other
  misc_feature (527)..(527): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtccagacagattcagcggcaggtggtcaggcactgatttcacgctgaagatcagcgaggggtggagggctggaggtagtgttgtcggttttatacgtgcctgcagtagtattcacgtggccgtgggcgttcggaccgaagggaccgaagggtaggaaactacgaaacggaactcggtggctagcaccgngtccg

SEQ ID NO: 211194 - DNA, 592 bp, Homo sapiens
  misc_feature: GYAE6OF01AEY05.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagacgcctcgtacacagtgatgggaacaccgcttgaactggattcagcagacggccaggccaacgtccgaggccgaccttaattataagtatttctaagtcggtagttccgggtccagacagacttcgagcggcgaggtggtcgacggcacgtgtactttcgacgtctagaagactcgagacgaggggtaggacggcgtagaggtgttggttagtcggttttagttacgtcgtcgtgacgtagtagttacttcgacgtcgggccgtaggtaccggttccggaccgaacggggtaccgtaaggggtacggtaaacgtacgaaaccggtaatacggtacggacgtagaccctacgtacgttaccg

SEQ ID NO: 211195 - DNA, 646 bp, Homo sapiens
  misc_feature: GYAE6OF01DIGSG.26.26.C04.1.454.CMB.1.raw
  modified_base (232)..(232): a, c, t, g, unknown or other
  misc_feature (232)..(232): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccaggtggggatgttgtgatgactcagtctccgctctccctgcccgtcacccttggacnggccgcctccatcctctgcaggtctagtcagacgcctcgtacacgagtgagtgggaaccaccgtccttagaactggattcgagcaggacgccaggacccaaccgtccggaaggccgtacctttaatttaacgtaagtattttacgtaaagtccgggtacgttcccggggtacccagtacagtacgttcgaggccggtacgtagggtcgggtacgaggtcctaacgttcgtactttcgacgtcgtaggaaagtcgtacgagacgtaggggtggacggtcgtaggtaggtgttggtttacgttacggttttagtacgtcggtccgtggtacgtaggtacttagttacgacggttcgggtacccgttacgggtaccggttaccggaccggtaacgggtaaccggtaagggtaaacgg

SEQ ID NO: 211196 - DNA, 518 bp, Homo sapiens
  misc_feature: GYAE6OF01EQDW0.26.26.C04.1.454.CMB.1.raw
  modified_base (511)..(511): a, c, t, g, unknown or other
  misc_feature (511)..(511): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggccgcctaatttataagatttctaatcgggattccggggtcccagacagattcagcggcagtgggtcaggcactgatttcacgctagaagatcagcagggtggaggctgaggatggttgtggtttattactgcctgcagagtattcacgtggtccgtggtacgttcggaccgaagggaccaaggtacgaaatcgaaagacgtgtggctgacacngtcgtcg

SEQ ID NO: 211197 - DNA, 545 bp, Homo sapiens
  misc_feature: GYAE6OF01D6862.26.26.C04.1.454.CMB.1.raw
  modified_base (303)..(303): a, c, t, g, unknown or other
  misc_feature (303)..(303): n is a, c, g, or t
  modified_base (426)..(426): a, c, t, g, unknown or other
  misc_feature (426)..(426): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggccggcctccatctcctgcaggtctagtcagagcctcgtacacagtgatgggaacaccgccttgaactggnttcagcagaggccaggccaacctccgaggcgcctaatttataagatttctaaatcgggagttccggggtcccagacagattcagcggcaggtgggtcaggcacgtgatttcacgctagaagancagcgagggtggaggctaggaggtagttggtttgtacggtttattactgtcctgctagagttatctacgtcgggccgttacgggtcgttacggaccgaaacgggcgaagggtaaacggg

SEQ ID NO: 211198 - DNA, 714 bp, Homo sapiens
  misc_feature: GYAE6OF01B5XYS.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggccggcctccatctcctgcaggtctagtcagacgcctcgtacacagtgagtacgggaacaccgtccttgaactggattcagcgagaggccacggaccaaccgtccgaggccgtaccttaaatttacgtaaagtattttactaaacgttccggggtacgtttccccgggggtacccagacgaaggtacttcgaacggcgggctaacgggttgggtaccgaagggtcctaaccgttggtacttttaccgaaccgttcgtaggaaacgtacgttcgaacggtcggtaagggggtacgggaagggtaccgtagggaggggtaagtttgggtttacggttacggtttttagttaccgttggtacccgttggacgtacggttaacgttacgtttaccggtacggttcgggtacccggggttacggggtacccggtttaccgggggaaccccgtaaacgggggtaacccggtaaagggggttaaacggg

SEQ ID NO: 211199 - DNA, 553 bp, Homo sapiens
  misc_feature: GYAE6OF01BVH1R.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgcttgactggattcagcagaggccaggccaacctccggagcgcctaatttataagtactttactaagtcgggtacgttcccggggtacccagacagtattcgagcggcaggtgggtcaggctactgtatttcacgtctaggaagatcagcgagggtggaggctaggaggtagttggttgtcggtttatacgtcgcctgctaggcgttattcgacgtcgggaccgtgggtaccggttcggaccgaaggggaccaaggggtaacgg

SEQ ID NO: 211200 - DNA, 688 bp, Homo sapiens
  misc_feature: GYAE6OF01AQTH3.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagacgcctgtacacagtgatgggaacaccgccttagaactggattcagcagacggccaggccaaccgtccggacggccgaccttaaatttataacgtacttttcgtaaacgtccggggtaacgtttcccggggtacccaaggacctaagtactttacgaggccggacgaggttcggggtacacgggtcaacgttgtaactttccgacgtcgtagaaacgtactacgaggcgtaaggggtggaagggtcgtgggaggtagttggttcggtacggttttaattacgtcgtccgttaggacgtaggtagttacgttccgacgttcgggtacccggttaggggttacccggttaccgggaccggtaaacgggggtaacccgtaaaggggttagggaaaacttacccggaaaaaccggtacgttacggggttacggaccgttacggacctaaccgtgttacccg

SEQ ID NO: 211201 - DNA, 713 bp, Homo sapiens
  misc_feature: GYAE6OF01D14ZW.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggccgcctcatcctcctgcaggtctagtcagacgcctcgtacacagtgatgggaacaccgccttgaactggattcagcagaggccaggccaaccgtccggaggcgaccttaatttaactaagtattttactaaagttccggggtaactttcccggggtacccaaggaccgtaagtaactttacgaggccgggcgtaagggtcgggtacgaagggcctaacgttggtaacttttaccgaacggtaccgttagaaacggtaacttaccggaagggtaccggaagggggttacgggacgggtacgttagggtaagggtaagttaggtttacggttacggttttaacttacgttcggccgttaggacgtagtacgttattaccgtacggttcggtccggtaggtaccggttaccggacccggtaaacgggtaaccggtaaagggtaacggtaaaacgtaaaccggaaaacggtaacgttacggtacggtacgtaccgaccgtaaccgtagttaccg

SEQ ID NO: 211202 - DNA, 602 bp, Homo sapiens
  misc_feature: GYAE6OF01C2SY7.26.26.C04.1.454.CMB.1.raw
tcagagactatactcacgaccggtgctcgatttagtctagcgactttgggtttggggagataaaagctcagctctacccttgccttgactgatcaggactcctcagttcaccttctcacaatgagctccctgctcagctcctgggctgctaatgctctggtcccagggtccagtgggatgttgtgatgactcagtcctccgctctccctgcccgtcaccgttgacaggccgcctcatctcctgcagtcagtcagacgcctcgtacacagtgagtcgggaaccaccgtcttgaactggattcgagcgaggacgccaacggcccaaaccgtccggagccgtaccttaaatttaataacgtatttacgtaaagtccggggtacttccccggggaccagtaacagtacttcgaggcggactaggtggtcagggctacgtgtatttccgacgtctagaagtctcgagtcgagggtgaaggtctaggagtagtgttacgtcgtttagtaccgtcgtccgtacggacgtaaggtacgtacgttcgtaccggtcggtccggttacgggtaccggttacggaccggaaacgggtaccgtaagggtaaacgg

SEQ ID NO: 211203 - DNA, 552 bp, Homo sapiens
  misc_feature: GYAE6OF01BB3GH.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggccggcctccatctcctgcaggtctagtcagagcctcgtacacagtgatgggaacaccgccttgaactggattcagcagagccaggccaacctccgaggcgacctaatttataagtatttactaagtcgggtattccggggtacccagacagattcgagcggcgaggtgggtcaggcacgtgtatttcacgtctagaagatcgagcgagggtggaggctaggaggtattggtttggtacggttttatacgttgcctgcgagtagttattctcgtcggcggtcggtacggttcgggaccgaacgggaccgaagggtaacgg

SEQ ID NO: 211204 - DNA, 719 bp, Homo sapiens
  misc_feature: GYAE6OF01DHHDW.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctccgtggggctgctaatgctctgggtcccagggtccagtggggatgttgtgatgactcagtctccgctctccctgcccgtcacccttggacaggcgcctccatctctgcaggtcagtcagagcctcgtacacagtgatgggaaccaccgtccttagaactggattcgagcagacgaccaggcccaaaccgtccgaggccgaccttaaagtttaataaagtactttactaaagtccgggtaacgttcccggggtacccaaggacctaagactttccgaaggtccgggacgtaagggtcggggtaccgagggacctaaccgttgtaacgttttccgaaccggtcgttaacggaaaggtaacttacgaacggtacgggaggggtacgggtagggaccgttgggaagggttagttagggtttacggttaacggttttacgtttaaccgttcggtacccgtaggaccgtaagggttaacgttactttaccggtaccggttaccggggtcccgggttacgggttacccgggtttaccgggaacccggtaaaacgggggtaacccggtaaaggggttaaaaccggg

SEQ ID NO: 211205 - DNA, 536 bp, Homo sapiens
  misc_feature: GYAE6OF01COJBV.26.26.C04.1.454.CMB.1.raw
  modified_base (392)..(392): a, c, t, g, unknown or other
  misc_feature (392)..(392): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctaagtcagagcctcgtacacagtgatgggaacaccgccttgaactggattcagcagaggccaggccaacctcgaggcgacctaattataagatttctaaagtcggattccggggccagacagatcagcgcgagtggtnaggcactgtatttcacgctagaagatcgagcgagggtggaagcgtagaggtgtgttgtacggtttattaccgtgtacctgtacagtagtattcgtacgtggccgtagggtacgttacggaccgaaacgggtacgaaggtaacgg

SEQ ID NO: 211206 - DNA, 534 bp, Homo sapiens
  misc_feature: GYAE6OF01C562Z.26.26.C04.1.454.CMB.1.raw
  modified_base (419)..(419): a, c, t, g, unknown or other
  misc_feature (419)..(419): n is a, c, g, or t
  modified_base (446)..(446): a, c, t, g, unknown or other
  misc_feature (446)..(446): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgccttgaactggattcagcagagccaggccaacctccgaggcgacctaatttataagatttctaatcgggattccggggtccagacagattcagcggcgaggtgggtcagggcacgtgtatttcacgcttacgaagatcagcgagggtggaggctggagtntgtgacgtatttatactgcctgcagtntattcacgtggccgttggacgttcgggaccgaagggaccaagggtaggtaaataccgaaaagacgtaggtagactcgccaaccgtacg

SEQ ID NO: 211207 - DNA, 657 bp, Homo sapiens
  misc_feature: GYAE6OF01DJN4H.26.26.C04.1.454.CMB.1.raw
  modified_base (260)..(260): a, c, t, g, unknown or other
  misc_feature (260)..(260): n is a, c, g, or t
  modified_base (329)..(329): a, c, t, g, unknown or other
  misc_feature (329)..(329): n is a, c, g, or t
  modified_base (382)..(382): a, c, t, g, unknown or other
  misc_feature (382)..(382): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctcatctcctgcaggtctagtcagacgcctcgtacacagtgagtcgggaaccnccgtccttagaactggacttcgagcaggacggccgacggccaaccgtccgaggccgtacttaaatttanaagtactttacgaagtccgggtacgttcccgggaccagacagtactcgagcgngaggtggtacaggctacgtgtacttcgacgtcgtagaacgtactacgaggacggtaggggtaggacggtcgtaggacggtagttggttggtacgttttagtacgtcgtcgtggacgtaggtacgttacttccgtaacggtcgggtaccgggtacgggttaccggttaccgggaacccggtaaaacggggtaaccggtaaacggggtaaaggtaaaccgttaaccggaaaacggtaacgttcgggtacggtacgtacgaccctaacgtggttaccg

SEQ ID NO: 211208 - DNA, 562 bp, Homo sapiens
  misc_feature: GYAE6OF01EFXWV.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaaccgtccgaggcgtcctaatttataagatttactaagtcgggtacttccggggtcccagacagattcagcggcaggtggtcaggcacgtgatttcgacgtctagaagatcagcgagggtggaggcgtggaggtatggttgtcggttttaattacgtgtcctgacgagtagttagttcacgttcgggccggtcggacggttccggaccgaagggacccgaaggtagggaaactacgaaacgtacgtacggtcggacgtagccactgttaccg

SEQ ID NO: 211209 - DNA, 663 bp, Homo sapiens
  misc_feature: GYAE6OF01BL8E8.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccaggtggggatgttgtgatgactcagtctccgctctccctgcccgtcacccttggacaggcggcctccatctcctgcaggtctagtcagacgcctcgtacacagtgatgggaaccaccgcttagaactggattcgagcaggaggccaggcccaaccgtccgaggccgaccttaatttaataagtattttacgtaagtccggggtacgttcccggggtaccaggaccagtattcgagcggactaggtgggtacagggctacgtagtactttcgacgtctaggaacgtatacgaggcggagggtggaggtctagggaggtattgggttacgtacggttttattacggtcgtccgttaggactaagggtacgttacgtttccgaaccggttcgggtaccggttagggtaacccggttcggggaaccggtaaacggggaacccgtaaaggggttacgaaaacgttacgtaaaaaccgggacggttggtaccgggtaccgtacggaccctaaccgtagttcgtaccg

SEQ ID NO: 211210 - DNA, 549 bp, Homo sapiens
  misc_feature: GYAE6OF01DSBSJ.26.26.C04.1.454.CMB.1.raw
  modified_base (190)..(190): a, c, t, g, unknown or other
  misc_feature (190)..(190): n is a, c, g, or t
  modified_base (546)..(546): a, c, t, g, unknown or other
  misc_feature (546)..(546): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtnacccttggacaggccggcctccatctcctgcaggtctagtcagacgcctcgtacacagtgatgggaacaccgcttgaactggattcagcagaggccaggccaaccgtccgaggccgacctaatttataagtatttctaagtcgggtattccggggtcccagacagattcagcggcaggtgggtcaggcacgtgtatttcacgctagaagatcgagcgagggtggaggctggaggtatgttgtcgtttatactgctgcagtagtattcacgtggtccggtggaccggttccggaccgtaagggaccgtaagggtaaggaaactacgaaaacgtacgtaggtcggactagaccacgtntcg

SEQ ID NO: 211211 - DNA, 714 bp, Homo sapiens
  misc_feature: GYAE6OF01DDJIT.26.26.C04.1.454.CMB.1.raw
tcagagactatactcacgaccggtgctcgatttagtctagcgactttgggtttggggactgatcaggactcctcagttcaccttctcacaatgaggctccctgctcagctcctggggctgctaatgctctgggtcccaggtacagtggggatgttgtgatgactcagtctccgctctccctgcccgtcacccttggacaggcgcctccatctcctgcaggtctagtcagacgcctcgtacacagtgagtagggaaccaccggtccttagaacgtaggtattcgagcaggacggcccaacgggacccaacccgtccggacggaccgtaccgttaaattttaataaacgtattttacgtaaacgtccgggtacgtttccccggggtacccaaggacgtaagtaacttcgaacggtcggacgtaggtgggtacgaggccacgtgttacgttcgacgtcgtaagaagtactacgaggtacggtaaggggtacgggaggtacggtagggtaggtagttagggtttcggtttaacggttttaacgttacgttccgtccgtagtaccgtaaggttaagttacgttaccgtacggtcgggtccggtacgggttaccggttaccgggaaccggtaaacgggaaccgggtaaagggtaaacgtaaacggtaacgtaaacggtacgttacgggtcggtacgtacggaccctacgtacgtttccgg

SEQ ID NO: 211212 - DNA, 588 bp, Homo sapiens
  misc_feature: GYAE6OF01CUMC1.26.26.C04.1.454.CMB.1.raw
  modified_base (279)..(279): a, c, t, g, unknown or other
  misc_feature (279)..(279): n is a, c, g, or t
tcagagactatactcacgaccggtgctcgatttagtctagcgactttgggtttggggtgatcaggactcctcagttcaccttctcacaatgaggctccctgctcagctcctgggctgctaatgctctgggtcccagggtccagtggggatgttgtgatgactcagtctccgctctccctgccccgtcacccttggacaggccggcctccatctcctgcaggtctagtcagagcctcgtacacagtgatgggaacaccgccttgaactggattcagcagnggccaggccaacctccgaggccgccctaaatttataaagtattttactaagtcgggattcccggggtcccagacagattcagcggcagtgggtcaggcactgatttcacgctagaagatcagcgagggtggaggctaggaggtagttgttgtcggttttaagttactcgtccctgctaaggagttaacgttccacgttggacccggttggtaccggtttacggacccgtaaacgggtaccgaaagggtaggaaacttacggaaaaccggtacgtaggtacggtccgtagaccaacctagtccgttacgg

SEQ ID NO: 211213 - DNA, 581 bp, Homo sapiens
  misc_feature: GYAE6OF01AJ9DD.26.26.C04.1.454.CMB.1.raw
  modified_base (406)..(406): a, c, t, g, unknown or other
  misc_feature (406)..(406): n is a, c, g, or t
  modified_base (575)..(575): a, c, t, g, unknown or other
  misc_feature (575)..(575): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtacagtggggatgttgtgatgactcagtctccgctctccctgcccgtcacccttggacaggcggcctccatctcctgcaggtctagtcagagcctcgtacacagtgatgggaacaccgccttgaactggattcagcagagccaggccaacctccgaggcgcctaatttataagtatttctaagtcgggtatttcccggggtacccagacagtattcagcggcaggtggtcaggcacgtgatttcagctagagatcagcgagggnggaggctggaggtagtggtttggtacggttttattacgtcgtccgtggactaggtagttagttaccacggttcggtaccggtcgggtacggttccgggaccgaacggggtaaccgtaacgggtaggaaacgtacgaaacggtaacgttcggtcggactagccaaccgtnttaccg

SEQ ID NO: 211214 - DNA, 540 bp, Homo sapiens
  misc_feature: GYAE6OF01A22NB.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggcaacctccgaggcgcctaatttataagatttctaatcgggattccggggtcccagacagacttcagcggcaggtggtcaggcactgatttcacgctgaagatcagcagggtggaggctggaggatggtttgcggtttattacgtgtcctgcagtagttattcgactgggccgttggacggttcggccgtaaaggggaccgtaaagggtaggaaagttcgaaaccgaacgttggtaggctaggcaccagtccg

SEQ ID NO: 211215 - DNA, 533 bp, Homo sapiens
  misc_feature: GYAE6OF01A6D5I.26.26.C04.1.454.CMB.1.raw
  modified_base (528)..(528): a, c, t, g, unknown or other
  misc_feature (528)..(528): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtatagtcagacgcctcgtacacagtgatgggaacaccgccttgaactggattcagcagagccaggccaacctccgaggcgacctaattataagatttctaatcggattccgggccagacagatcagcgcagtggtcaggcatgatttcgacgctgaagatcgagcgagggtaggaggcgtggaggagttggttcgtcggttttatacgtgcgtgcgagtagttattcgacgttgggccgttggacggttccggacgacggtacgaagggttagaaagtcgaaacgacgtgtacggctagcctacngttcg

SEQ ID NO: 211216 - DNA, 627 bp, Homo sapiens
  misc_feature: GYAE6OF01C0OVH.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcaccctggacaggcggcctccatctcctgcaggtctagtcagagcctcgtacacagtgatgggaacaccgtccttgaactggattcagcagacgccaggcccaaccgtccggaggccgtaccttaaatttataaagtacttttacgtaaagttcgggacgtttcccgggggtcccaagacgagtacttccgaggccggacgaggtcgggtcgaggctacgtgtactttcgacgcgtagaagatcgaggcgaggggtgggaggtctaggagggtattggtttcggttacgggttttattacgtcgtccgtggacgtaaggtacgttattacggtaccggttcgggtcccgggttagggtacccggtttaccgggaccggaaacgggggtaaccgtaaaggggtaaacgg

SEQ ID NO: 211217 - DNA, 637 bp, Homo sapiens
  misc_feature: GYAE6OF01CQ0AI.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacaggtgagtgggaacaccgccttgaactggattcagcagagccacggccaaccctccggaggccgaccttaatttaagtaagtatttctaagtcgggattcccggggtccagacagtattcgagcggcgaggtgggtcgacggcacgtgtatttcacgctagaagatcgagcgaggggtggagggtctagggaagggtagttgggtttcggtacggtttttacttacgttcggtaccgttggacgtaagggtaacggttagtttacccgtaacggttccggggtacccgggtttcggggtaacccgggttttccggggaaccccgggtaaacgggggtaacccggtaaagggggttaaaacggg

SEQ ID NO: 211218 - DNA, 684 bp, Homo sapiens
  misc_feature: GYAE6OF01CIJUN.26.26.C04.1.454.CMB.1.raw
  modified_base (417)..(417): a, c, t, g, unknown or other
  misc_feature (417)..(417): n is a, c, g, or t
tcagagactatactcacgaccggtgctcgatttagtctagcgactttgggtttggggtgatcaggactcctcagttcaccttctcacaatgaggctccctgctcagctccgtgggctgctaatgctctgggtcccagggtccaggtgggatgttgtgatgactcagtcctccgctctccctcgcccgtcacccgtggacaggccgcctcatcctcctgctaggtctagtcagacgtcctacgtacacgtagtgaagtcgggaaacctaccggtccttaggaaccgttggtacttcgaggccgaggaccggccgaacggaccccaaccgtccggacggtccgtaaccttaaatttaacgtaagtactttacgtaaacgttccgggtacgttcccgggaccagacgagtatcgaggcgngaggtcggcaggctagtggttacttcgacgtctaggtaacgtatacgacggacgggagggtcggaggtcgtaggaggtagttggttagtacggttttactacgtcgtccgtaggactaggttagttacgttaccgacggtcggtccggtacgggtaacccggttaccggaaaccgggtacggtaaccggtaaagggtacggtaaaactaaccggtaaacggtacgttacgggtacgccgtaacgacccgtaactgtttccgttaccg

SEQ ID NO: 211219 - DNA, 563 bp, Homo sapiens
  misc_feature: GYAE6OF01CS0OK.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagtatttctaatcgggtattccggggtccagacagattcagcggacaggtgggtcagggcacgtgactttcacgtctaggaagtatcgagcgaggggtggaggcgtgaggagtggttgtcggttttattacgtgccgtgctaggtagttattcacgttcggccggttggtaccggttcgggaccgtaagggaccgaagggtaggaaagtaccgaaacgtacgtaggtacggctagactaccgagttccg

SEQ ID NO: 211220 - DNA, 603 bp, Homo sapiens
  misc_feature: GYAE6OF01DQ8MG.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaaccaccgccttgaactggatcagcagaggccaggccaaccgtcgacggcgccttaaatttataagtatttactaagtcgggattcccggggtccagacagattcagcggcaggtggtcacggcacgtggtatttccgacgtctagaagatacaggcgagggtgggaggtcgtaggaggtattggttacggttcggttttaatttacgtggtcctggactaggagttattcgacgtgggtccggtagggtaccggttcgggacccgtaaacggggaaccgtaaggggttaggaaaacgtaaccggaaaacgtaaacgttggtacgggacttacggacctaccgtagttccg

SEQ ID NO: 211221 - DNA, 665 bp, Homo sapiens
  misc_feature: GYAE6OF01B2T1C.26.26.C04.1.454.CMB.1.raw
  modified_base (246)..(246): a, c, t, g, unknown or other
  misc_feature (246)..(246): n is a, c, g, or t
  modified_base (657)..(657): a, c, t, g, unknown or other
  misc_feature (657)..(657): n is a, c, g, or t
tcagagactatactcacgaccggtgctcgatttagtctagcgactttgggtttggggtgatcaggactcctcagttcaccttctcacaatgaggctccctgctcagctcctggggctgctaatgctcgtgggtcccagggtccagtggggatgttgtgatgactcagtctccgctctccctgcccgtcacccttggacaggccggcctccatcctcctgcaggtctagtcagacgcctcgtacacngtgatagggaaccaccgtccttgaactggattcagcagacggccacgggaccctaaaccgtccggagggcccgtaccctttaaagttttaactaaaggtactttttaccgtaaaaggttccggggtaacgtttccccgggggtacccaaggaaccaggtaacttcgaaggcggtcaggtcgggtcaagggcctaacgtgtatttaccgacgtctagaagatccgaagtcggaggggtggagtcgtggaggtagttggttacggttcgttttaattacgtgtccgtggacgtagttaacgttcttacgacgttcgggtccggtacgggtacggttccggaccggaaacgggtaaccgtaagggtacgtaaagtacgaaacggtaacgttggtacgcgttacgacctaacgtnttcgtacg

SEQ ID NO: 211222 - DNA, 638 bp, Homo sapiens
  misc_feature: GYAE6OF01E4HBZ.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccaggtggggatgttgtgatgactcagtctccgctctccctgcccgtcacccttggacaggccggcctccatctcctgcaggtctagtcagacgcctcgtacacagtgagtggaaccaccgtccttgaactggattcagcagacggccacggccaaccgtccgaggccgaccttaatttaataagtattttcgtaagtcgggtacgttccggggtccagacagtattcgaggcggcgaggtgggtacaggctactggtaatttcgacgtctagaacgatcgagcgagggtaggagggtctggaaggtagttggtttgtacggttttattaccgtcggtcctggacgtaggtagttacgttccgtacgttcgggtacccggttagggtacccggtttcgggaaccggtaaacgggaaccgtaaaggggtaacggaaactacggaaaaccggtaacgttgggtacgggtcctacggaccctaaccctagttccgttacgg

SEQ ID NO: 211223 - DNA, 552 bp, Homo sapiens
  misc_feature: GYAE6OF01DLIB1.26.26.C04.1.454.CMB.1.raw
  modified_base (213)..(213): a, c, t, g, unknown or other
  misc_feature (213)..(213): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctcatcncctgcaggtctagtcagagcctcgtacacagtgatgggaacaccgccttgaactggattcagcagaggccaggccaacctccgaggcgcctaatttataagatttctaatcgggattccggggtccagacagatcagcgcagtggtcaggcactgactttcacgtctagaagatcgagcgagggtggaggctaggaggatgttgcggttttatacgtgcctgcagtagtaattcacgttcggccggtggtaccgttcggaccgtaaggggaaccgaacgggtaaggaaactacgtaaaacgaaacgttaggtacgggtattacgccaacctagttaccg

SEQ ID NO: 211224 - DNA, 788 bp, Homo sapiens
  misc_feature: GYAE6OF01CT5PR.26.26.C04.1.454.CMB.1.raw
  modified_base (285)..(285): a, c, t, g, unknown or other
  misc_feature (285)..(285): n is a, c, g, or t
tcagagactatactcacgaccggtgctcgatttagtctagcgactttgggtttgggggagataaaagctcagctctacccttgccttgactgatcaggactcctcagttcaccttctcacaatgaggctcctgctcagctcctgggctgctaatgctctggtcccagggtccagtgggatgttgtgatgactcagtctccgctctcctcgcccgtcacccgttggacaggcggcctcatctcctgcaggtctagtcagagcctcgtacacagtgatagggaaccnccgtccgttagaacctggaacttcgaggcgaacggacggcccaaggacccaaccgtccggaacgggtcctaccctttaaattttaagttaaacggttaacttttacgtaaacgttacggggtaaccgtttacccgggggtacccaaagggaaccgtaaggtaacgtttaccgaggaccgggtacgtacgggttacggggtaccgaaggggtccctaacggttcgttaacgtttccgaacggtaccgttaggaaacgtacttaccggaacggtacggtaaggggggttcgggaaacggtccggttaagggtaacggggttagttacgggttttacggtaaccgggttttttaagttacccggtacggtcccggttaggtaccggtaaggtttaacggtttaacttaccggtaccggttccgggggtacccggttacgggttaacccgggtttaccgggaaccccgggtaaaacgggggtaacccgtaaaggggttaaacccggg

SEQ ID NO: 211225 - DNA, 580 bp, Homo sapiens
  misc_feature: GYAE6OF01CBP1W.26.26.C04.1.454.CMB.1.raw
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
  modified_base (559)..(559): a, c, t, g, unknown or other
  misc_feature (559)..(559): n is a, c, g, or t
  modified_base (567)..(567): a, c, t, g, unknown or other
  misc_feature (567)..(567): n is a, c, g, or t
  modified_base (576)..(576): a, c, t, g, unknown or other
  misc_feature (576)..(576): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtaacacagtgatgggaacaccgccttgaactggattcagcagaggccaggccaaccgtccgaggcgcctaatttactaagtatttacgtaagtcgggacgttccggggtccaagacgagtattcagcggcgtaggtggtcgaggctacgtgtattcacgngtagaagntacagcgagggtggaggtcgtaggaggtattggttaggttacggttttaagttacgtgtccgtgacgtagtacgttacttcgtacggtcggtcggtacggtaccggttcggaccgaagggacgtaaagggtaggaaactacgaaacgtaacnggtacggntacgcacgnttcg

SEQ ID NO: 211226 - DNA, 765 bp, Homo sapiens
  misc_feature: GYAE6OF01BOTON.26.26.C04.1.454.CMB.1.raw
tcagagactatactccacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtcctccgctctccctcgcccgtcacccgttggacaggccgcctccatcctcctgcaggtctagtcagacgcctcgtacacgagtgagtacgggaaccaccgtccgttagaaccgtggtactttcgagcaaggacggccgacggtacccaacccgtccggacggccgtaccttaaatttagtaaagtactttactaagtcgggtacgttcccggggtacccagacgagtacttcgacggcggtacgtagggtcgggtacgacgggactacgttggtactttaccgaccggtcgtaaggaacgtagttaccgacggtacggtacgggggtagggacgggtacgttagggaacgggttaagttgggtttacgggttacggtttttaactttaccggtcggtcccgttaggacgtaagggttaacggtttacgttaccgtaacgggtcgggttcccgggttaacgggttacccggggtttcccggaaaccggtaaacggggtaacccgtaaaggggttaacgggtaaaacttaaccggaaaaccggttaaacggttagggtaccgggttactacggtaccctaccgttacgttacccgg

SEQ ID NO: 211227 - DNA, 556 bp, Homo sapiens
  misc_feature: GYAE6OF01CLKQU.26.26.C04.1.454.CMB.1.raw
  modified_base (418)..(418): a, c, t, g, unknown or other
  misc_feature (418)..(418): n is a, c, g, or t
  modified_base (549)..(549): a, c, t, g, unknown or other
  misc_feature (549)..(549): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggccgccttaaatttataagtattttactaagtcgggtattccggggcccaagacagattcagcggcagtgggtcaggcactgtatttcgacgtctagaagatcgagcgagggtggaggcgngaggtgttgttgtggtttaattacgtgtcgtgcaagagttattcacgtggccgttgggaccgttcggaccgaacgggacctaagggtacgaaatacgaaaacggacgttaggcggtactacgaccaccgtntcgttcg

SEQ ID NO: 211228 - DNA, 605 bp, Homo sapiens
  misc_feature: GYAE6OF01CFQ44.26.26.C04.1.454.CMB.1.raw
  modified_base (410)..(410): a, c, t, g, unknown or other
  misc_feature (410)..(410): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcaccttggacaggcgcctcatctcctgcaggtctagtcagacgcctcgtacacagtgagtgggaaccaccgccttgacgtggattcagcaggacgccgaggcccaaccgtccggaggcctaccttaaatttaataaagtatttacgtaagtccgggtacgttcccggggaccagacagtattcgaggcggngaggtcggtcgaggctacgtgtacttcgacgctagaagatcgagcgtagggtggaggtcgtaggaggtgttggttcggttacggttttacgtcgttacgtccgttaggacgaggtagttattcgtacggtcgggtaccggttcgggtaccggttacgggacccggaaacggggtaccgtaaaggggtaaaccggg

SEQ ID NO: 211229 - DNA, 657 bp, Homo sapiens
  misc_feature: GYAE6OF01B738D.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggccggcctccatctcctgcaggtctagtcagcgcctcgtacacagtgatgggaacaccgtccttagaactggattcagcagacggcacggccaacccgtccgaggccgtaccgttaactttataagtatttactaagttcgggtacgttcccgggtaccagacagtacttacgagcggacaggtcgggtacaggctagtagtactttacgacgtctagaagtactacgaggtcgaagggtggaaggcgtagaggtagttggttacggttcggttttattacgtgcgtggatagtagttacttcgtacgttacgggtccggttagggtaccgggtttaccggaaccggtaaacggggtaaacccggaaaggggttaacggaaaacggttaaccgaaaaacggtaaaccgttagggttacgggtaccgtacggacctaacccgtagttttaacccgg

SEQ ID NO: 211230 - DNA, 666 bp, Homo sapiens
  misc_feature: GYAE6OF01CX8YJ.26.26.C04.1.454.CMB.1.raw
  modified_base (343)..(343): a, c, t, g, unknown or other
  misc_feature (343)..(343): n is a, c, g, or t
tcagagactatactcacgaccggtgctcgatttagtctagcgactttgggtttggggtgatcaggactcctcagttcaccttctcacaatgaggctccctgctcagctccgtggggctgctaatgctcgtgggtccagggtccaggtggggatgttgtgatgactcagtctccgctcctccctcgcccgtcacccgttggacgacggccggcctccatcctcctgcgtacggttctagtcgacgacgccgttacgaacacgagtgaagtacgggaaccaccgtcgttagaacgtggattcagcagacgccgacggaccaccgtcgacgcgtacctaatttaanaagtacttacgtaacgtcggtacgttccgggaccagacagtatcgagcggacgtggtacggtcgacggtcacgtgtactttcgacgtcgtaggaagtatacgagtacgggtaaggggtcggaaggtccggtaaggaagggtacgtttgggttacgttacggttttactcgtacggtccgtgtacgtaggagttacgtcgtaaccggttcggtccggtaggtcccggtacgggaaccggaaaccgggtaaacgtaacgggtaacgtaaacggaacgtaaacgtacggtagtcggacgtacgaccctaaccgtgtccgttaccgg

SEQ ID NO: 211231 - DNA, 619 bp, Homo sapiens
  misc_feature: GYAE6OF01ELZXC.26.26.C04.1.454.CMB.1.raw
  modified_base (201)..(201): a, c, t, g, unknown or other
  misc_feature (201)..(201): n is a, c, g, or t
  modified_base (382)..(382): a, c, t, g, unknown or other
  misc_feature (382)..(382): n is a, c, g, or t
tcagagactatactcacgaccggtgctcgatttagtctagcgactttgggtttgggggactgatcaggactcctcagttcacctcctcacaatgaggctccctgctcagctcctggggctgctaatgctctgggtcccagggtccagtggggatgttgtgatgactcggtctccgctctccctgcccgtcacccttggacnggcgcctccatctcctgcaggtctagtcagacgcctcgtacacgagtgagtggaacaccgccttagaactggattcagacgagaggccgacggcccaaccgtccgaggccgaccttaatttaataagtattttactaagtcgggtacgttacccggggtcccagacagacttcgaggcggngtaggtgggtcgaggcacgtcgtatttcgacgctagaagatacgagcgtagggtaggaggcgtggaggtagttggttagttacggttttatacgttcgtcctgcgaaggtagttagttacgtacgtgggtccggttacggtacgggtaccggtaccggaaaccggggtaacgaaagggtacggtaaactaacggtaaacggtaacgtggtacgtacgtacgactacaagtcgttacg

SEQ ID NO: 211232 - DNA, 596 bp, Homo sapiens
  misc_feature: GYAE6OF01BKFPV.26.26.C04.1.454.CMB.1.raw
  modified_base (363)..(363): a, c, t, g, unknown or other
  misc_feature (363)..(363): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgagtgggaacaccgcttgaactggattcagcagaggccaggccaacctccgaggccgaccttaatttataagtatttacgtaagtcgggtacttcccggggtccagacagattcagcggnaggtgggtcaggctacgtgtatttcacgctagaagatcgagcgagggtggaggcgtaggagtagttggttggtacggtttatacgtcgtccgtgcgtaaggtacgtacttcgacgttcgggccggttacggtaccggtttaccggaaccgaaacggggaacccgtaaagggtacggaaaagtaccgaaaaccggtacgtggacggtcctacgaccctacgtagttccgttacg

SEQ ID NO: 211233 - DNA, 715 bp, Homo sapiens
  misc_feature: GYAE6OF01EAGO3.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagcctccgtggggctgctaatgctcgtcgggtcccagggtccaggtggggatgttgtgatgactcagtctccgctcctccctcgcccgtcacccgttggacgacgggccgcctccatcctcctgcgaggtctagtcaggacgcctacgtaacacgaggtgagtacggggaaccaccgtaccgttagaacgtggtacttacgagacgacggacggaccgaacggaccccaaaccggtccggaacggtaccgtaacctttaaagtttaagtaaacgttactttaacgtaacggttacgggtaccggttacccggggtaccagtaacgagtacttcgaggcggacgtagggtcgggtcgacgggtctaacgttcgtaacgtttaccgacgtacgtaggaaacgtatccgaaggtcggtaaggggtcgggaacggtcgtaagggtagggttagtttggtttacggttacgtttactacggtcgtaccgttgacgttaggtacgtttactcgtacggttcgggtccgggttacggtaccgggttaccggaaccggtaaacgggtaccgtaaagggtaaaccgg

SEQ ID NO: 211234 - DNA, 664 bp, Homo sapiens
  misc_feature: GYAE6OF01C9DHT.26.26.C04.1.454.CMB.1.raw
tcagagactatactcacgaccggtgctcgatttagtctagcgactttgggtttggggtgatcaggactcctcagttcaccttctcacaatgaggctccctgctcagctcctgggctgctaatgctctgggtcccagggtccagtggggatgttgtgatgactcagtctccgctctccctgcccgtcacccttggacaggccggccctcatcctcctgcgtaggtctagtcagacgcctcgtacacgagtgagtacgggaaccaccgtccttagaacgtggtattcagcgagacggccacggacccaaccgtcggaggccgaccttaatttagtaagtactttacgtaagtcgggtacgttcccgggtaccagacagtacttcgacggcggcgtaggtcgggtacagggctacgtgtactttccgacgtcgtaagaagacgtacgaggacgggtaaggggtagggacggtacgtagggagggtagttggtttacggttacggttttaacgttacgtcgtaccgtagcgtaaggtagttacgttcgacggttcgggtccggtacggtaccggttaccgggaaccgaaacgggtaccgtaaggggtaacgaaacgtaacgaaaacggtacgttggacggtacctacgacctaccgtgttccgttacg

SEQ ID NO: 211235 - DNA, 565 bp, Homo sapiens
  misc_feature: GYAE6OF01EPUKO.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgccttgaactggattcagcagaggccaggccaacctccgaggcgacctaatttataagtatttctaatcgggtagttccgggtcccagacagattcgagcggcaggtggtcaggcacgtgtactttcacgtctagaagatcaggcgaggggtggaggcgtaggaggtagttggttggtcggttttattacgtgtccgtgactagtagttattcgacgtcgggccgtgggtaccgttcggaccgaaggggtaccgaaagggtaggaaataccgaaacgtactcggtacggcgtaggacctacgtatcg

SEQ ID NO: 211236 - DNA, 604 bp, Homo sapiens
  misc_feature: GYAE6OF01ATROB.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagccctcgtacacagtgatgggaacaccgccttgaactggattcagcagaggccaggccaacctccgaggcgcctaatttataagatttctaatcgggacttccggggtcccagacagacttcgagcggcaggtgggtcaggcacgtgtactttcgacgtctagaagatcgaggcgaggggtggaggtcgtggaggtagtggtttaggtcggtttattacgtcgtcctgactagtagttacttcgacgttcgggtaccggtcgggtaccgttccggggaccgtaaacggggtacccggtaaagggtaggaaacgtaaccgtaaaaccggtaacgttgggtacggtacgtaggccctaacccgtacttcccgg

SEQ ID NO: 211237 - DNA, 509 bp, Homo sapiens
  misc_feature: GYAE6OF01ETJSX.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaattataagatttctaatcgggattccggggtcccagacagattcagcggcagtgggcaggcactgatttcacgctgaagatcgagcgagggtggaggctaggaggatgttgcgtttattactgcctgcagtagtattcacgtggccgtggacgttcggacgaagggaccaaggtgaaatcaaacgactggtgctgacacatctcg

SEQ ID NO: 211238 - DNA, 866 bp, Homo sapiens
  misc_feature: GYAE6OF01B5HUJ.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagacgcctcgtacacagtgatgggaacaccgccttgaactggattcagcagagccaggccaacctcgaggccgaccttaatttataagtattttacgtaaagttcggggtaacgtttcccgggggtacccaaggtaacaaggtaactttcgaaggtccggtacgagggttcggggtaccacggggtacctaacgttggtaacttttaccgaccggtacgttaggaaaacggttacgtaccgtaagggtacccggtaaaggggggttacgggtaacgggtaccggttaggggtaaaggggttaacggtttaggggttttacggttaccggggttttttaaacgtttaaccggttacgggttccccgtttaagggaccgttaaagggtaacggttttaaaccgtttacccggtaaacgggtttccgggggtacccgggtttaccgggggttaaaccccggggttttacccgggggaaaccccgggtaaaaaaccgggggggtaaccccggttaaaaggggggttaaaccgggtaaaaaaccggtttaaacccggtaaaaaacccgggtaaccggtttacgggttaccggggtaccgttaacccgggaacccttaaaccccggtaagttttaaccccggg

SEQ ID NO: 211239 - DNA, 709 bp, Homo sapiens
  misc_feature: GYAE6OF01DK8UN.26.26.C04.1.454.CMB.1.raw
  modified_base (215)..(215): a, c, t, g, unknown or other
  misc_feature (215)..(215): n is a, c, g, or t
  modified_base (451)..(451): a, c, t, g, unknown or other
  misc_feature (451)..(451): n is a, c, g, or t
tcagagactatactcacgaccggtgctcgatttagtctagcgactttgggtttgggggactgatcaggactcctcagttcaccttctcacaatgaggctccctgctcagctccgtggggctgctaatgctcgtgggtcccagggtccagtgggatgttgtgatgactcagtctccgctctccctgcccgtcaccgttggacaggccgcctcatcnctgcaggtctagtcagacgcctacgtacacgtagtgagtacggaaccaccgtcttagaacgtggtattacgacgacgaggacggccgacggacctaacccgtaccggaggaccgtaccttaaagtttacaagttacttacgtaacggtcggacgttacccgggtaccagtaacagtacttcgaacgcggacgtaggtggacaggacacgtacgtacttcgacgttcaaggtaaacntaccgaggacggtagggtacggacgggtgtagggtaggtacgttggtttacggtacggtttttacgtacgtacggtccgagtaccgtaggttagtaccgtttacgacggttccgggtaccgggtacggttaaccgggttacccggaaacgggtaaaccgggtaacggtaaaccggggtaaagttaaaaccggtaaaccggtaaaacggttaccgttacgggtacgggtaccttaacgacccgtaaaccgttgttaccg

SEQ ID NO: 211240 - DNA, 779 bp, Homo sapiens
  misc_feature: GYAE6OF01CC35R.26.26.C04.1.454.CMB.1.raw
  modified_base (284)..(284): a, c, t, g, unknown or other
  misc_feature (284)..(284): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctcgtcgggtcccagggtccaggtggggatgttgtgatgactcagtcctccgctcctccctcgcccgtcacccttggactggccgcctccatcctctgacaggttatagtcaagacgcctcgtaacncgagtgacgtagggaacctccggccttaggacctggtaattccgaagcgaggacggtacccgacggaccccaaccgtccggacggtaccctaacctttaaatttaacgtaaacgttactttaaccgttaaacggttccgggtaaccggtttccccgggggaacccttaaggaaccgtaacggtacgtttaccggaaccgggtccgggtaaccggttacgggttccggggttaccgacgggaaccccttaaggttacgttaaaccgttttccgaaacggttcgtaaaggttaacgtaacggttacgaacggtacgggtacggggttagggaaccggtggttaacgggagggttagttaccgggtttggttacggttttacgttccctgggtcccgttagagtaaggtactttaagttacccgagggttcccggtacggttaccgggtaccggttaccgggaacccggaaacgggtaacccggtaagggtaaaacgg

SEQ ID NO: 211241 - DNA, 499 bp, Homo sapiens
  misc_feature: GYAE6OF01AHAS9.26.26.C04.1.454.CMB.1.raw
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
tcagagactatactcacgaccggtgctcgatttagtctagcgactttgggtttggggtgatcaggactcctcagttcaccttctcacaatgaggctccctgctcagctcctggggctgccaatgctctgggtcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatcccctaagatcctaatctctcaggcgtctggtttggaaagtggggtcccatcaaggttcagtggcgcggatctgggacagaattcactctcaccatcagcgggctccagtctgaggactctgcaactttattactgaccaacaatatgattatttattctccagcgttcggccgagggaccaggtgaagtcgaagcgaactgnggcncgcacatctgtcttac

SEQ ID NO: 211242 - DNA, 705 bp, Homo sapiens
  misc_feature: GYAE6OF01DE17P.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctctccctgcccgtcacccttggacaggccgcctccatcctcctgctaggtctagtcagacgcctacgtacacgaggtgagtacggggaaaccacccggtcctttaggaaaccgttggatttaccgagcgaggacggccaacgggacccaaccgtccggaggccgtaccttaaattttaataagtaacttttacgtaaaggtcgggtaacgttcccggggtaccaagacctagtattacgaggcggacgtaggtgggtacagggtacacgttaggtactttcgacgtctaggaacgtatacgaagggtcgaggggtaggagggtcgtagggagtagttggttaggttacggtttttactacgtgcctagacgtaggtattagttcgacgttcgggtaccggttagggtacccggttacgggaaccggtaacggggaaacccgtaaaggggtaaggaaaccgttaaacggaaaacccggtaacggttacgggtacgggtacctaggtaacccaacccgttgtttacccgg

SEQ ID NO: 211243 - DNA, 831 bp, Homo sapiens
  misc_feature: GYAE6OF01DWHSW.26.26.C04.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (807)..(807): a, c, t, g, unknown or other
  misc_feature (807)..(807): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctcgtgggtcccagggtacaggtggggattggttgtgatgactcagtctccgctcctccctgcccgtctacccgtggacaggccggcctccatcctcctgcnggtcagtcagacnccgtacgacagaggtgacgtacgggaaccacccgtaccttaggaaacgtcggtattaccgaagacgaaggaaccggcccgaaccggaccccgtaaaacccggcggtaaccgggacctttaaacccgtttaaagtttaaacgtaaacggtttaacttttaacggttaaaacggttccggggttaaaccggtttaccccgggggtaacctaaacgggtaaacctacggttaactttcccggaacgggtaacccgggtacggtaaacggggttcggggtacccgaacggggttaccaaaccggtttacgttaacgttttacccgaaccggggtaagtaacgggtaaaagtaccgttacggaaacgggtaaccgggtaaggggggtttcgggaacggttaggtaaggggtaagttaccggtttagggttcggtttaaacgttttcgttaacgtcgaccgtttagaccgtaagtttaccgtagttccgtagtcgggtcggtaacggtacggtaccggaaacgaaccgggtacggaaaggaagtaacgtaaccgaaacggttagcgggtancgtaacggtccaacgtgtttaccg

SEQ ID NO: 211244 - DNA, 661 bp, Homo sapiens
  misc_feature: GYAE6OF01B5QP8.26.26.C04.1.454.CMB.1.raw
  modified_base (261)..(261): a, c, t, g, unknown or other
  misc_feature (261)..(261): n is a, c, g, or t
tcagagactatactcacgaccggtgctcgatttagtctagcgactttgggtttggggtgatcaggactcctcagttcaccttctcacaatgaggctcctgctcagctccgtgggctgctaatgctctcgggtcccagggtccaggtggggatgttgtgatgactcagtctccgctctccctgcccgtacacccttggacacggcgcctccatctcctgcaggtctagtcagacgccttcgtacacacgtgagtcgggaacnccgccttgaactggacttcagacgacgacggccgacggtaccccaaccgtccggacggaccgtaccttaacgtttaagtaaagtacttttaccgtaacgtcgggtacgttcccggggtaccagacgagtagttcaggccggtgtaggtcgggtacacgggtccacgtcgtatttaccgaacgtctaggaacgtagtcgaaggtcggtagggtcggtaagggctaggaggtagttggttagtacggtttattacgtcgtaccgtgtacgaagtagttacgttacgacgttcgggtccggtaggtaccggttccggaaccggaaacgggtaaccgaagggtacggaaacttaacggaaaacggtacgtaggttacggcttacggacaccgtagttcgttacg

SEQ ID NO: 211245 - DNA, 710 bp, Homo sapiens
  misc_feature: GYAE6OF01DX3Q1.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctcctccctgcccgtcacccttggacaggccggcctccatcctcctgcaggtctagtcagacgcctcgtaacacagtgagtgggaaccaccgtccttagaacgtggtattacagcaggacggaccgacggacccaaccgtccggacggccgtaccttaatttaagtaagttactttacgtaacgttcgggtacgttcccggggtacccagacagtacgtacgacggcggacgtaggtcgggacgaggctacgtagtactttaccgacggtcgtagaaacgtacgtacgaggtcggaggggtagggacgggtacggtagggaacggttgtttagggtttggtttacggtttaacgttcgtcggttccgtaggtacgtaagtaggttacttaccgtacggttcgggtccggttacgggtaccgggttaccgggaaaccggtaacgggtaaacccggtaagggttaacggaaaacgttaaccgaaaccggttaacgttacgggttacggacgttaccgacccttacgtacgttaccg

SEQ ID NO: 211246 - DNA, 535 bp, Homo sapiens
  misc_feature: GYAE6OF01CVK4C.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcggattccggggtccagacagattcagcggcagtggtcaggcactgatttcacgctagaagatcagcgagggtggaggcgtgaggagtgttgcggttttatcgtgcctgcagagtattcacgttggccgtggtaccggttcggaccgaaggggaccaaagggttggaaaactacgaaaacgtaagtaggtcggactgaccacctgttccg

SEQ ID NO: 211247 - DNA, 842 bp, Homo sapiens
  misc_feature: GYAE6OF01ALA3X.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccaggtggggatgttgtgatgactcagtctccgctctccctgcccgtcaccgttggacaggccggcctccatcctcctgcaggtctagtcgagagcctcgtacacagtggagtcgggaaaccaccggtccttagaaccgtggtaactttcgaagccgaaggacgggtcccgaacgggaccccaaaacccgttcccgggaacgggtacccggtaaccttttaaaagttttaacttaaaacgtaacgtttttaccgtaaacggtttccgggggtaaccggttttccccggggggttacccccaaaggtaacccggtaaggttaacgtttaccggaacgggcccgggtacgtacggggttcgggggtaccgtaaccggggtaccgttaacgttacggttaccgttttacccgaaccgggtaccgttaaacgggtaacgtaacgttaccgaacggggtaccggtacggggggttacgggaacggggtaccgttagggaacgggttagtttaggttcgggtttaccgggtttttaacgttaccggttcgtaccgttacggacgtaaggttacggtttacgttacccgtcgggttacgggtacccggttacggggttacccgggtttacccggggaacccggtaaccggggtaaaccggtaggggttaaaaccgg

SEQ ID NO: 211248 - DNA, 537 bp, Homo sapiens
  misc_feature: GYAE6OF01B0K05.26.26.C04.1.454.CMB.1.raw
  modified_base (200)..(200): a, c, t, g, unknown or other
  misc_feature (200)..(200): n is a, c, g, or t
  modified_base (531)..(531): a, c, t, g, unknown or other
  misc_feature (531)..(531): n is a, c, g, or t
tcagagactatactcacgaccggtgctcgatttagtctagcgactttgggtttgggggactgatcaggactcctcagttcaccttctcacaatgaggctccctgctcagctcctgggctgctaatgctctgggtcccagggtacagtggggatgttgtgatgactcagtctccgctctccctgcccgtcacccttggacnggcgcctccatctcctgcaggtctagtcagagcctcgtacacagtgatgggaacaccgccttgaaactggattcagccagaggccaggccaaaccgtccgaggccgccgtaatttataagtatttctaagtcggattccgggtccagacagattcagcgcagtggtcaggcactgatttcacgctgaagatcagcagggtgaggctgaggatgttgtcggtttatctagcctgactagtagtattcgacgtggccgtggacgttcggaccgtaagggaccgtaagggtagaaagtacgaaacgaacgttacggtcggacttacgcaccgtnttaccg

SEQ ID NO: 211249 - DNA, 647 bp, Homo sapiens
  misc_feature: GYAE6OF01AZUMS.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtgggatgtgtgatgactcagtctccgctctccctgcccgtcacccttggacaggccggcctccatctcctgcaggtctagtcagacgcctcgtacacagtgagtgggaaccaccgccttgaactggattcagcagacggccacggccaaccgtccggacggccgtaccttaaagtttaataacgtacttttacgtaagttcgggtacgtttcccgggggtacccagtaccgtagtacgttacgacggacggtacgtacggtcgggtacgagggactacgtgtacgtttaccgacgtcgtaagaacgtacgtcaaggcgaggggtggaaggtcgtaggacggtagttggtttcggttacggttttagttacgtggtacccgttgacgtaagtacgttacgttcgtaaccgtcgggtacccggttacggtaccggttccggaaccggtaacgggaccgtaagggtaaaccgg

SEQ ID NO: 211250 - DNA, 617 bp, Homo sapiens
  misc_feature: GYAE6OF01CEZHC.26.26.C04.1.454.CMB.1.raw
  modified_base (424)..(424): a, c, t, g, unknown or other
  misc_feature (424)..(424): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctgggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgccttgaactggattcagcagaggccaggaccaaccgtccgaggccgacctaatttataagtatttactaagtcgggattccggggaccagacagtacttcagcggcagtgggtcaggctacgtgtactttcgacgntagaagatcgagcgagggtggaaggcgtaggaggtagttggtttcggtacggttttacgttacgttcggtaccgttacggacgtaaggtacgttaacgttacggtaccgttcggggtcccggtttacggggtaacccggtttcccggggaaaccccggtaacgggggtaaacccggtaaaggggttaaaccgg

SEQ ID NO: 211251 - DNA, 682 bp, Homo sapiens
  misc_feature: GYAE6OF01CIX6P.26.26.C04.1.454.CMB.1.raw
  modified_base (282)..(282): a, c, t, g, unknown or other
  misc_feature (282)..(282): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatcctcctgcaggtctagtcagagcctcgtacacagtgatgggaacaccgccttgaactggattcagcagnggccaggccaaccgtccgaggccgaccttaatttagtaaagtatttactaagtcgggtacgttccggggtacccaagacagaattccaggcggcgaggtcgggtcacggcacgtgtactttcacgcgtaagaagtactacgaaggacgtaggggtcggaagggtcgtagggacgggtaagttgggtttacggttacggttttaacgttacgtcggtaccgttggaacgtacggtagtttaccgttccgtaacggttcgggcccggttagggtcccgggtttaccgggaacccgggaaacggggtaacccggtaaagggttaacgggaaaacgttaaccggaaaaaccggtaaacgttacgggttaacggtcgtacggaacccgtacccgtagttacccgg

SEQ ID NO: 211252 - DNA, 597 bp, Homo sapiens
  misc_feature: GYAE6OF01A1NS2.26.26.C04.1.454.CMB.1.raw
  modified_base (282)..(282): a, c, t, g, unknown or other
  misc_feature (282)..(282): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagacgcctcgtacacagtgatgggaacaccgccttgaactggattcagcagnggccaggccaaccgtccgaggcgcctaatttataagtatttctaagtcggacttccggggtccagacagattcagcgcaggtggtcaggcacgtgtactttcgacgtctagaagatcgagcgaggggtggaggctaggaggtagttggttgtacgggttttaattacgtcgtccgtagacaggtagttacttcgacgttcggccgtcgggtaccgttccgggaccgtaaacggggtacccgtaagggttacggaaaacgttaccgaaaacggtaacgttagggtacggacgttacggaccgtaccctagttcccg

SEQ ID NO: 211253 - DNA, 809 bp, Homo sapiens
  misc_feature: GYAE6OF01AO8F5.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcaccttggacaggcgcctcatctcctgcaggtctagtcagacgcctcgtacacagtgagtagggaaccaccgtccttgaactggattcagcaggacggccacggcccaaccgtccgaggccgtaccttaatttataagtattttactaagttcgggtacttcccggggtacccagactagtacgttcgacggccggacgtaggttcggggtacgacgggtacgtaacgttacggtacttttaccgacgtacgttaacggaaacggtacttacggacggtacggtaagggggttcgggaacgggtcgtagggtaacgggttacgtttacgggtttacgggtttaccgggtttttaacgtttaaccgttcgggtacccgttgggtaaccgttaagggttaacggttttaaccgttaccggttaacccgggtttacggggttaccccgggttaacggggttacccgggttttaacccgggaacccggggtaaaacgggggtaaaccccggtaaacgggggttaaacggtaaaaccggttaacccggaaaacccgggttaaccggttacggggttaccggttacccggttacggacccttaacccggtaaggttttaaccccgg

SEQ ID NO: 211254 - DNA, 656 bp, Homo sapiens
  misc_feature: GYAE6OF01CO2N4.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggccgcctcatctcctgcaggtctagtcagacgcctcgtacacagtgatgggaacaccgccttgaactggattcagcagagccaggccaacctccgaggcgacctaatttataagtatttactaagtacgggtacgttcccggggtaccagacagtacttcgacggcggacgtaggtcggggtacacggactacgttcgtaacgttttaccgacgtcgttaacgaagtactaccgaggcggtaaggggtcgggaggtcggtaggacgggtagtttggttggttacggttttaacttacggtacgtccgtgtacgtaacggtagttacttcgtaccgttcgggtaccggttacgggtacccggttacgggaccggtaaacggggaacccgtaagggtaacggtaaacgtaaccggaaaacgtacgtcggtaggtcttacgaccgtacctagtcgttacg

SEQ ID NO: 211255 - DNA, 727 bp, Homo sapiens
  misc_feature: GYAE6OF01B7W82.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctcctccctgcccgtcacccgttggacaggccgcctccatctcctgcaggtctagtcagacgcctcgtacacagtgagtcggaaccaccgtcttagaacgtggacttcgagcgaggacggacccacggacccaaccgtccgacggccgtaccttaaatttagtaacgttacttttacgtaaacggttccggggtacgtttccccggggtaccaagacgagtacttcgaggccggacgtaggtcgggtacgacggtctacgtgtactttacgacgtcgtagaagtactacgagtacggagggtacgggaggtacgtagggaggtagttggttacggttacggttttaagttaccgtcggtaccgttaggacgtaaggtaacgttacgttaccgtacggttcgggtaccggttacgggtaccggtttaccgggaaccggtaaaacggggaaccggttaaacggggtaacggtaaaacgttaaacccggaaaaccggttaaggttcgggtaacgggttaccgtaccggtaccctaacccgttaagtttacccgg

SEQ ID NO: 211256 - DNA, 723 bp, Homo sapiens
  misc_feature: GYAE6OF01BFS5V.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctctccctgcccgtcacccttggacaggccggcctccatctcctgcgaggtctagtcagacgccctcgtacacagtgagtacgggaacaccgccttagaactggattcgagcaggacggccacggacccaacctccgaggccgtaccttaaatttaataagtatttacgtaagttccgggtacgttcccggggtacccagactagtattcgaggcggcgtagggtcggtacgacggtccgacgttgtacgtttaccgacgtactagaaagtactacgaggtaccggaagggggttcgggagggtaccgtagggtaacgggttagtttagggtttacggttaccgggtttttaataccgtcggtaccgttcgaccgtagtaacgttactttaccggacggttaccggggtccggttagggttacccgggttaccgggaacccgggtaaacgggtaacccggtaaaggggtacgaaaacgtaaccggtaaaaccggttaccggttacggttaccgggtactaccggtaccctaacccgttagttaccgg

SEQ ID NO: 211257 - DNA, 802 bp, Homo sapiens
  misc_feature: GYAE6OF01B44NW.26.26.C04.1.454.CMB.1.raw
tcagagactatactcacgaccggtgctcgatttagtctagcgactttggggtttgggggagataaaagctcagctctacccttgccttgactgatcaggactcctcagttcaccttctcacaatgaggctcctgctcagctccgtgggctgctaatgctcgtcgggtccgagggtccaggtgggatgttgtgatgactcgagtcctccgctcctccgtcgcccgtctaccgtggacgaggccgcctcactctcctgcgtacggtctagtcacggtaccgccgtaccgtacacgagtacggtaggtaacgggaaccgacccggtacgttaggtaaccgttgggtacttacggaagtacgaacgggaccggaccgaacggtaacccgaaccggtaccggaacggaccgttaaccttaaagtttaaacgttaaacgttaaccgttttaacggtaaccggttaccggggtaaccggtttcccggggtacccaaggtaaccgtagtacgttaccgaacgggaccgggtacgtacggggtacgggtacgaacgggtcctaacggttcgtactttacgaccgtacgtagtaacgtacgtaacgtacgggacggttagggggtacggaacggtacgggtaggaagggttacggtttcggtttacggttaaccggttttacgttaacgtccggttacgtggaaccgtaaggtttacgttacggtacccggttcgggttacccgggttccggttcggggtaccggttacccgggaaacgggtaacgggtaaacgggtaacgggtaaaccggg

SEQ ID NO: 211258 - DNA, 645 bp, Homo sapiens
  misc_feature: GYAE6OF01EL2GO.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccaggtggggatgttgtgatgactcagtctccgctctccctgcccgtcaccttggacaggccgcctccatcctcctgcaggtctagtcagacgcctcgtacacagtgagtgggaaccaccgccttagaaccgtggacttcgagcgaggacggacccgaggcccaaacccgtccggacggccgtacccttaatttaataagtactttacgtaagtcgggtacgttccggggtcccagacagtattcgagcggcgaggtgggcgaggcactagtatttcgacgtcgttagaagtgtaccgaggtaccggaggggttacgggaagggcgtagggtaagggtagtttagggtttggttacgggttttacgttacgttcgccgttgacgtaaggtacgttattcggtcgtacgggtccggttacgggtaaccggttacgggacccggtaacggggtaaacgtaaggggtaaaccggg

SEQ ID NO: 211259 - DNA, 548 bp, Homo sapiens
  misc_feature: GYAE6OF01D7IDZ.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggccggcctccatctcctgcaggtctagtcagagcctcgtacacagtgatgggaacaccgccttgaactggattcagcagaggccaggccaacctccgaggcgcctaatttataagatttctaatcggattccgggtcccagacagattcagcggcagtggtcaggcactgatttcacgtctagaagactcagacgagggtggaggctggaggtatggttgtcggttttattactgccgtgacgagtagtattcacgtcggccggttggaccggttcggccgtaagggacccgaaagggtaggaaatccgaaaacgacgtagtacggactaggaccaccgattccgg

SEQ ID NO: 211260 - DNA, 642 bp, Homo sapiens
  misc_feature: GYAE6OF01BCRE1.26.26.C04.1.454.CMB.1.raw
  modified_base (325)..(325): a, c, t, g, unknown or other
  misc_feature (325)..(325): n is a, c, g, or t
  modified_base (371)..(371): a, c, t, g, unknown or other
  misc_feature (371)..(371): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccaggtggggatgttgtgatgactcagtctccgctctccctgcccgtcacccttggacacggcgcctccatctcctgcaggtctagtcagagcctcgtacacagtgatgggaaccaccgcttagaactggatcagcagcggccgacggcccaaccgtccgaggccgtaccttaatttataaggtntttactaagtcgggtacttccgggaccagaacagtactcgaggcgnaggtggtcaggacacgtgatttccgacgtacgtagtaacgtatacgagacggtagggtagggacggtcgtagggaacgggtagtttggttacggtttacggttttaacgttacgtcgtccgtacgagtaacgtaggttacttaccgacggttcgggacggttacgggtaaccggtcggaaccggaaacgggtaacccgtaagggtaccggtaaaattaccggaaaacgtacggttcggtacgtaccgtacggaccaacgttacgtcttcgg

SEQ ID NO: 211261 - DNA, 707 bp, Homo sapiens
  misc_feature: GYAE6OF01ELD7B.26.26.C04.1.454.CMB.1.raw
  modified_base (218)..(218): a, c, t, g, unknown or other
  misc_feature (218)..(218): n is a, c, g, or t
  modified_base (692)..(692): a, c, t, g, unknown or other
  misc_feature (692)..(692): n is a, c, g, or t
tcagagactatactcacgaccggtgctcgatttagtctagcgactttgggtttgggggactccgatcaggactcctcagttcaccttctcacaatgaggctccctgctcagctcctggggctgctaatgctctgggtcccagggtccaggtggggatgttgtgatgactcagtctccgctctccctgcccgtcacccttggacaggcgcctcatctcngcagtctagtcagacgcctcgtacacgagtagagtacggaaccaccggtccttagaacgttggtacttcgagcgaggacggaccgaacggacccctaaccgtaccgggacggtaccgtaacctttaaagtttaacgtaaagttactttacgtaaacggtcggggtaaccggttcccgggtaccaaggaactaggtacttacggacggcggtacgtagggttcggtacacgggtacctacgttgttacgtttacgaccgtataacggtaaagacgtacggaacgggtacggtaacgggggtagggtaacgggtcgtaagggacggttagtttggtttacggtttacgtttaagttaccgtcgtcgtagacgtagtacgttactcggtacgtcgggtcggtacggtacggtacccggaacggtaacggaaccggtaaggtaacgaaactaacggaaacgtaggtcggtcacgttanacctacgtgttaccg

SEQ ID NO: 211262 - DNA, 715 bp, Homo sapiens
  misc_feature: GYAE6OF01BAJ15.26.26.C04.1.454.CMB.1.raw
tcagagactatactcacgaccggtgctcgatttagtctagcgactttgggtttgggggactgatcaggactcctcagttcaccttctcacaatgaggctccctgctcagctccgtggggctgctaatgctctgggtcccagggtccagtggggatgttgtgatgactcagtctccgctctccctgcccgtcacccttggacaggccgcctccatctcctgcaggtctagtcagacgcctcgtacacgaggtgagtacgggaaaccaccgtccgttagaaccgtggtattcgagcgaaggacggccgacggaccaacccgtccggacggaccgtactaatttaataagtattttactaagtcgggtacgttccgggtaccagacgagtatcgaaggtcggcgtaggtcgggtacacgggtactacggttagtacgtttacgaacggtacgtagtaaagtacttaccgaggtacggtaggggtacgggacgggtcgtagggtaaggttagtttggttttacggtacggttttaacgtttacgttccggtaccgttagtaacggtaaggttaacgttacgtttaaccgtcgggttacgggtaccggttacgggttaccggtaccggtaccggtaaacggggtaaccgtaagggtaacggtaaacgtaacggaaaccggtaagttcggtacggtccgtaggacctaacggtcgttaccg

SEQ ID NO: 211263 - DNA, 702 bp, Homo sapiens
  misc_feature: GYAE6OF01E4Z0Q.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctctgcaggtctagtcagacgcctcgtacacagtgagtcgggaaccaccgtccttagaactggattcgagcaggacggccacggcccaaccgtccggacggcccgtaccgttaaattttaagtaaagttacttttaccgtaaagtcggggtacgtttcccggggtacccaggacaggtacttcgaaggcggacagggtgggtcagggctacgtgtacttccgacggtctaggaatacgtacgacggtacggtaagggggtgggacgggcgtacgggaaggtagttgggtttacggttacggtttttaacttacggtacgtccgttgacgtaggttacgttacttcgtaacggtcgggtacccggttagggtaacccgggttcgggaacccggaaacggggtaaccggtaaggggtaaccggtaaaacgttacccgaaaacggttaacgtcgggtacggtaccgtacgacccgtaaccgtacgtttaccgg

SEQ ID NO: 211264 - DNA, 724 bp, Homo sapiens
  misc_feature: GYAE6OF01BFX2W.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggccggcctccatctcctgcaggtctagtcagacgcctcgtacacagtgagtagggaaccaccgtccttagaactggattcgagcaggacggccacggcccaaccgtccggacggccgtaccttaatttaataagtacttttacgtaagtcgggtacgttccggggtacccagacagtacttacgacggcggtcgtaggtgggtacacgggactacgtgtactttcgacgtctagaagtactcgaaggcggtaacggggtgggacgggtcgtagggaaggttagttgggtttacggttacggtttttaattaccgttacggtcccgtggtaccgtaaggtaacggtttactttaccggtaaccggttcgggtacccggttacgggttacccgggtttacggggaaccccggaaacgggggtaacccgtaaaagggggttaaccggtaaaacgttaaccggtaaaaccggtaacggttacgggtcgggtacccgtaggtaccctaaccgttacgtttccgttaccgg

SEQ ID NO: 211265 - DNA, 815 bp, Homo sapiens
  misc_feature: GYAE6OF01B9WBP.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctcgtgggtcccagggtccaggtggggatgttgtgatgactcagtctccgctctccctgcccgtctacccgttggacaggccgcctccatcctcctgcaggtctagtcagacgcctcgtaacacgaggtgagtacgggaacaccgtccttagaactgggaattcagcgagacgggacccacgggacccaaacccgttcccggaggccgtacccttaaagttttaataaagtaacttttactaaacggttaccggggtaacgtttcccgggggtacccaacggtaacgtaacgaacgtttaccaagggtccggacgtaacgggtgggttacggacgggtactacggttagtaacgttttaccgacggtaccgttaaggtaaacggtagttaccggaacgggtacgggaaaggggggttcggggtaaacgggtaccggttaaggggtaaacggggtttggtttacgggttttacgggtttaacgggtttttaaaccggttttaacgttccgggtaccggtttgaacccggtaaggtacggtttaacgttaccgtaacggttccggggtaccggttacggggtacccgggttaccggtaaccgggaaacgggtaacggaaacgggttaacggtaaaacgtaaccggaaaacgtacggtacggtcggacgtacgaccctaacgtgttacccg

SEQ ID NO: 211266 - DNA, 743 bp, Homo sapiens
  misc_feature: GYAE6OF01BIEBZ.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagacgcctcgtacactagtgagtcgggaaccaccgtccttagaactggacttcagcaggacggccacggcccaaccgtcgacggcctaccttaatttataagtactttactaagttcgggtacgttccggggaccagacagtacttcgaggcggacaggtcgggtacgacgggacctacgttgtacttttaccgaccggtacgtagtaaagtacttacgacggtacggtaacggggtagggaacgggtcgtagggtacgggtaagtttcgggtttacggtttacgggtttttaacgttacgttcggtacccgttaggtaccgtaaggtaacggtttacgttacccgtaaccggttccgggtacccggttacgggtaacccgggtttaccgggaacccgggtaaaccggggtaaaccggtaaacggggttaaacggtaaaacgttaaccggtaaaaccgtaaccggttaggtaccgggtacctaccgggtaccctaacccgtacgttccgttaaccgg

SEQ ID NO: 211267 - DNA, 802 bp, Homo sapiens
  misc_feature: GYAE6OF01CQ6X4.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtcctccgctctccctgcccgtcacccttggacaggccgcctccatcctcctgctaggtcctagtcaggcgtcctcgtaacacgaggtgaagtcgggaacacccgccttagaacgtggattcagcgaggacggccgacggaccccaaccgtccggacggtccgtacccttaaagttttactaaagtattttacgtaaagtccggggtacgttcccgggtaccaacgtacaagtacttcgaacggtccggacgtagggtcggggtaccgagggtcctaacgttggtacttttaccgaccggtaccgttagggaaacgtacttaccggaacgggtaccggtaagggggtacggggtaacgggtccggtttaaggggaacgggttaccggttttaggggtttacgggtttaaccgggttttttaacgtttaacccgggttcggtacccgtttagggaaccgttaagggttaacggttacgtttaccgacgggttaccggggtccggggttacgggtacccgggttaccgggaacccgggtaaacggggtaacccggtaaaggggtaacggtaaacgtaaacccggaaaacggtaacgttaggtacggtacgtacggaacccacgttacgttaccgg

SEQ ID NO: 211268 - DNA, 849 bp, Homo sapiens
  misc_feature: GYAE6OF01CRB06.26.26.C04.1.454.CMB.1.raw
tcagagactatactcacgaccggtgctcgatttagtctagcgactttgggtttggggtgatcaggactcctcagttcaccttctcacaatgaggctccctgctcagctccgtggggctgctaatgctcgtgggtcccagggtccaggtggggatgttgtgatgactcagtctccgctcctccctcgcccgtcacccgttggacaggccgcctcatcctcctgcaggtctagtcagcgcctcgtacacagtgagtacgggaaccaccgtccgttagaacgtggtacttcgacgacgaggacggaccgacggaccccgtaaccgtccggacggccgtaccttaagtttaataagtactttacgtaagtcgggtacgttccgggacccagaccagtcttacgaggcgacgtagggtcggtacgacggtactcgttagtacgtttccgaaccgtcgtaacggtaaacgtacttaccggaacggtacggggtaagggggtacgggtaacgggtacgttaggggtaagggtttagggttttacgggtttacggggttttaacccgggtttttttaagtttaccggtttaccggtaccccgggttagggttaacccggtaaagggtttaaccggttttaaccgtttacccggttaacccgggtttccgggggtacccgggttttacgggggttaacccccgggtttaccggggaaaccccgggtaaaccgggggtaaacccgggttaaaagggttaaacggggtaaaacttaaaaccccgggtaaaaaccgggttaacccgggttgggtacccggttaccgtacgggacccttaaccgttcgttacgtttacccgg

SEQ ID NO: 211269 - DNA, 679 bp, Homo sapiens
  misc_feature: GYAE6OF01CY3MK.26.26.C04.1.454.CMB.1.raw
  modified_base (280)..(280): a, c, t, g, unknown or other
  misc_feature (280)..(280): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctcctccctgcccgtcacccgttggacaggccggccttccatcctcctgcaggtctagtcagacgcctcgtacanacgtagagtacggaacaccgccttagactggattacgagacgacggacggccgaacggaccccgaaaccgtccggacggtaccgtaccctttaaaatttaagtaaacggtacttttacgtaaacggttccggggtacgtttacccggggtacccaagaaccaggtactttacgacggccggacgtagggtcgggtacagggcctacgttagtactttcgacgtcgtagaagacttacgaggtcggaggggtcggacggtcgtaggtacgggtagttcggtttggttacggttttagttacgttgtccgtacgcgtaaggtagttacgttacgacggttcgggtaccggttacgggtaccggttacggaaccggaacgggtaaccggtaagggtaaacgg

SEQ ID NO: 211270 - DNA, 680 bp, Homo sapiens
  misc_feature: GYAE6OF01D79UX.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctcctccctgcccgtcacccgttggacaggccggcctccatctcctgctaggtctagtcagacgcctcgtacacagtgagtgggaacaccgccttgactggattcagcagaggccaggccaaccgtccggaggccgtacccgtaatttacgtaagtattttacgtaaagttcgggtacgttaccccgggggtacccaaggacctaaggtactttccgaaggtccgggtcgtaagggttggggtaccgagggcaaccgttggtactttccgaacgtccgtaggaagacgttacgaggtacggaaggggttcgggaagggtaccgtaggtaagggtagtttggttcggttacgggttttattaccggttgtcccgtgacgtagtagttaacttcgtacggtcggtccggtaggtaccggttcgggaaccgtaagggaaccgtaaagggtacggaaattaccggaaaacgtacgttaggtacggtcgtacgacgaacctagtccgttacgg

SEQ ID NO: 211271 - DNA, 751 bp, Homo sapiens
  misc_feature: GYAE6OF01CR3JH.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctcctccctgcccgtcacccgttggacacggccgcctcatctcctgcaggtctaagtcagacgtcctacgtaacactaggtgagtacgggaacaccgtccttagaacgtggtattcgagcgaggacggcccacgggacccaaccgtccgaggccggtaccttaaatttaataaggtaactttacgtaaacgtccgggtagttccccggggtaccaagaaccaagtacttacgaggccgggactaagggtgggtaccaacgggctaacgttggtaacttttccgacgtacgtaggaaacgacgtacgaacggacggtaggggtacgggaacgggtacgtagggtaacggtagttgggttacggttaacggttttaacgtttaacgtggcccgttaggaccgaggtagttacttaccgtacgttcggggtacccggtcgggttaaccggtttccgggaacccggtaaacgggaaaccgggtaaacgggtaaacgggttaaaacgtaaccgtaaaaaccgggttaaccgtaacgggttacgggacgttaacggaccgtaacccgttagtttaacccgg

SEQ ID NO: 211272 - DNA, 903 bp, Homo sapiens
  misc_feature: GYAE6OF01DZ871.26.26.C04.1.454.CMB.1.raw
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
tcagagactatactcacgaccggtgctcgatttagtctagcgactttgggtttgggggagataaaagctcagctctacccttgccttgactgatcaggactcctcagttcaccttctacacaatgagcctccctgctcacgctccgtggggctgactaatcgctcgtgggtcccagggtccaggtggggatggttgtgacngactcngtcctccgctcctcctcgaccgtcacccgtggacacggccggcctcccatccgtcctgaccgaggtctagtcagacgcctacgtacaagacgtaggacgtacggggaacccacccggtacctttacggaaaccgtggtagtttaccaacggaccgagggaaccgggccgaaccgggacccctaaaccccggtaccgggaaccggaccggttaacccgtttaaaattttaaacgtaaacggttaacgttttaacggttaaaacggccggggtttaaccggtttaccccggggggtaacccctaacggaaaccgtacgttaaacgttacgacgtaccggggggtaacctaacgggggttccgggttaacggacgggtacccttaaccggttacggttaccttacgtaacgggtcctaagggaaattaaccggacgtaacggtacgggttaaggggggacggtacgggtaccgtaggtaaagggtaccggtttaggtttaaacggggttccgtttttaaacggtaccgtttaccggtccggggtttacgtaaacggtaacgggttttaaacccgtattttaacccgggaacggggtttaacccggggtccggttaacggggttacccccgggtttaaggggtaacccccggggtaaaaaccggggtaaacccggggttaaaaggggtaaaaaccccggg

SEQ ID NO: 211273 - DNA, 738 bp, Homo sapiens
  misc_feature: GYAE6OF01EMOCL.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtgggatgttgtgatgactcagtctccgctctccctgcccgtcacccttggacacggcgcctccatctcctgcaggtctagtcagacgcctcgtacacaggtgagtcgggaacaccgtccttgaactggattcagcagacggccacggccaaccgtccggaggccgaccttaatttagtaagtacttttacgtaagttcgggtacgtttccgggtacccagtaacagtacttacgacggtcggactagggtcgggtacacgggacctacgttacgtacgttttaccgacggtacgttaggaaacgtagttacgaacggtcgggtaagggggttgggaacgggtcgtacgggtaagggttacgtttgggttttacggttacgggttttttaacttaaccggttcggtaccgttacggaacgtaacggtaacgtttacgtttaccggaacggttcggggtacccggttcgggttaacccgggtttccgggaacccggtaaaacggggtaccgaaacggggttaacggaaaacgttacccgaaaaccgggtaacgtccgggtacgggtactaccggcctaaccgtcgtttaccg

SEQ ID NO: 211274 - DNA, 654 bp, Homo sapiens
  misc_feature: GYAE6OF01CPJ6C.26.26.C04.1.454.CMB.1.raw
  modified_base (266)..(266): a, c, t, g, unknown or other
  misc_feature (266)..(266): n is a, c, g, or t
  modified_base (288)..(288): a, c, t, g, unknown or other
  misc_feature (288)..(288): n is a, c, g, or t
  modified_base (318)..(318): a, c, t, g, unknown or other
  misc_feature (318)..(318): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccgttggacacgggccgcctccatcctctgcaggtctagtcagacgtcctcgtacacgagtgagtcgggaaccnccgcttgaactggatcagcagngccaggccaaccgtcgagcgacttaattanaagtatttcgaagtcggtacgttccgggtccagacgagattcgagtcgacgaggtggtacaggcacgtgtacttccacggtactaggaacgtactacgaggacggtacggggtgggaacggtcgagggtaggtaggttggttcggttacggttttacttacgtcgtccgttgacgttaaggtacgttacgttcgacggtttcgggaccggttacgggtaccggtttaccgggaacccggtaaacggggtaacccgtaaaggggttaacgggaaaacgtaaaccggtaaaccggtaacggttcgggtacggtactacggaaccctcgtacgtttccg

SEQ ID NO: 211275 - DNA, 590 bp, Homo sapiens
  misc_feature: GYAE6OF01CC74U.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaaccgtcgaggcgacctaatttataagtatttctaagtcgggtagttccggggtcccagacagattcagcggcaggtggtacaggcactgtatttcacgctgaagatcgagcgtagggtaggaggtctggaggtagtgttgtcggtttattacgtgtacctgactaggtagttacttcgacgtcgggtcgtcgggtaccgttccgggaccgtaaacggggaccgtaaacggggtacggaaaacggttcgaaaaccggtaacgttggtacggtacgttacggaaccctacgtaacttccgg

SEQ ID NO: 211276 - DNA, 739 bp, Homo sapiens
  misc_feature: GYAE6OF01DNM4L.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctccgtggggctgctaatgctcgtgggtccagggtccagtgggatgtgtgatgactcagtctccgctctccctgcccgtaccaccgtggacacggccgcctcatcctcctgctaggtctagtcagacgacctacgtacacgtagtagagtacgggaacctacccgtacttagaacgtggtattacgagcgaaggacggaccgacggacccaaccgtaccggaggtaccgtaaccttaaagtttaaacgtaaacgtagttttaaccgtaaacggtaccgggtacgtttacccgggggtaccaaggtaacgtacgtaacttcgaacggccggtacgtaacggtcgggtacgaacgggtactaacgtagttacgtttaccgacgtacgttaaggaacgtactacggtaacgcggtaaggggtcgggagtaccggttagggaaggttacggttagggttacggttaaccggttttagtaccgtacggttcccgtagtacgtaacgggtaacgttacgttaccggacggttcggggtaacccggttcgggtaacccggtttaccgggaaaccggaaacggggtaaaccgtaaggggttaaaacgg

SEQ ID NO: 211277 - DNA, 819 bp, Homo sapiens
  misc_feature: GYAE6OF01DZNBV.26.26.C04.1.454.CMB.1.raw
  modified_base (801)..(801): a, c, t, g, unknown or other
  misc_feature (801)..(801): n is a, c, g, or t
  modified_base (811)..(811): a, c, t, g, unknown or other
  misc_feature (811)..(811): n is a, c, g, or t
tcagagactatactcacgaccggtgctcgatttagtctagcgactttgggtttgggggactgatcaggactcctcagttcaccttctcacaatgaggctccctgctcagctccgtggggctgctaatgctcgtcgggtcccagggtccaggtggggattgttgtgatgactcgagtcctccgctcctccctcgcccgtctacccgttggacgacggccgcctccactcctccgtgcgtaggttctacgtacgaggtacgtcctacgtaacacgtaggtcgaacgtacgggaacctaccgtcgttagaacgtggtacttcgacgacgaggacggcccgtacggaccctaaccggtccggaacggtccttaaccgtttaaaattttacgtaaacggttacgtttttaaccgtaaacgggttcccgggttaaccgggttacccccgggggtaacctaaacgggtaaacccgttaaggtaacctttacccgggacggtaccgggtaccggtaaaggggttcgggtaacgacggtaccgtacgtttacggttacttaccgaacggtcgttaaggaacgtacgtacggaacggtacgggtaagggtacgggtacgtaccggttaggggtaaggttacgttttacgggttacgggttaaccggttttaaacgtcgtcgggtaccgtagaaccgtaaggttcgttacgtacgtcggacggttcggtacgggtacgttaccggaaacggtaaacgggtaccgaaagggttaacgaaactaaacccggaaagttagtcgggtaccacgtanccctaaagtnttaaccgg

SEQ ID NO: 211278 - DNA, 560 bp, Homo sapiens
  misc_feature: GYAE6OF01CMX29.26.26.C04.1.454.CMB.1.raw
tcagagactatactcacgaccggtgctcgatttagtctagcgactttgggttttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctcatctcctgcaggtctagtcagagcctcgtacacagtgatgggaacaccgccttgaactggattcagcagaggccaggccaacctcgagcgcctaatttataagatttactaatcgggattccggggtccaggactagattcagcggcaggttgggtcagggcacgtgtatttcgacgctagaagatcagcgaggggtgaggctaggaggtattggttagtcggttttattaactgccttggactagagttaattcacgtcggtccggtgggtacgttcgggaccaacgggtaccgtaagggtacggaaatacgaaaacggtacgtaggtggactcgaccaacctgtcgttacg

SEQ ID NO: 211279 - DNA, 643 bp, Homo sapiens
  misc_feature: GYAE6OF01B41NA.26.26.C04.1.454.CMB.1.raw
  modified_base (232)..(232): a, c, t, g, unknown or other
  misc_feature (232)..(232): n is a, c, g, or t
  modified_base (438)..(438): a, c, t, g, unknown or other
  misc_feature (438)..(438): n is a, c, g, or t
tcagagactatactcacgaccggtgctcgatttagtctagcgactttgggtttggggtgatcaggactcctcagttcaccttctcacaatgaggctccctgctcagctccgtggggctgctaatgctcgtgggtcccagggtccaggtggggatgttgtgatgactcagtctccgctctccctgcccgtcaccctggacaggcgcctccatctcctgcaggtctagcagacncctcgtacacgagtgagtgggaacaccgtcttagaacgtggtatcagacagacgccaggccaaccgtcgagccgacttaattataagtatttacgtaaggtccgggtacgttccgggaccagacagtactcgaggcggagacggtgggtacaaggctacgtgtacttacacgctaggaacactacgacggacgagggtaggacggngtaggagtagttggttcgttacggtttagttacgtaggtccgtagtacgtaggtaacgtgtttaccgacgttcgggtaccggttacgggtaccggttaccgggaacccgggtaaagggaacccggtaaacggggtaaggaaacgttaaccgtaaaaccgggtcgttacggtacggacgttcgaacccgtacctagttcgttaccg

SEQ ID NO: 211280 - DNA, 765 bp, Homo sapiens
  misc_feature: GYAE6OF01DBIRK.26.26.C04.1.454.CMB.1.raw
  modified_base (266)..(266): a, c, t, g, unknown or other
  misc_feature (266)..(266): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtacaggtggggatgttgtgatgactcagtctccgctctccctgcccgtcacccttggacacggcgcctccatcctcctgcaggtctagtcagacgcctacgtacacgtagtgagtcgggaaacnccgtccttagaactggtaacttcgaagaccgaggacggacccgacggaccctaacccgtccggaacggtccgtaacctttaaattttaacgtaaaaggttacttttaaccggtaaaaggttccggggtaaacgtttccccgggggtaccaaggtaaccgtaacggtaacttaccggaacgggtcccgggtacgtaacggggttacggggttacaaccggggtctaaacgtcggttaaactttccgaacgtcgtaagaacgtctacgacggacgtaggggtcggaacgggtctagggaggtaacgttggttacggttacggttttaattcgtacgtccgtaggacctaaggttagttacttacggtcggttcgggtaccgttacggggtacccgttacgggacccgtaaacggggaacgtaaacgggttaacggtaaaactacccgtaaaaccgggtacgtttacgggcgtacggtaccgtaccgtaacgtaccgtttcg

SEQ ID NO: 211281 - DNA, 783 bp, Homo sapiens
  misc_feature: GYAE6OF01BB9EY.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctctccctgcccgtcacccgttggacaggccgcctccatcctctgccaggtctagtcagcgcctcgtacacgagtgaagtacggaaccaccgtccttagaactggacttcagcgaggacggccaacggacccaaccgtaccggacggtaccgtaccttaaatttaataacgtactttacgtaacggttcgggtacgtttcccggggtacccaagtaacgacgtacgttacgacggtcggtacgtaggtcgggtagacggactacgtgtactttacgacgtcgtagaacgtactacgacggtacggtaaggggtacgggtaagggtaccgtagggtaagggttacgtttcgggtttacgggtttaccgggttttttaacgtttaacggtttccggttacgttacgggtaccgtaaggtaacgtttacgtttaccggtacgttaccggggtaccgggttacgggttaacccgggttaccgggtaaacccggtaaaacgggggtaaacccggtaaacggggtaaaggtaaaacggtaaacccggtaaaaccggttaacggttacgggtaccggtaccgtacggtaacccgtaacccggtagtttacccgg

SEQ ID NO: 211282 - DNA, 675 bp, Homo sapiens
  misc_feature: GYAE6OF01ECF4Q.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctcgcccgtcacccttggacaggccggcctccatctcctgcaggtctagtcagacgcctacgtacacgagtgagtcgggaaccaccgtccttagaactggacttcgagcgaggacggcctaggcccaaccgtccggacggcctacctttaaatttaataagttatttactaagttcgggtacgttcccggggtacccagacgtaagtacttacgaggcggacgtagggtcgggtacgaacgggtcctacgttagtactttaccgacgtcgtaaggaacgtactcgaggtacggagggggtcgggaaggtcggtaggaacgggttattcgggtttaggttacggttttacttaccgtgtaccgtcggacgtaggtaacgtttcgtacgtacggttcgggcccggttacgggtaccggtttacccgggaaccggtaaacggggtaacccgtaaaggggtaaaacgg

SEQ ID NO: 211283 - DNA, 636 bp, Homo sapiens
  misc_feature: GYAE6OF01DFOV7.26.26.C04.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (267)..(267): a, c, t, g, unknown or other
  misc_feature (267)..(267): n is a, c, g, or t
  modified_base (392)..(392): a, c, t, g, unknown or other
  misc_feature (392)..(392): n is a, c, g, or t
  modified_base (429)..(429): a, c, t, g, unknown or other
  misc_feature (429)..(429): n is a, c, g, or t
tcagagactatactcacgaccggtgctcgatttagtctagcgacttttgggtttgggggactgatcaggactcctcagttcaccttctcacaatgaggctccctgctcagctcctggggctgctaatgctctggggtcccagggtccaggtggggatggttgtgatgactcagtcctccgctctccctgcccgtcaccgttggacnggccgcctccntcctcctgcaggtctagtcagacgcctcgacacgaggtgagtgggaaccncccgtccgttagaactggattcagcaaggacgccgacggacccaacccgtcggacggcgtaccttaatttaataagtatttactaagtcgggtacgtccgggtccacgacagacttcgcgacggntaggtggtcaggcacgtgtacttcgacgtactagaanatcgaacggcgaggggtggaggcgtagggaggtagtggtttacgttcggttttacttacgtcgtcgtgacgtagttacgtacgttcgtacggttcgggtcggttacgggtccggttacggaacccggaagggaacggtaaagggtaacggtaaactacggaaaacgtacggttacggtacggtccgtagacgtaccgtcgttaccgg

SEQ ID NO: 211284 - DNA, 708 bp, Homo sapiens
  misc_feature: GYAE6OF01DX18B.26.26.C04.1.454.CMB.1.raw
  modified_base (272)..(272): a, c, t, g, unknown or other
  misc_feature (272)..(272): n is a, c, g, or t
tcagagactatactcacgaccggtgctcgatttagtctagcgactttgggtttggggtgatcaggactcctcagttcaccttctcacaatgaggctccctgctcagctccgtggggctgctaatgctcgtcgggtcccagggtccaggtggggatggttgtgatgactcagtctccgctcctcccgtcgcccgtcacccgttggacacggccgcctccatctcctgcaggtctagtcagacgtcctacgtacacgtagtgacgtcggaaccnccgtcttagaacctggtacttcagacaggacgccgacggtcccaaccgtccggaggccgtaaccttaattaataacgtactttacgaaaggtccgggtagttccccggggaccaagaccgagtactcgaggtcggacgaggtcgggtacacgggtactacgtagtactttccgaacggtctaaggaacgttacacgaccggtggagggggtacggacggcgtaagggaggttagttgggtttacggtacggttttactacgttcggaccgttgacgtaaggtagttcgtaccgacggtccggtacggtacggaacccgggttccgggaacgtaaaccggggaaccgttaaaggggtaacgtaaaccgtaaccgtaaaaacggtcggtacgggttacggaccttaccggaaacccaccgttagttcccgttaaccgg

SEQ ID NO: 211285 - DNA, 804 bp, Homo sapiens
  misc_feature: GYAE6OF01BJ02M.26.26.C04.1.454.CMB.1.raw
  modified_base (167)..(167): a, c, t, g, unknown or other
  misc_feature (167)..(167): n is a, c, g, or t
tcagagactatactcacgaccggtgctcgatttagtctagcgactttgggtttggggtgatcaggactcctcagttcaccttctcacaatgaggctccctgctcagctccgtggggctgctaatgctcgtgggtcccagggtccaggtggggatgttgtgatgactnagtctccgctcctcctgcccgtacaccgttggacaggccgtcctcatcctctgctaggtctacgtcaagcgtcctcgtaacacgtaggtgaacgtacgggaaacctcccggtcgttagaacgttggaacttcgaggacagggacggacctacgggaaccccaaaccggtccggaacgggtcccttaacctttaaaagtttaacgtaaacgtactttttacggtaaaagggtcccgggggtaacgttttcccccggggaccaagggtacctaacggtacgttacggacgggtaccggtcgtaaggggttccgggactacggggtactaaccggtttaggtttaaaccttccgaaccgggtacgttaaggaaacgtaacgtccggtaagggccgggttaaggggggtcggaacgggtcggtaagggtacgttaggtttcgggtttacggttaccggtttaatacccggtgtaccgtacggcgtaacggttagttaaccgtttccggtacggtccgggtaccggtacgggtaccggttacggaacggaacgggtaccgtaaagggtaacggtaaacgaccgggtaaaactcggttacgggaccggttcgtaccgaacctacctaacggtttcgttacccg

SEQ ID NO: 211286 - DNA, 658 bp, Homo sapiens
  misc_feature: GYAE6OF01EZWZT.26.26.C04.1.454.CMB.1.raw
  modified_base (433)..(433): a, c, t, g, unknown or other
  misc_feature (433)..(433): n is a, c, g, or t
  modified_base (478)..(478): a, c, t, g, unknown or other
  misc_feature (478)..(478): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctcgtgggtcccagggtccaggtggggatgtgtgatgactcagtcctccgctcctccctcgcccgtcacccgttggacgaggccgtcctcatcctccgtgccgaggtctagtcgagacgcctcgtacacagtgagtcgggaaccaccgtccgttagaacgtggacttcgagcgaggacggccacggacccaaccgtccggacgccgtacctaaatttataaagtactttacgtaagtcgggtacgttcccgggtaccagtacagacttcgaggcgngtaggtcgggtacaggctacgtgtactttacgacgtgtagaacgngtacgaggtacggagggtaggagggtcgtaggtaggtacgttagggttcgttacggtttaacgttaccgtcgtaccgtcgacgtaaggttacgttacttaccggtacggtccgggtaccggttacgggttaccggttaccgggaaccgaacggggtaaacccgtaaagggtaaaaccggg

SEQ ID NO: 211287 - DNA, 742 bp, Homo sapiens
  misc_feature: GYAE6OF01ACM2I.26.26.C04.1.454.CMB.1.raw
tcagagactatactcacgaccggtgctcgatttagtctagcgactttgggtttgggggactgatcaggactcctcagttcaccttctcacaagtgaggctccctgctcagctccgtggggctgctaatcgctcgtgggtcccagggtccaggtggggatgttgtgatgactcacgtcctccgctcctcccgtcgtcccgtctacccgttggaccgacggccgtcctccatcctccgtgcgtacggttactacggacgaaggtccgtccgttacggtaaccacgtaggtacgaacggtaccgggaacctacccggtcttaaggaacgtcggtaactccgaggcgtaaggcgacccgtaacggccctaaccgtcggacgtaccgttactttaaggttatacgtacttacgaacggtcggtaccggttcccggaccagactagtcgtcgacggcggtaacgtgggtcggtacagttaccagttacgttacttccgaagtcgtaagaacgttcgaggtacggtacgggtggggtacgtagtacggtaggggtaactttgggtttccggtaacgggttttccttacgtccggtaccgtgtaccggttaacgtaacgttaacgttcgttaaccgggcggttcgggacccggttaagggtccgtaccgggaaacgaacggggttaccgaaggttaacgaaccgttacgaaacgttgcgttaaacggccacgtaccgtactttggtaccc

SEQ ID NO: 211288 - DNA, 856 bp, Homo sapiens
  misc_feature: GYAE6OF01D6QDM.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctcgtgggtcccagggtccagtggggatgttgtgatgactcagtcctccgctctccctcgcccgtcaccgttggaccaggcgcctcatcctcctgctaggtctaagtcagacgtcctacgtacacgagtagacgtacgggaaccaccgtcctttaggaaacgttgggtactttaccgaggcgaacggacgggacccaacggggaccccctaaaacccggttccgggaacggtaccccggttaaccttttaaaagttttaaacgtaaacgggtttaactttttaccgttaaaaacgggttcccgggggttaaaccggttttcccccggggggaacccctaaaggtaaccgtaaggtaaaccgttttacggacggggtaccggtacggtacggggttacggggttacccgaacgggtacctaacggttacggttaacgtttacccgacggtaccgtaggaaacgtacgttacgacgggtacggtagggggtacgggacgggtacgtagggagggttagttttacgggtttacggttaacggtttttacgtacccggttacgttcccggtacgtacggttaagtttaaacggtttagtttacccggtaaccggtttcggggaccgggtttaccggggttaaaccgggtttacccgggaaaccgggtaaaacgggggtaacccggtaaaaggggtaaaccggg

SEQ ID NO: 211289 - DNA, 736 bp, Homo sapiens
  misc_feature: GYAE6OF01CX3F7.26.26.C04.1.454.CMB.1.raw
  modified_base (208)..(208): a, c, t, g, unknown or other
  misc_feature (208)..(208): n is a, c, g, or t
  modified_base (721)..(721): a, c, t, g, unknown or other
  misc_feature (721)..(721): n is a, c, g, or t
tcagagactatactcacgaccggtgctcgatttagtctagcgactttgggtttgggggactgatcaggactcctcagtttcaccttctcacaatgaggctccctgctcagctccgtggggctgctaatgctcgtcgggtcccagggtccaggtggggatgttgtgatgactcagtctccgctcctccctcgcccgtcaccgttggacncggccgcctacatcctctgcgagtctagcagcgtcctacgtacacgtaggtagagtacggaacctacccgtctttaagaacgttggaacttcgacgacgaacgggacggacccgaaccgggacccctaacccggtaccggacggtacccgttaaccttttaaaatttaaagttaaacgttacgttttacgttaaacgggtccggggttaccgtttcccggggaccaagtaactaggtacttcggaacggcggtacgagggttcggaacgacgggtactacgtacgttacttacggtacgtacgtaagtacgacgtacggtacggagggtacgggtagggcggtagtagggtagggtagtttggtaggttttacggtttaacgttcgtcgtcgtaggagttaacggttcttacgtcgttacggtacggtcggttacggttacggtaaccgggtaccgaacgggtacggtaacgggtaacgtaaacgtaacggaaaggttccggtagtcggtacngtacctcgtcgttcg

SEQ ID NO: 211290 - DNA, 683 bp, Homo sapiens
  misc_feature: GYAE6OF01AUSQA.26.26.C04.1.454.CMB.1.raw
  modified_base (176)..(176): a, c, t, g, unknown or other
  misc_feature (176)..(176): n is a, c, g, or t
  modified_base (215)..(215): a, c, t, g, unknown or other
  misc_feature (215)..(215): n is a, c, g, or t
  modified_base (413)..(413): a, c, t, g, unknown or other
  misc_feature (413)..(413): n is a, c, g, or t
  modified_base (668)..(668): a, c, t, g, unknown or other
  misc_feature (668)..(668): n is a, c, g, or t
tcagagactatactcacgaccggtgctcgatttagtctagcgactttgggtttgggggactgatcaggactccctcgagttcaccttctcacaatgaggcctcccctgctcagcgtcctggggctgctaatgctcgtgggtcccagggtacgaggtggggatggttgtgatgactnagtcctccgctcctcccgtcgcccgtcacccgttggacncggccgcctccatcctccgtgcgtaggtctagtcagtacgcctcgtacacagttgagtagaacgaaccaccgtccttagaacgtggtacttcgacgcgagacggccgacggacccaccgtaccggacggaccgtacttaagttaataacgtatttacgtaaggtcgggtacggttcccgggtaccaggacgtaacgtntaccgaggcccggtgtacgggtcgggtaccgaacgggtacctacgttagttacgtttaccgacggtacgtaggaatacgtacggaggcgggtaaggggtcggaggtcgtagggtaaggttgttaggtttcggttagttttacgtacgttacgtcctaggtacgaaggttacgttactacggtccggtacggtcggtacggtcgttaccggacgtaacggacgtaagggtacggaaacacgaagtacggtcggacncgacgacgtcgtacg

SEQ ID NO: 211291 - DNA, 727 bp, Homo sapiens
  misc_feature: GYAE6OF01B6F3S.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctcgtgggtcccagggtccagtggggatgttgtgatgactcagtctccgctctccctgcccgtcacccttggacaggcgcctccatctcctgcaggtctagtcagagcctcgtacacagtgagtacggaactaccgcttagaactggtattcgagcgagacggtaccacggaccaacccgtcggacggtaccgaccttaaattttagtaaagtacttttacgaaagttcggggtaacgttcccggggtacccaaggtacaggtattcgaaggcggtacgtaagggtcgggtacctagggactaacgttcgtaacgttttccgaacgtaccgttaggaaaacgtagtaccgtaagggaccgtaagggggttagggaacggtccgtaagggtaaggtacgtttgggtttacggttacggtttttaaacttacgtacgtccgtgtaacgaggttaacgtactttacggaaccgttcggggtccggttaacggtaccggtttaccggggaaccgtaaaggggtaacccggtaaagggttaacgggaaaacttaaccggaaaacggtaacggtaggttcggacttacggaccaccgtacgttacg

SEQ ID NO: 211292 - DNA, 698 bp, Homo sapiens
  misc_feature: GYAE6OF01AOUCK.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctctccctgcccgtcaccctggacaggcgcctccatctcctgcaggtctagtcagagcctcgtacacagtgagtcgggaacaccgtccttagaacgtggtacttcagcagacggcccaggaccaaccgtccgaggacgtccttaaatttagtaaagtatttacgtaacgttcgggtacgtttcccggggtacccaagacagtacttacgaggcgggcgtaggtgggtcaggctacgtgtacgtttacaacgtcgtaggaaagtactacgagggtaccggaagggggttgggaagggtcgtagggtagggtagttgggtttaggttacggtttttaacttacgttcgccgttggaccgtaggttaagttacttccgtaacgttcgggtaccggtacgggtaaccgggttccgggaaaccggtaaacggggtaaccggtaaaggggttaaacggaaacgttaaccggaaaaaccggttacggtacggtacgggtaccgtaggaaccctaaccgtcgttacccgg

SEQ ID NO: 211293 - DNA, 775 bp, Homo sapiens
  misc_feature: GYAE6OF01C1VHD.26.26.C04.1.454.CMB.1.raw
  modified_base (165)..(165): a, c, t, g, unknown or other
  misc_feature (165)..(165): n is a, c, g, or t
  modified_base (753)..(753): a, c, t, g, unknown or other
  misc_feature (753)..(753): n is a, c, g, or t
tcagagactatactcacgaccggtgctcgatttagtctagcgactttggggtttgggggactgatcaggactcctcagttcaccttctcacaatgaggctccctgctcagctccgtggggctgctaatgctcgtcgggtcccagggtccaggtggggatggttgngatgactcagtcctccgctcctccctcgcccgtactacccgttggaacgcgggccgtcctccactcctccgtgcgtacggttactacgtacgagtacgtccgtacgtaccaagtacggtcgtaaggtaccgggaaacctccgtacttaagacgttgaactcgacgagaggacggccaacggccctaaccgccggacggaccttaacgtttaaacttaagtaagttactttacggtaaccgggttcgggtaccggttcccgggacctaagacgtaacggtacgtttacggacggtcggtacgtaggggtccgggtacgacggtacgttacgtagttacgttaccggagtacggtaataaacgtcgtacgacgggtacggtggggtaacggtgggacggtagggtagggttacgtttggggttacggttttacgtttaacggtccttccgggtacttagggaaccgttaaggttcgttaacgtcggttcgggaccggttccgggtaccggttaacggtccggaaaccggaacggggttaacgaacgggttaaacaaaccgtaacggtaacgtcgtagggttacccggtancctaaccgcgttaacgttccgg

SEQ ID NO: 211294 - DNA, 719 bp, Homo sapiens
  misc_feature: GYAE6OF01BT4KN.26.26.C04.1.454.CMB.1.raw
  modified_base (501)..(501): a, c, t, g, unknown or other
  misc_feature (501)..(501): n is a, c, g, or t
tcagagactatactcacgaccggtgctcgatttagtctagcgactttgggtttgggggactgatcaggactcctcagttcaccttctcacaatgaggcctccctgctcagctccgtgggctgctaatgctctgggtcccagggtccaggtggggatgttgtgatgactcagtctccgctcctccctgcccgtcacccgttggacaggcgcctcatcgtcctgcaggtctagtcagacgcctacgtacacgagttgagtacgggaaacctccgtaccttaggaaccgtggattaccgagcgaacggcggacccgaacggcccaacccgtccggacggaccctacctttaaatttagtaaagtattttaaccgtaaggttaccgggtaccggttcccggggtaccaaggaaccagtacttacgaggtcggcgtaggttcggactacggctaacgtcgtacgtttcgacgtcgtagaagactcgagtcggagggtacggacggngtaggaggttagtcgttggttacgtttagttacgtcgtcctaggacgtaaggtacgttacttaccggtaggttaccgggccggttacgggtaccgggttaaccgggaaacccgggtaaacgggtaaacggtaacgggtaaaggttaaaccgtaaacggaaaccggttaacggttacggtccgggtacttaaccggccttaacccggtaacgtttcccg

SEQ ID NO: 211295 - DNA, 620 bp, Homo sapiens
  misc_feature: GYAE6OF01DFOP0.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagacgccttcgtacacagtgaagtgggaacaccgccttgaactggattcagcgagacggccaggacccaaccgtccgaggccgaccttaatttataagtatttactaagtcgggaacgttcccggggtaccagacagattacgaggcggactaggtgggtacacgggtctacgtgtactttcgacgtacttagaagtagtacgaggcgtaggggtaggaggcgtaggaggtagttgttggtacggttttattacgtgtccgtgtacgtaaggtagttagttcacgtcggtccgtggtacccggttacggacccggaaagggtacccgaaagggttacgaaacgtaacgaaacggtaacgtgggtacggtactaggacccacgtagttccg

SEQ ID NO: 211296 - DNA, 724 bp, Homo sapiens
  misc_feature: GYAE6OF01ENBOJ.26.26.C04.1.454.CMB.1.raw
tcagagactatactcacgaccggtgctcgatttagtctagcgacttttgggtttggggtgatcaggactcctcagttcaccttctcacaatgaggctccctgctcagctccgtggggctgctaatgctcgtcgggtcccagggtccaggtgggggattgtttgtgatgactcagtcctccgctcctccctcgcccgtctacccgttggacgacgggcgcctccatctcctgcaggtctagtcagacgtcctacgtacacgagtgagtacgggaaccacccgtccttagaacgttggacttacgagacgaaggacggaccgaacggaccccaaccgtccgggacggaccgtacctttaaattttaagtaaacgttactttacgtaacggttacgggtacgttccccggggtaccaaggacgtagtacttacgacggcggacgtagggttcgggtacacgggtactacgttagtacgtttaccgacgtacgtagaacgtagtacgaggacggtaggggtcgggaaggtcggtagggaggttagttcgggtttcggttacggttttacttcgtcgtcgtacgacgtaaggttagttactacgtacggttcgggtccggttacgggtaccggttaccggaaccggaaacgggtaacggtaaacgggtaacgtaaacgtaacgtaaacggtaacgtggtacggactacggaaccacgtgttccgttacg

SEQ ID NO: 211297 - DNA, 752 bp, Homo sapiens
  misc_feature: GYAE6OF01DHSEC.26.26.C04.1.454.CMB.1.raw
  modified_base (201)..(201): a, c, t, g, unknown or other
  misc_feature (201)..(201): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccaggtccagtgggatgttgtgatgactcagtctccgctctccctcgcccgtcacccgttggacnggccgcctccatcctcctgcgtaggtctagtcagacgcctcgtacactagtgagtacgggaacctacccgtccttagtaacttggtaactttcgagacgaggacggaccgacggacccaaccgtcccggacggtaccgtaacctttaagtttaagtaacgttaacttttacgtaaacggttccggggtaaccggtttcccgggggtacccaagtaccgtaacgtacgttacgacgggccggtcgtaagggttcgggtaacgaggtaccgtacgttagtactttaccgacggtacttaaggaacgtacgtacgaacggtacggtaggggtagggacgggtcgttagggtaacggttagtttcgggttaggtttaccggtttttaactaccggtcggtcgttacggacgtaagttacgttacgttccgtacgttcgggtccggttacgggtacccggttaccggaaaccggtaacgggaaccgtaaagggtaaggtaaactaaccgtaaaaccggtagttcggtacggactacgaaccgtaccgttcgttacg

SEQ ID NO: 211298 - DNA, 727 bp, Homo sapiens
  misc_feature: GYAE6OF01EGMR7.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagacgcctcgtacacagtgagtgggaaccaccgtccttagaacctggtacttcgagcgaggacggcccaagggaccccaaccgtccggagggccgtaccttaaatttataaagtacttttactaaagtcgggtacgttcccggggtacccagacagtacttcgaggcggagtaggtcgggtcagggcctaacgtgtactttccgaacggtactaggaaagtacgtacgaaggtcggtaaggggtacgggacgggtacgtagggtaacgggttagttcgggtttggttaccggtttttattaccgtcgtaccgttggactaggttaagttaacgttccgtaacgggttcgggtacccgggttacgggtaaccggtttacccgggaacgggtaaacggggtaacccggtaaagggggttaaggaaaaccgttacggaaaaaccgggttaccgttacgggttacgggtacctaccggaaccctaaccggtagtttacccg

SEQ ID NO: 211299 - DNA, 683 bp, Homo sapiens
  misc_feature: GYAE6OF01CT92C.26.26.C04.1.454.CMB.1.raw
  modified_base (204)..(204): a, c, t, g, unknown or other
  misc_feature (204)..(204): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctcctccctgcccgtcacccgttggacnggccggcctccatcctcctgctaggtctagtcagacgcctcgtacacgagtgagtcgggaactaccgcttagacgtggattcagacgagacggccacggcccaaccgtccgaggccgtaccttaagtttataacgtatttacgtaagtcggggtacgtttcccggggtaccaagtacgaagtacttacgacggtcggacgtagggtcggggtacacgggtactacgtagtaactttcgaacgtcgtaagaagtactacgaggacggtaggggtagggacggtcgtagggaggtagttggttacggttcggttttaagtcgtcgaccgtgacgtaggttacgttacgttcgacggttcgggacggttacgggtaccggttaccgggaaccgtaacggggtaccgtaaagggtaccgtaaacgtaaccggtaaaacgtacggttacggtacgggtacctagacccgtacgttacgttaccg

SEQ ID NO: 211300 - DNA, 765 bp, Homo sapiens
  misc_feature: GYAE6OF01DGTA1.26.26.C04.1.454.CMB.1.raw
  modified_base (212)..(212): a, c, t, g, unknown or other
  misc_feature (212)..(212): n is a, c, g, or t
tcagagactatactcacgaccggtgctcgatttagtctagcgactttgggtttggggtgatcaggactcctcagttcaccttctcacaatgaggctccctgctcagctccgtggggctgctaatgctcgtggtcccagggtccagtggggatgttgtgatgactcagtctccgctctccctgcccgtcaccgtggacaggcgcctcatctcngcagtctagtcagacgcctcgtacacgagtgaagtcgggaaccaccggtccttagaacgtggtaattccgagcgaggaggcccgaaggacccctaaaccgtccggaacggtccgtaaccctttaaatttagtaaacgtattttaaccgttaacgtaccggggtaccgttacccggggtacccaaggaaccgtagtaactttaccgaacggtccggtacgtaacgggttcgggtacgacggctaacgtgtactttccgaacgtccgtaaggtaagacgttacgaaggtcgggaaggggtgggtaagggtaccgttagggaggttaagttcggtttacgggtacggtttttagttaaccgtcggtacccgttaggaaccgtaggttaacgttcgttaccgaacggttcgggttacccgggtacgggttaccggttacccgggaaacccggtaaacgggggtaacccgtaaaggggttaaacggtaaaaccttaacgggaaaaccgttacgggttacggtcgggtacctacggacccacgttaacgtccggtttcg

SEQ ID NO: 211301 - DNA, 675 bp, Homo sapiens
  misc_feature: GYAE6OF01EXHEH.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctgggctgctaatgctctgggtcccagggtccagtggggatgttgtgatgactcagtctccgctctccctgcccgtcacccttggacaggccgcctccatctcctgcaggtctagtcagacgcctcgtacacgagtgatggaacaccgccttagaactggattcagcagacggccgacggcccaacccgtccggacggcccgtacccttaaattttaagtaaagttacttttacgttaaacgtcgggtaacgttacccggggtacccaaggactagtattcgaggcggcaaggttcgggtcgaggccacgttacgattttccgaacgtccgtaggtaaacgtaagtcgaacggtacgtaaggggtcgggtaagggtcctagggaaggtgttaggtttggtaccggttttaagtttacgtcgtctggacgtaggtagttaacttcgacgttcgggccggtagggtaccgttccgggtaccgaaacggggtaacccgtaagggtaggtaaacgttaacgaaaaccggtagttcggtacggacgttacgacctaccgtagttcccg

SEQ ID NO: 211302 - DNA, 709 bp, Homo sapiens
  misc_feature: GYAE6OF01AI1PS.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggccggcctccatcctcctgcaggtctagtcagacgcctcgtacacagtgatagggaacaccgccttgaactggacttcagcaggacggccgaggacccaaccgtccggacggccgacccttaaattttaataaacggtacttttacgtaaacgttccgggtacgtttacccgggggtaccctaggaacgaaggtaacttacgaacggccgggtacgagggttcggggtacgagggcctaacgttgtacttttccgaaccggtccgtaggaaacggataccgacggtacggtaagggggtacgggacgggtacgtagggaagggtagttaggtttcgggttacggtttttaacgttaccgttcggtcctcggtacgaggtacgttattaccgacgttcgggtaccggtggtaccgggttccggaaccggtaacgggtaaccggtaaagggtaggtaaaacgtacgaaaaccggtacgttaggtacggcgtacgcctaacgtgttaccg

SEQ ID NO: 211303 - DNA, 722 bp, Homo sapiens
  misc_feature: GYAE6OF01ER92N.26.26.C04.1.454.CMB.1.raw
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
  modified_base (487)..(487): a, c, t, g, unknown or other
  misc_feature (487)..(487): n is a, c, g, or t
tcagagactatactcacgaccggtgctcgatttagtctagcgactttgggtttgggggactgatcaggactcctcagttcaccttctcacaatgaggctccctgctcagctccgtggggctgctaatgctcgtgggtcccagggtccaggtggggatgttgtgatgactcagtctccgctcctcccgtcgtcccgtctacccgttggacgacggccggtcctccacttcctccgttggaccgtacgggttcctaggtccaagtacgtccctacgtacacgtaggtgaagtacgggaaacctacccggtcttaggaacgtggtacttcgaagcaggacggtaccgacggacccgaacccgtcggaacggtaccgtaacctttaaatttacgtaaacgttatttacggtaacgtcgggttacgtcccgggtccaagacagtntcgaggcgngaggtcgacgagctagtgtacttcgagtataggaactnacgagggtcggaggtggacggtacgaggtaggtattggttacgttacgtttacgtacgtcgttacgacgtacggtagtacgttactaccggttacgtaccgggtaccggttacgggtacggtacccggtaaaccgggaaagggtaaaccgtaacggggtaaacggttaaaccgaaacccggtaaacgttaccggtcggttaccgggacttaccgaccctaacggttcgttacccg

SEQ ID NO: 211304 - DNA, 737 bp, Homo sapiens
  misc_feature: GYAE6OF01C9N2V.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtacagtggggatgttgtgatgactcagtctccgctctccctgcccgtcacccgttggacacggccggcctccatcctccgtgctaggttctaggtccaggacgtccctacgtaacacaggtgacgtcgggaaaccaccggtccttagaaccttggtattccgaggacgaggacggacccaacggcccaaacccgtccggacggtccgtaccttaaattttataaacgttactttacgtaacggtcgggtacgttacccggggtaccagtacagtacgttcgagtcggcgtaagggtcggtacgacggtctacgttacgtacgtttacgaaccgtctaggtaacgtacgtacgaggacggtaggggtacgggagggtacgtagggtaggtacggttaggttcggttacggttttaacgtttacgtacgtccgttacggacgtaaggttaccgttacgttaccgtacgttccgggtaccgggtcggtaaccggttccgggaaacccggtaaagggaaccgtaaggggtaaccggtaaacgtaaccggtaaaacggtacggtacgtacgggtaccgacgacccgtacgtacgttcccg

SEQ ID NO: 211305 - DNA, 637 bp, Homo sapiens
  misc_feature: GYAE6OF01C3RYC.26.26.C04.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (243)..(243): a, c, t, g, unknown or other
  misc_feature (243)..(243): n is a, c, g, or t
  modified_base (274)..(274): a, c, t, g, unknown or other
  misc_feature (274)..(274): n is a, c, g, or t
  modified_base (464)..(464): a, c, t, g, unknown or other
  misc_feature (464)..(464): n is a, c, g, or t
tcagagactatactcacgaccggtgctcgatttagtctagcgactttgggtttgggggactgatcaggactcctcagttcaccttctcacaatgaggctccctgctcagctccgtggggctgctaatgcctcgtgggtcccagggtccaggtggggatgttgagatgactcagtcctccgctcctccctgcccgtnacccgtggacngggccgtcctccatctctgctaggtctagcaggacncctacgtaacacgagttgacgacgggaaccnccggtcgttagaaacgtggtaacttcgagccgaaggtacggacccaggtacccaaaccgtccggacgtaccgtaccttaaatttagaagtattttacgaaggtaccgggtacgtcccgggtaccaaggacagtactcgacggacgcgaggtcggtacacgggctacgtacgtattccgagtctaaggaancgtacgaggacgagggtggacgcgtaaggagtagtgttaggttaccgtttagtctcgactcgataaggtacgtacttcgacggtcggtacgtacggacggttccgaacggtaacggaacggtaggaagtaacggaacgtaacgtacgtcgtacggacacgcctatacgttccg

SEQ ID NO: 211306 - DNA, 745 bp, Homo sapiens
  misc_feature: GYAE6OF01AXW3C.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggccggcctccatcctcctgcaggtctagtcagacgcctcgtacacgaggtgagtagggaaccaccggtaccttaggaacctgggtacttcgaagtcgaggacggtccgaacgggacccctaaacccggtccggaacggtccgtaaccctttaaattttaacgtaaacggttacttttaaccgtaaacggttccggggtaaccgtttccccgggggtacccaaaggtaccgtaaggttacttaccggaggtccggacgtaagggttcgggtaccgaagggtacctacgttagtacgtttccgaaccgtcgtaggaacgtacgtacgaggtacggaggggtacggaggtcgtaggaggtagttggttacggtacggttttaacgtacgtcggtaccgtgtacgtaagtacggtacgttaccggacggttcgggaccgggttacggtacccggttacgggtaccgaacggggtaaccgtaagggtacgtaaagtaccgaaacggtacgttacgggtcgtaccgtacgtacccaacgttgtcgttaccgg

SEQ ID NO: 211307 - DNA, 722 bp, Homo sapiens
  misc_feature: GYAE6OF01BT0FM.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctcgtgggtcccagggtccaggtgggatgttgtagatgactcagtcctccgctcctccctcgcccgtcaccgttggacaggccgcctcatcctcgtgcgtaggtctagtcagacgcctcgtaacacgagtagagtcggaaccaccgtctagaacgtggtacttgacgacgaacgacgtccgacggacccaaccgtccggagtacctacttaaattagtaacgtacgttacgtaacggtcggtacggttcccgggacagacgagtattcgacggcggacgtagggtcgggtacgacggtacgtacgttacgtactttacgacgtcgttaaggaacgtacgtaccggaaggtcggggtaagggggttacgggacgggtacgttaacggggtaacgggtttacgggttttacggtttaccgggtttacgggtttaacgttaccgttacgggtacccgttaggtaccgtaaaggttaccggttacgttacggttccgggtacggtacccgggttacggtacccgtacgggaaaccgggtaccggtaaacggggtacggttaaaaccggg

SEQ ID NO: 211308 - DNA, 786 bp, Homo sapiens
  misc_feature: GYAE6OF01AG4G5.26.26.C04.1.454.CMB.1.raw
tcagagactatactcacgaccggtgctcgatttagtctagcgactttgggtttgggggtgatcaggactcctcagttcaccttctcacaatgaggctccctgctcagctcctggggctgctaatgctctgggtccaggtccaggtggggatgttgtgatgactcagtctccgctctccctcgcccgtcaccgttggacaggccggtcctcactcctcctgcgaggtctagtcagacgcctacgtacacgtaggtgagtacgggaaccaccgtccgttaggaacgtggacttcgacgacaggacggccgacggacccgtaaccgtccggacggtccgtaccttaaatttaataaagttactttacgtaacggtcggggttacgttccccggggtaccacgtacgagtacgttcgacggcggtacggtagggttcgggtacgacgggtacctacgttacgttacgtttccgaccgtacgtaggtaaagacgttacgaacgggtacggaagggggttgggaacgggtcgtacgggaagggttagtttgggtttacgttacggttttaagttccgttacggttccgtaggtaacgtaacggtagtttacgttaccggtacggttcggggtacccgggttacgggttaccggggtttacccggggaaccggttaaaccgggggtaaacccggtaaaggggttaaaccggtaaaacgttaaaccggtaaaaccgtaacggttcgggtacggtacggtacggtaaccccgaacggttacgttcccggttaccg

SEQ ID NO: 211309 - DNA, 619 bp, Homo sapiens
  misc_feature: GYAE6OF01CEPTA.26.26.C04.1.454.CMB.1.raw
  modified_base (424)..(424): a, c, t, g, unknown or other
  misc_feature (424)..(424): n is a, c, g, or t
tcagagactatactcacgaccggtgctcgatttagtctagcgactttgggtttgggggaggaactgctcagttaggacccagccggaaccatggaaaccccagcgcagcttctcttcctcctgctactctggctcccagattccaccgcagaaattgtgctgacgcagtctcccggacctgtctttgtctccaggggaaagagccaccctctcctgcagggccagtcagagtgttagcaactactatttagcctggtaaccaacagaagtctggccaggcctccccggctccctcatacctacggaacactcccgaaccgggccacgtcggcactcccgagacgtaggttcaggtcggctaggtggtctaggagacagacttcactctacactatcagcaagacgtggacgacgtagtaaagtntttacgacgtaggttagtattacgtagtcaagtctagtactcgtcttacctcgttaccgtttccgtagttaccgtttcgggaccgtaacggggtacctaggtacgtaggtactacgtaaccgaaacgtacgtcgggtacgtacgtacgaccgtacgtagttcctacgttacctacttacgttcccgttaaccccg

SEQ ID NO: 211310 - DNA, 761 bp, Homo sapiens
  misc_feature: GYAE6OF01B3281.26.26.C04.1.454.CMB.1.raw
  modified_base (206)..(206): a, c, t, g, unknown or other
  misc_feature (206)..(206): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctcgtgggtcccagggtccaggtggggatgttgtgatgactcagtctccgctcctccctgcccgtcacccgttggacgnggccggcctccatcctcctgcaggttctagtcacgacgcctcgtacacgagtgagtacggaaccaccgtccttagaacgtggtattcgagacgaggacggaccgacggacccaaccgtccggacggaccgtaccttaatttataacgttacttttacgtaacggttcggggtaccgttacccggggtacccaacggacgtaacgtagttaccggacggaccgggtacgtagggtcgggtaccgacggtaccgtacgtagttacgtttacgacgtacgtaggaacgtacgtacgacgggacggtagggggtacgggagggtaccgtagggtaacgggttaggtttagggtttacgggtttacggtttttaaacgttcgtaccgtccgtacggtagtaaggttacgtttacgtccgttacggtcgggtacccgggttacgggtacccgggttaacggaacccggtaaccggggtaacggtaacgggttaagaaacccgttacgaaaccggtaacggttcgggttacgggtacgtaccgaccgttacccgtgttaccg

SEQ ID NO: 211311 - DNA, 809 bp, Homo sapiens
  misc_feature: GYAE6OF01ADJY2.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctatgctctgggtcccagggtccagtgggatgttgtgatgactcagtctcgctctccctgcccgtcaccgttggacaggccgcctcatcctacgtgcgtagtctagtcaagcgtccttgacacaggtcgagtaggaaccaccggtccgttacgtaactcggacgtttcgacgcgaggacggccgtaggccaaccgtccggaggtaccgtaccttaatttaacgtaagtacgttttacgtaacgtccggggtacgttccggggttacccaacggtacgtacgtaacgttcgaacgggtccggtacggtaacgggttcggggtaccgtacggggtaaccctacgttacggttaacgtttttcccgaaccgggttaccgttaaggaaacggtaaccgttcggtaaacggtacccgggttaagggggttacggggaaccgggttcggtaacgggtagggttacggtttgggttaacggttacgggtttaacgtttaccgtaccgttccgtacggttacgtaacgtaggtttaacccgtacggtacggttaccgggtacccggtacggggttaaccggttcgggtaacccgggaaacggtaacccggttaaacggggtacggttaaaaccggtcccgtaaaaacggtcgtacggttacggtacgtaccggaacccttcgtacgtttaacccgg

SEQ ID NO: 211312 - DNA, 773 bp, Homo sapiens
  misc_feature: GYAE6OF01BP9M1.26.26.C04.1.454.CMB.1.raw
  modified_base (177)..(177): a, c, t, g, unknown or other
  misc_feature (177)..(177): n is a, c, g, or t
  modified_base (227)..(227): a, c, t, g, unknown or other
  misc_feature (227)..(227): n is a, c, g, or t
  modified_base (258)..(258): a, c, t, g, unknown or other
  misc_feature (258)..(258): n is a, c, g, or t
tcagagactatactcacgaccggtgctcgatttagtctagcgactttggggtttgggggactgatcaggactcctcagttcaccttctcacaatgaggcctccctgctcagctccgtggggctgactaatcgctcgtcgggtcccagggtccaggtggggattgttgtgatgactcngtcctccgctcctccctcgtcccgtcaccgtggacgcggccggtcctacntcctccgtagcgtaagttcagtccaagtccnccgtacgacacgtgagtacgtacggaacctccggtacttagaacgtggtaactcgaacgacgagacggacccaacggacccctaaccggcggtacgtacgtaactttaaattacggaacttactttacgacggttaccgggtaaccggtcccggtaccaagaacgtaagtcgtacggacgcgggtactagggtcggaaccgtacgcttaacggttattccgtacggaccgagtaacgaaggtctacgagtcgggtaaggggtcggaacggtcggaggttaagggtcgttaggggtttaccggtttacggttttaacgtaccggttccgacgttaaccggaggtttaaaccgaacggggttttcttacggggaccgtttccggggcgtttaacccggggtacggttaaacccggggacggtaaaaccggggtacggtaaaaccgggtaagtttaaaccggaaaccggtaggttaacgcgggttcggaccgttagacccgttaaagttcgttaaccg

SEQ ID NO: 211313 - DNA, 749 bp, Homo sapiens
  misc_feature: GYAE6OF01EP8A3.26.26.C04.1.454.CMB.1.raw
  modified_base (236)..(236): a, c, t, g, unknown or other
  misc_feature (236)..(236): n is a, c, g, or t
  modified_base (308)..(308): a, c, t, g, unknown or other
  misc_feature (308)..(308): n is a, c, g, or t
tcagagactatactcacgaccggtgctcgatttagtctagcgactttgggtttgggggactgatcaggactcctcagttcaccttctcacaagtgaggctccctgctcagctcctggggctgctaatgcctcgtcgggtcccagggtccagtggggatgttcgtgatgactcagtctccgctctccctgcccgtcaccttggacaggcgcctccatctcctgcaggtctagtcagncctcgtacacagtgatgggaacaccgcttgaactggatcagcagagcaggccaactcgaggcgcctaattanaagtatttctaatcggattccggggtcccagaccagtacttcagtcggctaggtcggtacacgggactaaccgtggtaacttttccgaacgtccgttaggaaacgtacgttaccgaaggtacccgtaaagggggttcgggaggggtacccgttaggggtaaccgggtaagtttcgggtttcggttaccgggtttttaaacgtttaaccgtcggtaacccgttcggacccgtaaggttaacgttaacgtttacgtaacccggttcggggtacccggtttaccgggaccggttttacccggggaaccccgttaaaagggggaaccccggttaaaaggggttaacggggtaaaaacgttaacccggaaaaaaccgggttaaaccgttcgggttaccgggttaacccgttaccgacccggtaaacccccgtaaggtttaccccgg

SEQ ID NO: 211314 - DNA, 802 bp, Homo sapiens
  misc_feature: GYAE6OF01CXJPT.26.26.C04.1.454.CMB.1.raw
  modified_base (226)..(226): a, c, t, g, unknown or other
  misc_feature (226)..(226): n is a, c, g, or t
tcagagactatactcacgaccggtgctcgatttagtctagcgactttgggtttggggtgatcaggactcctcagttcaccttctcacaatgaggctccctgctcagctccgtggggctgctaatgctcgtcgggtccgagggtccaggtgggattgttgtgatcgactcagtcctccgcctcctccccgtcgcccgtcctacccgttgggaacgcggccgcctccntccgtcctgctggtctagcagtcgtcctacgacacgtaggtacgaaggtacggaacctaccgtccgtttagaaccgttggtacttacgacgacgacggacggacccgaacggccccgaacccgtaccggacgtccgttaacctttaagttaacgttaagtacttttacgtaacggtccgggtacgttaccccggggtaccacggtaacacggtattaccggaggtaccggacgtaggtcgggtaccagggtacctacgttcgtttaaacgttccgacggtacgtaaggtaacgtacgttaccggaaggtccggggtaagggttacggaacgggtgtagggtacggtaaggttggtttccgggtttacgtttaacgtcgtcgtacccgtaggtaaccgaagttacggttattccgggtaaccgtcgggtttccggtacgggtacgggtaccgggaaccgggttaaaccggggaaaccgttaacggggtaaacgttaaaacgggtaaacaaccgggttaaagtccggggtacggtaaaacctcgggacccttaaacccggcgtttcgtttaaccccgg

SEQ ID NO: 211315 - DNA, 891 bp, Homo sapiens
  misc_feature: GYAE6OF01EY8KF.26.26.C04.1.454.CMB.1.raw
tcagagactatactcacgaccggtgctcgatttagtctagcgacttttgggtttgggggagataaaagctcagctctacccttgccttgactgatcaggactcctcagttcaccttctcacaatgaggctccctgctcagctccgtggggctgctaatgctcgtcgggtcccgagggtccgaggtggggattggttgtgatgactcacgtctccgcctcctccctcgcccgtcctacccgttggaccgacgggccgcctcctattccctccgtcgcgtaggttccttaggtacgaacggacgtcccgttacgtaccaacgtagggtacgaaggtaacccggggtaaaccaccccgggttaccttaacggtaaccggttcggtaacgttaccgaaggaccggaacgggaaccggacccggaaccggtaccccgtaaaaccccggttccgggaaccggtccgttaaaccgttttaaaattttaaacggtaaacgttacgtttttaaccgtaaacgggtttcccgggggtaaccgggttttacccccggggggtaacccctaaaggttaaccgaaaggtttaccttaccggacgggccggtaacggtacggggttcgggtacggacgggtacccgttaacgttaggttaccttttaacccggaccgggtacgtaacgaaacgggttacctaggtaacgggcggggtaagggggttacgggtaccggggttaggtacggggtaagggttagggttttacgggtttacgggtttaacgggtttttacttccgggtacggttccgtaggtacgttaggtacgtttacgtccggtacggtcgggtccggttacggtaccggttacggaaccggaacggggaaccgtaaagggtaaccg

SEQ ID NO: 211316 - DNA, 785 bp, Homo sapiens
  misc_feature: GYAE6OF01CVH6A.26.26.C04.1.454.CMB.1.raw
tcagagactatactcacgaccggtgctcgatttagtctagcgactttgggtttggggtgatcaggactcctcagttcaccttctcacaatgaggctccctgctcagctccgtgggctgctaatgctctggtcccagggtccaggtggggatgttgtgatgactcagtctccgctctccctcgcccgtcctacccgttggacagggccgcctccacttcctccgtgcgtagttctagtcagacgtcctacgtacacgtaggtgaagtacgggaaccaccgtccttagtaaacctggtacttacgagacgaaggtacggacccgaacggaccccaacccgtcggacggtaccgtaacctttaaagtttactaaagtacttttacgtaacggtaccggggtaccgttaccggggtacccaaggtaaccagtaacttacgaggtcggacgtagggtacgggtacgaacgggtctacgtcggttaacttaccgaacgtcgtaaggaaacgtagtccgaagggtcggaaggggtcgggtaaggtcgtagggtaacgggtcggtttcgggttacggtttacggttttaacgtaccgttcggtaccgttaggacgtaaggttaacggtttactacggttacggttaccggggtaccggttacgggtaccgggttacgggaaacccggtaaaccgggtaaccggttaaaagggtaacggtaaaacgttaaaaccggtaaaaccgggtacggttaggacggtacgtacgtaccgtaacttaccggtcgtttaccg

SEQ ID NO: 211317 - DNA, 721 bp, Homo sapiens
  misc_feature: GYAE6OF01AWXLW.26.26.C04.1.454.CMB.1.raw
  modified_base (162)..(162): a, c, t, g, unknown or other
  misc_feature (162)..(162): n is a, c, g, or t
  modified_base (216)..(216): a, c, t, g, unknown or other
  misc_feature (216)..(216): n is a, c, g, or t
  modified_base (708)..(708): a, c, t, g, unknown or other
  misc_feature (708)..(708): n is a, c, g, or t
tcagagactatactcacgaccggtgctcgatttagtctagcgactttggggtttgggggactgatcaggactcctcagttcaccttctcacaatgaggctccctgctcagctcctggggctgctaatcgctcgtgggtcccagggtacaggtgggatgttgngatcgactcgacgtcctccgcttcctcccgtcgcccgtacacccgttgggaccncgggtccgtcctccgtatccgtccgtgaccgtaacggttctaggtacgacgtacgtccgtacggtacacgtagtcggacgtacgggaacctaccgtcgttacggaaccgtcggtacttacgacgaccgacggacgaccgacggtacccaccgtccggagtaccgtactttaagttactaacgttacttacgtacgtccggtacgttcccgggtacacgacgtacgtacgtacgacggtcgtacgtaggtcggtacgacggactacgtcgtacgttccgacgtgtacgaacgtacgtacgtacggtacggtagggtagtacgtagtacggtaggtgttcgtacggtttcgtttaactcgtcgtcgtgtacgtagttactcgttacgtcgggttcggacggtacggtaccggtaccggtaaacggaacggtaaccgtacgggtaaacgaacgtaacggtaaccggttcgttacggtactacggtactacccgtnttcgtttacccgg

SEQ ID NO: 211318 - DNA, 861 bp, Homo sapiens
  misc_feature: GYAE6OF01AQ2Q9.26.26.C04.1.454.CMB.1.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
tcagagactatactcacgaccggtgctcgatttagtctagcgactttgggtttgggggactgatcaggactcctcagttcaccttctcacaatgaggctccctgctcagctccgtggggctgctaatgctcgtgggtcccagggtccaggtggggattgttgtgatgactcagtctccgctcctccctgcccgtcaccgttggacaggccgcctcntctcctgcnggtctagtcagacgtcctcgtacacgagtgagtacggaaccaccgtccgttagaacctggacttcgacgacgacggacggtccgaacggtacccgaacccgtccgggacggtaccgtacctttaaacgttttaagttaaaacgtacgttttaactaaacggttaccgggttaacggtttacccggggtacccaaggtaaccgtaacgtacgttacggaacggccgggtacggtaacggttcggggtacggtacgggtaccgtacggttacgttaactttcccggaacgtcgttaaggaaacggtaccgtacgtaacggtacgggtaacggggtacgggacgggtacggtagggtaacggttggttacgggttttacggttacgggtttttaacttaccggtttacgtacccgttacgggaacgttacgggtaacgtttacgtttaccggtacggttccggggtacccgggttaacggggttacccgggttacccgggttaaaccgggggaaaaccggggttaaacccgggtaaacggggtaaccgggtaaaaaccggttaaacggtaaaacccggttaacgggtacgggttaacggtaccgttaacggtaacccgtaaccgttacggtttaaccgg

SEQ ID NO: 211319 - DNA, 638 bp, Homo sapiens
  misc_feature: GYAE6OF01BGLBW.26.26.C04.1.454.CMB.1.raw
  modified_base (400)..(400): a, c, t, g, unknown or other
  misc_feature (400)..(400): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacaggtgatagggaacaccgccttagaactggattcagcagaggccagccaacctccgaggcgacctaatttactaagtatttacttaaagtcgggtacgttccggggtccctagacagattcagcgcagtgggtcaggcatgattcacgctaggaanatcagcgagggtggaggctaggaggtacgtggttacggtcgttttaacgttacgtcgtaccgttgacgtaacggtaagttaacgtttaccgacgttcgggtacccggttagggtaaccggtttaccgggaaacccggtaaacgggggaaacccgtaaaaggggttaacgggaaaacgttaaccggaaaaacgtaaacggtgggttacggacgtaccggtacccgaacgtccgttaccg

SEQ ID NO: 211320 - DNA, 726 bp, Homo sapiens
  misc_feature: GYAE6OF01DXBKA.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctccgtggggctgctaatgctcgtcgggtcccagggtccaggtggggatgttgtgatgactcagtcctccgctcctccctcgcccgtcctacccgttggacacggccgtccctcctactctcctgcgtaggtctagtcgagcgtcctccgtacacgagtgagtcggaacctaccgtccgttacgaacgtggtacttacgacgacgaggaccggcccgacggacccgtaacccgtccggacggtaccgttaacctttaaagtttaacgttaaacgtacttttaccgtaaacggtttaccggggtaccggtttaccccggggaccctaagtaccgtaagttacgttacgacgggtcggtacggtacgggttcggggtacgacgggtctacgtgtaccgtttacgaccgtcgtaaggagtacgtcgtacggcggtaggggttgggacggtacggtaggtacgggtagtttcgggtttcggttacggtttagttacgtcgtacgtacgtagtacggttagttacgtacgtacggtcggtaccggtacgggtacggtaccgggaaggacgggtaaccggtaagggtaaacgg

SEQ ID NO: 211321 - DNA, 753 bp, Homo sapiens
  misc_feature: GYAE6OF01A80HG.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtgggatgttgtgatgactcagtctccgctcctccctgcccgtcacccttggacaggccggcctccatctcctgcaggtctagtcagagcctgtacacagtgagtgggaacacgccttagactggattcagcagacgccaggccaacctccgaaggcgtacctaatttagtaagtatttacgtaagtcgggacgttccgggtacccagactagtacttcgagcggacgtaggtcgggttacagggcctacgtacgtacgtttaccgacgtacgtagaaagtactacgacggtaccggaaggggttcggaagggccgttagggaagggtagttacggtttcgggtaccggtttttaacgttacgttacgggtacccgttaggtaccgacggttagtttaaccgtttacgtaccggttacggggtcccgggtttacgggtaaccggggttaccgggtaacccgggtaaaaccgggggttaacccggtaaaacgggggtttaacgggaaaaacccggttaccggtaaaaaaccgggttaacccgggttacgggttacccgggtaaccggttaccggtaacccgtaaccccgggttaactttaaccccggg

SEQ ID NO: 211322 - DNA, 858 bp, Homo sapiens
  misc_feature: GYAE6OF01BLL0P.26.26.C04.1.454.CMB.1.raw
  modified_base (603)..(603): a, c, t, g, unknown or other
  misc_feature (603)..(603): n is a, c, g, or t
tcagagactatactcacgaccggtgctcgatttagtctagcgactttgggtttgggggactgatcaggactcctcagttcaccttctcacaatgagctccctgctcagctccgtggggctgctaatgctcgtgggtcccagggtccaggtggggattggttgtgatgactcacgtcctccgccttcctcccgtcgccccgtctaccgttaggacgacgggccgcctacctacttcctccgtggacgtacgggttctaacgtcaacggtaccgtcccgttacgtaaccaacggtaggtacggtaacggtaccgggaaaccctccggtaccgtttaaggaaccgttacggtacttacgaacggacggaacgggaccggtacccgaaccgggtacccctaaacccggtccggaacggtacccgtttaaaccttttaaaagttttaacgtaaacgtttaacgttttaccggtaaacgggttccgggttaaccggtttaccccggggaaccaacggtaacgtacgtaacgttacggaacggtccggacggtagggtcggtaaccgaggtaccttaggttacgtcgttaccgacgtacgtaaggtaaanacgttacgacggtagggtagggttggaacggtcggtaaggtaacggttggtttcggtttacggttaccggttttaattccgtgggttaccgtacgtagttaacgtacggtttacgttacggttacgggtccgggttacggtcgggttaccggtaaccgggaaaccggaaacgggtaaccggttaaaggaaccggttaaacgtaaaccgaagggttaaccgtgggttaccgacctacggaccttacgttcgttcgg

SEQ ID NO: 211323 - DNA, 783 bp, Homo sapiens
  misc_feature: GYAE6OF01EXAQP.26.26.C04.1.454.CMB.1.raw
tcagagactatactcacgaccggtgctcgatttagtctagcgactttgggtttggggtgatcaggactcctcagttcaccttctcacaatgaggctccctgctcagctccgtggggctgctaatgctcgtgggtcccagggtccaggtggggatgttgtgatgactcagtctccgctctccctcgcccgtcacccgttggacaggccgcctccatctcctgcgaggtctagtcagacgcctcgtacacgagtagagtacgggaaccacccggcttagaactggtattcgagcgaggacggaccacggccctaaccgtccggacggaccgtaccttaaattttaacgtaacgttacttttacgtaacggttcgggtacgttccccggggtacccaagtaacgacgtacttcgacggcggacgtagggtacgggtcgaacggtacctacgttaggtacttttacgacggtacgttacggaaagtacgttacgaacggaccgggtaagggggttacgggtaacgggtacggtaagggttacggggtaaggtttcggttttacgggtttacgggttttttaacgttacggttccggttaccgtcgggtaacgtaacgggtaacgtttacgttaccggtaaccgggttcgggtccggtttagggtaacccgggttacccgggaacccggtaaacgggggaaaccggttaaacggggtaacggtaaaagtaccggtaaaacgtacggtacggtacggtcgtacgtaaccgtacctacgttcgtttaccg

SEQ ID NO: 211324 - DNA, 739 bp, Homo sapiens
  misc_feature: GYAE6OF01C0TR4.26.26.C04.1.454.CMB.1.raw
  modified_base (219)..(219): a, c, t, g, unknown or other
  misc_feature (219)..(219): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctcgtgggtcccagggtccaggtgggattggttgtgatgactcgagtcctccgctctccctcgcccgtcaccgttggacgaggccgcctacntctccgtgctaggtctagtcagtcgcctacgtacacgtaggtgacggtacggaacctacccggtcgttacgaacgtggtaactccgaagacgaacggaccggccgaacggtacccaaaccgtccggaacggtaccgtaacctttaaaatttaacgtaaagttaccgttttacgtaaaccgggttccgggtaaccggtttaccccggggtacccaaacggtacgtaacggttacctttaccggaacgggccggtacgtacgggtcggtacccgaggtacctacgtgttacttcgacgtacgtagaagtacgtcgaaggcggtaggggtaggtacggtcgtagggtacggtagtttggtacggtttacggttttacgtaccgttggtaccgtagtacggttaaggttacgttcgtacgtacggttaccgggtccgtacgggtaccggttaccggacgtaagggtaaccgtaaggtaacgaactaacgaacgtacgtggtaccgatacgacctgtcgttaccg

SEQ ID NO: 211325 - DNA, 981 bp, Homo sapiens
  misc_feature: GYAE6OF01EDDGQ.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgacggcctccctgctcagcgtccgtggggctgacttaatgtccgtcgttcgggtacccgagggtcccgtaagggtggggtagttggtttgtagagttcgtaccttcgtacgttcctcccggtccttcccttccccgtcccgtcccccgttacccgtaaccccggtttacgggaacccggtaccggggtccccggttccccttacccgtaacctttccccgttacccgttacggtacccggttacggtttaacccgtaaggtaaccgaacggttacccggtacccccgttaacggtaaccgaaaggtacggtaacgggtaacgggttaacccggggaaacccccgttaacccgggttaccggtttaacggtaaaccggttaccgggttaacgtttaccggaaccggacgaaaccggggaccggaaaccccggaccggtaaccccccgtaaaccggccgggaaccggtaaccgttaaaccttttaaagtttaacgtaacgtttacggtttaacgtacgggttacccgggttacccggtacccgggtaccgaacggtacggtaacgttacgtaccggaccgggtaggtacggtaacggggttcgacgtaacgggtactacgtacggtttaacctaccgggaacgttagtaaggtacgaggttacgggaccgggtagggtacgggtaacgggcgtaaggtaggggtacgtttaaccgggttttgtttacggtttaacccggtttattcccgtcggtaccgttggaacttaaggtttaccgtgttaccggtcgggttacccgggtcggttaacgggtacccgggtaacgaaacggggaaacggtaaacgggtacggtaaaagg

SEQ ID NO: 211326 - DNA, 715 bp, Homo sapiens
  misc_feature: GYAE6OF01BYI0W.26.26.C04.1.454.CMB.1.raw
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccaggtgggatgttgtgatgactcagtcctccgctcctccctcgcccgtcacccgttggacaggccgcctccatcctctgcaggtctagtcagacgcctagtacacagttgagtgggaaccaccgccttagaactggacttcgagcgagacgacacggccaaccgtcgagcactaattanaagtnttactaagtcggtacgtccgggaccagacatagtcgaggacggcgtagggtcgggtacgacgggtactaacgtacgttaactttacgaacgggtacgttaacgggaaataacggtacccggaaggaccgggtaagggggtacgggaaacgggttcggtaagggtaagggttaagttcggttttaaggggtttaaccggttttttaacgttaaccggtcggttaacccgtaggtaaccgtaagggttaacgttaaagtttccggtaaccggtttcgggacccgggttaaggggtaacccgtttaccggggaaaccccggaaaagggggtaaaccccggtaaaagggttaaaaacgggg

SEQ ID NO: 211327 - DNA, 746 bp, Homo sapiens
  misc_feature: GYAE6OF01D9HYE.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctccgtggggctgactaatgctcgtcgggtcccagggtccgaggtggggattggttgtgatgactcacgtcctccgcttcctccctcgcccgtccaccgttggacgcggccgcctcattcctcctgcgagtatacgtcgacgcgccttacgtacacgagtagacgtacggaacctaccgtccgttaggacgtaggtacttacgacgacggaggaccggaccgacggacccctaaccggtccggacggtccgtaactttaatttaagtaacccccgttatttacgtaacggttccgggttacggttcccgggtaccgaacggtacaaggtacttacgacgggtcggacgtagggtacggtcgtacggactacgtacgttacgttaccgacgtcgtaagacgtagtacgacggtcgggtagggtaggacggtaggtaggacgggttagttgggtttacggtttacggttttacgttacgttcggtacctaggacgttaacggttacgtttacgttacggtaccggggttaccgggtaccgggtttacggggtaccgggttacccgggaaaccgggtaaaccggggtaaccggttaaaggggtaaaccgg

SEQ ID NO: 211328 - DNA, 800 bp, Homo sapiens
  misc_feature: GYAE6OF01CRQAE.26.26.C04.1.454.CMB.1.raw
tcagagactatactcacgaccggtgctcgatttagtctagcgactttgggtttggggtgatcaggactcctcagttcaccttctcacaatgaggctccctgctcagctcctgggctgctaatgctctggtcccagggtccagtggggatgtgtgatgactcagtctccgctctccctcgcccgtcacccgttggacgaggccggtcctcatcctcctgcgaggtctagtcagacgtcctgtacacgtagtgagtagggaaccacgtccttagactggattcgagcgaaggacggccaggcccaaccgtccggtagccgtacctaactttaagtaaacgtacttttacgtaacgttacgggtacgttacccggggttacccaaggaaccgtaagtacgttaccgaaggtaccggacgtaacggttgggacgtaacgggccgtaaacgttacggtacttttcgaccgtgtacggaaagtacgttacgaacgggtacgggtaaggggttacggaggggtacgtaaggagggtacgtttaggttaccgggttaacgggttttacgtttacgtacggtccgttaccggaaccttaagggtaactttaccggtttaccgtaaccgggttcccgggtaccgggttcggggttaacccgggtttaacccggtaccggggtaaaaccgggtaacccgggtaaaagggttaaaccgggtaaacgttaaaacccgaaaaccgggttaaccgttaacgggggtccgtaacggttaccgaacccggtaaccgttaccgttccggttaacccgg

SEQ ID NO: 211329 - DNA, 755 bp, Homo sapiens
  misc_feature: GYAE6OF01COLCM.26.26.C04.1.454.CMB.1.raw
  modified_base (209)..(209): a, c, t, g, unknown or other
  misc_feature (209)..(209): n is a, c, g, or t
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (303)..(303): a, c, t, g, unknown or other
  misc_feature (303)..(303): n is a, c, g, or t
tcagagactatactcacgaccggtgctcgatttagtctagcgacttttgggtttgggggagataaaagctcagctctacccttgccttgactgatcaggacctcctcagttccacctttctcaacaagtgaggcctccctgctcagctccgtggggctgataatgctcgtcgggtcccgagggtccaggtgggattggtgtgatgactnacgtccncgtctccnccctcgcccgtccaccgtggaacgcggccgtacctaccactcgtcctggcgtaggtctagcagacgtacctacgtacanagtgagtacggaacctaccgtacgttagaacgtgatcgaagcgaagacgcgacgacctaccgtacgagccgtaacttaaagttaataacgtattacgtaacgtacgggtacgtcccggtacagtacaggtaactcggagacggtagagggtcggtacgagggtacccaagttacgttaccgttacgaaccgtacggaaggaaagttaacgaccggtaaagggtcgggtaaagggggtagtaacggggttcgaacgggtaaggttagggtttaacggtttaacgggtttaacggttttaacgttacgttcggtacccggtacggtaacggtaacgttaaggtttaaccttccggtaaccgggtacggggtaccgggttaacccggggtaccggggtttaaaccccggggaaccgggtaaaacggggtaaaccggtaaacgggtaaaaaccggg

SEQ ID NO: 211330 - DNA, 765 bp, Homo sapiens
  misc_feature: GYAE6OF01E0NF0.26.26.C04.1.454.CMB.1.raw
  modified_base (564)..(564): a, c, t, g, unknown or other
  misc_feature (564)..(564): n is a, c, g, or t
tcagagactatactcacgaccggtgctcgatttagtctagcgactttgggtttggggtgatcaggactcctcagttcaccttctcacaatgaggctccctgctcagctccgtggggctgctaatgctcgtgggtcccagggtccaggtggggatgttgtgatgactctagtctccgctctccctcgcccgtctacccgttggaccaggccggcctccatcctcctgcaggtctagtcagacgcctacgtacacgtaggtagacggtacgggaaccacccggtcctttaggaactggtacttacgagacgaacggacggacccgaacggacccctaaaccggtcccggaacgggtacccgtaacctttaaatttttaaacggtaaacgttaacgtttttaaccgtaaaacgggtttacccggggtaaccgttttaccccggggggtacccaacggtaaccgtaaggtactttacgacgggaccggtacgtaaggggttcgggtacagggtccaacgtgtacgtttacacgtctaagaacgtactcgaggcggagggtacggaggntagggagtgttacggttcgtacggtttattacgtcgtacgtagcgtaagtacgttacgttacgacggttcgggtaccggtacggttacggttaccggaaccggaaagggtaaccgtaaaggggtactaaaaggttaaccgaaaacggttaccgtgggtaacggtacccgttgaaaccccgtacgttaacgtccggtttacg

SEQ ID NO: 211331 - DNA, 800 bp, Homo sapiens
  misc_feature: GYAE6OF01B92X4.26.26.C04.1.454.CMB.1.raw
tcagagactatactcacgaccggtgctcgatttagtctagcgactttgggtttggggtgatcaggactcctcagttcaccttctcacaatgaggctccctgctcagctcgtgggctgctaatgctctgggtcccagggtccaggtgggatgttgtgatgactcagtctccgctctccctcgcccgtcacccgttggacaggccggcctccatcctcctgcaggttctaggtcagacgccctacgtacacgtagtagagtacgggaaccaccgtccgttagaacgttggtactacgagaccgaaggacggacccgaacggacccaaccccggtccggacggtacccgtaaccgttaaaattttacgaaacgtacttttaccgtaaacggttccggggttaacgttaccccggggtacccaagggaaccgtaaggtaacgtttacccggagggtacccggggtacgtaacggggtttacggggtacccaacgggggtacccttaacggtttacggttaaaccgtttttcccggaacggttacgttaagggtaaaacgtacgttaccggaacgggtacgggtaaggggggtaacgggtacgggtccgttagggtaacggttagttttacgggtttcgggtttacgggtttttaacttacgtcgtaccgtggtaaccgtaggttacgttacgttccgacggttcgggtaccggtacggtaccggttccggaaccggtaacgggaaccggtaaggtaacggtaaagaaccgaacgttacgtgtacggctcgaccactgtcgtccg

SEQ ID NO: 211332 - DNA, 976 bp, Homo sapiens
  misc_feature: GYAE6OF01DIE2J.26.26.C04.1.454.CMB.1.raw
tcagagactatactcacgaccggtgctcgatttagtctagcgactttgggtttggggactgatcaggactcctcagttcaccttctcacaatgaggctccctgctcagctcctggggctgctaatgctcgtgggtcccaggtccaggtgggattgttgtgatgactcagtcctccgctctcccgtcgcccgtcacccgttggacacggccgtccctccatcctcctgaccgtacggtcttacgtacaggacgtcccgttaccgtaacacgtagtagaacggttacgggggaaaaccctacccggtacccttttaaggaaacccgtttggggtaacttttacccgaacggtcccgaaacggggaaccgggaccccgaaccgggtaccccccctaaaacccggttaccccggggaacgggtccccggttaaaccccgttttaaaagttttttaacgttaaaaccggtttaacttttttaaccggtaaaacggttccccggggttaaaccgggttttcccccgggggttaacccaaacgtaaccggtaacgtaacgttttaccggaaccgggtaccggggtacgttaacggggtcggggttaccgacgggtacccgtaacgttaggtaccttttaccggacggaccgtacggtaaacgtacgttacggaacgtaccgggtagggggtacggtaaacggtcggttagggtacggttaaggtttcggtttacgggtttcggtttttaaacgttcgttaccgggttccgttaacgacggttaacggtaacgtttacgttaccggttaacggttcccggggttaccggttacccgggttaacccggggttcccggaaacccgggtaacggggtaaaccccgggtaaaacggggttaaccgggtaaaacgttaaacccggtaaaaacccggtacggttaccgggtacggtcccgttaccgaccgttaaccggtctttacccggg

SEQ ID NO: 211333 - DNA, 773 bp, Homo sapiens
  misc_feature: GYAE6OF01BTRS7.26.26.C04.1.454.CMB.1.raw
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
tcagagactatactcacgaccggtgctcgatttagtctagcgactttgggtttgggggagaataaaagctcagctctacccttgccttgactgatcaggacctcctcagttccaccttctcacaatgaggcctccctgctcagcctccgtgggctgactaatgcctcgtcggtcccgagggtccaggtggggattggttgagatgactcgagtcctccncttcctcccncgcccgtcctacccgttgacgcggccgccttcacttcctctcgacgtacgttacgtaacgtcgacggtacgccctacgtaacacgagtagacggtcggaaccctaccgtctacgaacgtgtacttacgagacgagaccggaccaacggaccctaacgtcggaacggtccgtaaactttaaagtttaaacgaaacgttacttttaaccggtaacggttccggggtaaccggttaccccggggtaaccaaagggaacctaaggtactttcggaacgggcggaacggtacgggttacgggtacggtaacggtacgtagttacgtaacgtttaccgacgttaaccgtaagaaacgtactacggaggtagggtaacgggtaggacggttacgtagggtaagttcggttacgtttacggttaacgtttacgtaccggttccgtacgtagtaaccgtaggtaacgttagttacggtacccggtcgggttccggtaacggttaccgggtacccgggtaaccggaaacgggtaaacgggtaaacggtaaacgg

SEQ ID NO: 211334 - DNA, 697 bp, Homo sapiens
  misc_feature: GYAE6OF01CP5UO.26.26.C04.1.454.CMB.1.raw
tcagagactatactcacgaccggtgctcgatttagtctagcgactttgggtttggggtgatcaggactcctcagttcaccttctcacaatgaggctccctgctcagctccgtggggctgctaatgctctgggtcccagggtccaggtggggatgttgtgatgactcagtctccgctcctccctgcccgtcacccgttggaccaggccgcctccatcctcctgcaggttctagtcagacgtcctcgtacacagtgagtcgggaacaccgtccttagaaccgtggattcgagcgaggacggcccacggacccctaaccgtccgacggaccgtaccttaaattttaacgtaaagtacttttacgtaaacggttcgggtaccgttacccggggtacccaaggaacctagtacttcgaacggcggacgtaggtcgggtcgacggctacgttcgtactttcgacgtctagaagtactcgaggcgagggtgacggtcgtggaggtgttggttacggtacgtttacttacgtcgtaccgtgactaaggtacgttacgtaccgtaggtcgggttaccggtcgggttaacccggttccgggaaccggtaaacggggtaaccgttaaagggtaacggtaaagttaaccggtaaaaccgtacgggttaggtccggaacgttccgaccttaaccgtgtttccgttaccgg

SEQ ID NO: 211335 - DNA, 639 bp, Homo sapiens
  misc_feature: GYAE6OF01EXXXI.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagacgcctcgtacacagtgagtggaacaccgccttagaactggattcagcaggacggccgacggcccaaccgtccggacgggccgaccttaatttaataagtatttactaagtcgggtacttccggggtcccagacagacttcgagtcggcgaggtcgggtcgaggcacgttgtacttttcgacgtacgtagaaacgtagtacgaggtcgtaagggggtaggagggtcgtaggaaggtagtttggtttaggtacgggttttattaacgtcgtaccgtgacgtaggtagttacgttacgtacgttcgggtaccggtcggtaccggttaccggaccgtaaaggggaccgtaaaggtacggaaagtaccgaaaacggtacgtggtacggtcgttacgacctacgtagtcgttacg

SEQ ID NO: 211336 - DNA, 730 bp, Homo sapiens
  misc_feature: GYAE6OF01A9MCU.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctccgtggggctgctaatgctcgtgggtccagggtccaggtggggattgttgtgatgactcagtcctccgcctcctccctcgcccgtctacccgttggacgcggccgcctcatcctcctgctaggtctagtcgagcgtcctacgtacacgaggtgacggtacgggaaccctaccgtcgttagaacgtggtacttcgacgacgacggacggccgacggaccctaaccgtccgggaacggccgtaacctttaaatttaactaacggttactttacgtaacggtccgggttacggttcccgggtaccacgtacgacgtacttacggacggcggtcgtagggtcgggacgacggtcagttcgtacctttcgacgtacgtaggaacgtccgacgacggtacgggaggggtacggacggtacggttagggaggttaggttcgggtttacggttacggttttacgtcggtccgtaccgttacgggacgttaacggttcgtttaacggtccgtacggggttccgggtcccgggttacgggtacccgggtttaccgggaaacgggtaaaccggggtaacgggttaaacggggtaaaccgg

SEQ ID NO: 211337 - DNA, 888 bp, Homo sapiens
  misc_feature: GYAE6OF01CE3V5.26.26.C04.1.454.CMB.1.raw
  modified_base (160)..(160): a, c, t, g, unknown or other
  misc_feature (160)..(160): n is a, c, g, or t
tcagagactatactcacgaccggtgctcgatttagtctagcgactttgggtttgggggagataaaagctcagctctacccttgccttgactgatcaggactcctcagttcaccttctcaacaatgacggcctccctgctcagcctccgtgggctgactancgtctcgtcgggtcccgaggtccagggtgggattggttgtagtacgtgacctcgtacgtcctccgtccttccgtcccgtaccggtcccttccgtacccgttagggacgcgggccgtccctcacgttcctcgtggacgtcgttacgtacgtcggacgtacgtaccgttcgaaacgcgtagttacggaaccggttaacggaaccccgtaccggttacgttaacggacgttagttacctacggaacgacggtaccgggaacgcccggtaacccgacccgaacccggtcggaacggtaccttaacctttaaagtttaaacaagtttaccttaacggtttaccgggtaccggggttaccggttaacccggaccgaagtaacggtacgtaaccgttagggccggaacggtcgtacggggttcggaccgtacgggtcctaacggttaacgtaccgtttacgaccgtagttaacggaagtacgtacgacggggtacggtacgggggtaaggcggtagggtaggtaaccgggtttaggtttccgggttttacgggttaacttttacccggtaacgttccgggtaccggtaccgttacgggttaaacgttaaacggttcgttaaccgggtccggtttaccgggggtaacccggggtttacccgggttaaccgggtaaaccccgggggtaaacccggttaaaaccggggaaaccgggtttaaagggtaaaaacccgggg

SEQ ID NO: 211338 - DNA, 737 bp, Homo sapiens
  misc_feature: GYAE6OF01BBF4R.26.26.C04.1.454.CMB.1.raw
  modified_base (263)..(263): a, c, t, g, unknown or other
  misc_feature (263)..(263): n is a, c, g, or t
tcagagactatactcacgaccggtgctcgatttagtctagcgacttttggggtttgggggactgatcaggactcctcagttcaccttctcacaatgaggctccctgctcagctccgtggggctgactaatgctcgtgggtcccagggtccaggtggggattgttgtgatagactcagtctccgtctcctccctcgcccgtctacccgttggaacgacgggccgtcctacctacttctcctggcctaggtcctagtacaggacncccgttagtacacgagtagacgtacggaaccaccgtacttacgaacttagtacttacagacgaggacggaccgacggaccctaaccgtaccggacggaccgtaacctttaatttaagtaaagtactttaagtaacgtcggtacgttccgggtaccagactagattacaggcgacggtaggtcggacgacggctacgtgtaacgttacgacgtctaagtaagactacgaacgagggtaacggttagggacggtacggtaggtaacgggttagtacggttttaggttacggtttagtttacctcggcgttaacgacgtaaggttacgttacgttaccgtaggttccgggtacgggttacgggtaaccgggtttcccggaaaccggtaaaacgggtacggtaaacgggtaacgtaaacgaaaccgtaaacggtacgtacggttaccggtagacccgtactaaaccgtcgtttaccgg

SEQ ID NO: 211339 - DNA, 614 bp, Homo sapiens
  misc_feature: GYAE6OF01DWL0P.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccgttggacaggccggcctccatctcctgcaggtctagtcagagcctcgtacacagtgatagggaaccacccgcttagaactggattcagcagaggccaggccaaccgtccggaggccgtacctaatttactaagtatttactaagtcgggacgttcccgggtaccagacagtatacgacgtcggacaggtggtacaggtcaacgtgtatttaccacgtcgtagaagatacgaggcgagggtggagcgttaggaggtattggttaggtacgtttattacgtcgtcttgactaggtaacgttacttacgacgtcgggtaccggtaggtaccggttccggaccgtaaacggggtacccgaaagggttacgaaaacgtaccgaaaacggtacgtagggtacggactacggaccacgtcgttaccg

SEQ ID NO: 211340 - DNA, 669 bp, Homo sapiens
  misc_feature: GYAE6OF01AN347.26.26.C04.1.454.CMB.1.raw
  modified_base (403)..(403): a, c, t, g, unknown or other
  misc_feature (403)..(403): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccaggtggggatgttgtgatgactcagtctccgctcctccctgcccgtcacccttggacaggccgcctccatcctcgtgcaggtctagtcagcgcctcgtacacagtgagtggaaccaccgcttagaactggtacttcagcaggagccacggccaaccgtcgaggccaccttaattataagactttacaagtcgggtacgtcccggggtacccagtaccagtacttacgngtcggacgtagggtcgggtcacgggactacgtagtacgtttaccgacgtacgtacggaacgtactaccgaacgggtcggtaagggggtacgggaaggtaccggtagggtacgggtaagtttggttacgggttacgtttttaacgttaccgtcggtccgttagacgtaaggttaacgtttacgttacgtaccggtcgggttcccgtaggggttacccggtttaacgggaacccgtaaacggggtaacccgtaaaggggttaaaccgg

SEQ ID NO: 211341 - DNA, 705 bp, Homo sapiens
  misc_feature: GYAE6OF01AZJQI.26.26.C04.1.454.CMB.1.raw
  modified_base (190)..(190): a, c, t, g, unknown or other
  misc_feature (190)..(190): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgcctcagcctccgtgggctgctaatgctcgtggtcccagggtccagtgggatgttgngatgactcagtctccgctcctccctgcccgtcacccgttggaccaggcgcctcatctctgcagtcgtagtcgagcgtcctacgtacacgtaggtaggaaccggggaaccacccggtcctttagaaccgttgggtaacttcgagacgaacggacggacccgtacggaccctaaccgtcccggacggtaccgtacctttaaacgtttagaacgttactttacgaaggttccgggacgttcccggggtaccaggactaggtacttcgaacggtcgggtacgtacgggtacggtcgacgggtacacgttagtactttccgacgtcgtaggtaacgactagacgggtacgtaggggtcggaacgggccttagggaggttgtttacgttacggtttaccgtttacgtacgtacgtcgttcgaccgtacgtacgttactaccgtaccggtcggtacccggttacgggtaccggttaccgggaacccgttaacgggaacggttaagggtaacgttaaacccgg

SEQ ID NO: 211342 - DNA, 831 bp, Homo sapiens
  misc_feature: GYAE6OF01BBJGA.26.26.C04.1.454.CMB.1.raw
tcagagactatactcacgaccggtgctcgatttagtctagcgactttgggtttggggtgatcaggactcctcagttcaccttctcacaatgaggcctccctgctcagctccgtggggctgctaatgctcgtcgggtcccagggtccaggtggggattgttgtgatgactcagtcctccgccttcctcccgtcgccccgtctacccgttggacgacggccgccctccactcctccgtgacgtacggttctacggtacacggtaccgtcccgtacgtaccacgtagtaggacgtacgggaaccctacccgttaccgttaagaacgtggtacttcgacgacgaggaccggacccgaccggacccctaacccggtccggaacggtcccttaaacgtttaagtttaacgtaacgtttacgtttacggtaacggttccggggttaccggttacccggggtaccaacgtaccgtaggtaacgttcggaacgggcggtacggtacgggttcggacgtacggtactacgttgttaccttaccgacggtacgtagtaacgtcgtacggacgggtcgggtaaggggtggacgggtacggtagggtacggttaggtttcgggttacggtttagtttaccgtcggtccggtacgtcggtaacgtaagttacggtttaccgtacggttaccgggttaccggtaccgggtacgggttaacccggtacccggggaaaccgggttaaaccgggaaccggtttaaggaaaccggttaaacgtaaccggtaaaccggtagggttacgtaccggtacctacgtaacccgttaccgttcgttacggttcccg

SEQ ID NO: 211343 - DNA, 909 bp, Homo sapiens
  misc_feature: GYAE6OF01EM4PK.26.26.C04.1.454.CMB.1.raw
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctccgtgggctgctaatgctcgtcggtccagggtccaggtggggatgttgtgatgactcagtctccgctcctccctcgccctcaccgtgacnggccgcctcnctctcngcaggtctagtcagacgtccctacgtacacgtagtcgaggtacgggtaaccacccgtaccgttacgaaccgttggacgttcgaaggtaccgaacggacgggaccccgtaaccggacccccgtaaacccgtccgggaacggtacccgttaaacccgtttaaagttttaaacgttaaacgttacttttaaccgttaaaacgggtcccgggggttaacccggtttaccccgggggtaaccccgaagtaaaccggtacggttaactttaccggaacgggtccgggtaccgtacggggttacgggaccggtaacgggtcttaaaccgtggttacctttaacccggacggtttaccgtaaaggtaacgtacgtaccgtaacgggtacgggtaggggtttaccgggaaacgggtgttaacggggtaacgggtttaccgggttttagggttttacggttttaaacccgggggtttttatacccggggtttagggttacccccgttaaggggtaaccggtttaaaggttacggtttttaaaccgggttacccggttaaaccggggtttaccgggggttcccggtttaccgggggtaaacccggggtttaccccggggaaaacccgggtttaaaccggggggtaaacggtaaacgggggtttaaaaacccgg

SEQ ID NO: 211344 - DNA, 710 bp, Homo sapiens
  misc_feature: GYAE6OF01CNJXM.26.26.C04.1.454.CMB.1.raw
  modified_base (505)..(505): a, c, t, g, unknown or other
  misc_feature (505)..(505): n is a, c, g, or t
tcagagactatactcacgaccggtgctcgatttagtctagcgactttgggtttgggggactgatcaggactcctcagttcaccttctcacaatgaggctccctgctcagctccgtggggctgctaatgctcgtgggtcccagggtccaggtggggatgttgtgatgactcagtcctccgctcctccctcgcccgtccacccgttggacacggccgccctccactctccgtagcgtaggtctagtcagtacgccttacgaacataggtagaacgtacgggaacctccgtcgttaacggacttaggacttccgagcgaaggaccgccgaacggaccctaaccgtccggacggtacctaacctttaaagtttaacgtaagttaactttacggtaacggttccggggtaccgtttaccccggggaccaaggtacgtaacggttacgttaccgaggtccggagtacgggtcggacgtacggacttacgtgtacttcgacgacgtagacgnacgaggtacggtagggcggtaggcgtaggaggttagttggttacgtttacgtttacgttcgtacgtcgacgtacgtagttacgttgtaccgtggtacgggtccgtacggtccggttaccggaaccggtaacgggaacgtaagggtaacgtaaacgtaaccgtaacgtaaggttcggtaccgtacgtaccgaacttcgtcgttccg

SEQ ID NO: 211345 - DNA, 689 bp, Homo sapiens
  misc_feature: GYAE6OF01D533M.26.26.C04.1.454.CMB.1.raw
  modified_base (155)..(155): a, c, t, g, unknown or other
  misc_feature (155)..(155): n is a, c, g, or t
tcagagactatactcacgaccggtgctcgatttagtctagcgactttgggtttggggtgatcaggactcctcagttcaccttctcacaatgaggctccctgctcagctccgtgggctgctaatgctctgggtcccagggtccagtgggatgttgngatgactcagtctccgctctccctcgcccgtcacccgtggacagggccgcctccatcctcctgcacggttctagtcagacgcctcgtacacgagtgagtacggaacaccgtccttagaactgtacttcgagaccgagacggccaaccggacctaaccgtccggaggtccgtaccgttaaattttaactaacgttatttaacgtaacgtcgggtacgttcccggggtccaacgacgtagtacgttcgaggtccggacggtaggtacgggtccaagggtcctacgtgttaccgtttcgaacgtctaggaagtactacgaggcggtagggtggacggtacgtgggtagtgtttaggttcggttacgtttacgttacgtcggtcctaggtaccgtagttacgttacgttccgtacggttcggtccggttacggtacgggttccggaacgggtaaaccggtaggtaaacgggtaaacggtaaataacccggtaaagaaccggttggtaacgtcgccgtaaccgactcggttcgttaccg

SEQ ID NO: 211346 - DNA, 732 bp, Homo sapiens
  misc_feature: GYAE6OF01CLVW5.26.26.C04.1.454.CMB.1.raw
  modified_base (163)..(163): a, c, t, g, unknown or other
  misc_feature (163)..(163): n is a, c, g, or t
  modified_base (190)..(190): a, c, t, g, unknown or other
  misc_feature (190)..(190): n is a, c, g, or t
  modified_base (223)..(223): a, c, t, g, unknown or other
  misc_feature (223)..(223): n is a, c, g, or t
tcagagactatactcacgaccggtgctcgatttagtctagcgacttttgggtttgggggactgatcaggactcctcagttcaccttctcacaatgaggcctccctgctcagctccgtgggctgctaatgctcgtgggtcccaggtccgaggtgggattgttgngatgactcagtcctccgcctcctcccncgcccgtctaccgttggagtcggccgtcctacnttcctcgtgcgacgttcgtaacgtcgacgccgtaccgtacgtacctagaggtaggacgtacgggaaccctacccgtccgtttaggaacgttaggtacttacggagtaccgaggacggacccgtaccggaccccaacccggtcggaacggtcctaacctttaagtttaacgtaacgttaagtttcgtaacggttacgggtaccgttacccgggtaaccaggacacgtacttacggacggtccgggacgtcgggtcggtacgacgacgtaagttcgtacgttacgccgtagttaagaacgtacgtaccggagtacgggtaagggtacggacgtggttgaagggttgttccggtttagttaccgttagttaccgtggtaacgtcggtaacgtaggttacgttaaccgttcgcgggttaccgggacgtccgggttaccgtacggaacccgggagtaaacccggaggtaacaaacggtaacgacaggtcggtagaccctacgacgtacgtgtac

SEQ ID NO: 211347 - DNA, 804 bp, Homo sapiens
  misc_feature: GYAE6OF01BWLVS.26.26.C04.1.454.CMB.1.raw
  modified_base (545)..(545): a, c, t, g, unknown or other
  misc_feature (545)..(545): n is a, c, g, or t
tcagagactatactcacgaccggtgctcgatttagtctagcgactttgggtttgggggactgatcaggactcctcagttcaccttctcacaatgaggctccctgctcagctcctgggctgctaatgctcgtgggtcccagggtccaggtgggattggttgtgatgactcagtctccgcttcctcctcgcccgtccacccttggacgacggcccggtacctcctatcctccgtgtcgtacggttactacgtacgagtaccgtccgtacgtacacgtaggtggaagtaccggaaccgtccgtaccgttaaggaaccgtaggttacttacgacgtacgacgggacggtacccgtaaccggtacccctaacccggtaccggacggtacccgttaacgttaaaacgtttttaaagtaaccggtttaatttttaaaccggtacgggttaccggggttacccggtttacccggggtacccaaagtacgtaacgtaccgtacgacgggtccggaggtacgggtcggtcacggacttacggtacttacttacgngtacgtacggtaatacgtacggtacgacggtaggggtacggaggtacggtaggaggtttaggttacggtttacggttttacggtttaacgttcgtccggttaccgttaggtacgttagtacgttacgtaccggtacggtcgggttaccggtacgggtaaccggtaccggtaaccgggaaacggtacggtaacgggtaaagaaccggttaacgaaacgtaccggtacgggtacgacgtacggtacctcggtaacgttccg

SEQ ID NO: 211348 - DNA, 720 bp, Homo sapiens
  misc_feature: GYAE6OF01DV2RC.26.26.C04.1.454.CMB.1.raw
  modified_base (303)..(303): a, c, t, g, unknown or other
  misc_feature (303)..(303): n is a, c, g, or t
tcagagactatactcacgaccggtgctcgatttagtctagcgactttgggtttggggtgatcaggactcctcagttcaccttctcacaatgaggctccctgctcagctccgtgggctgctaatgctcgtcgggtcccagggtccaggtggggattgttgtgatgactcagtcctccgctcctcccgtcgtccccgtctacccgttggacgcggccggtccctaccacttccgtcctgcgtacggtcctagtcgagacgtcctcgaacacgaggtgagtacggaacctccgtctagacgtagtntacgagcaggacggccgacggacccaaccgtccggagtaccgtacttaagttaactaagttactttacgtaacggtcggtaccggtacccgggtccaagtacgagtacgtacgacgcggtacgtcgggtacggtacgacggtacctaacgttagttacgtttaccggaccgttagtaaccggtaaggtacgtttaaccgggaaggttaccggggtaaggggtacgggtacgggtggtaacgggtagttaacgggttttcggtttaacggttttacgtttaagtccgtggtacctaggtaacgtagttacgtgttacgtacggttcgggtcggtacggtacgggtaccggaacgtaacgggaacgtaaaggtaacgtaaagacgtaagacggtcgtacgactgaacctctgtcgttcg

SEQ ID NO: 211349 - DNA, 746 bp, Homo sapiens
  misc_feature: GYAE6OF01CGF6I.26.26.C04.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
  modified_base (465)..(465): a, c, t, g, unknown or other
  misc_feature (465)..(465): n is a, c, g, or t
tcagagactatactcacgaccggtgctcgatttagtctagcgactttgggtttgggggagataaaagctcagctctacccttgccttgactgatcaggactcctcagttcacctttctcacaatgagctccctgctcagctccgtgggctgctaatgctcgtcggtcccagggtccaggtgggattggttgtgangactcncgtcctccgctcctccctgcccgtcacccgttggacacggccgcctcatctcngntaggtatagtcagatcctacgtanacagtgagtaggaaccnccgtactagaactggtatccgagacgaagcgtaccgaggaccctacgacccggaggacctaacttaaagtttagtaaacgttactttacgtaaaggtccgggtaacggtttcccgggaccaagtacgaagtacgtacggacggaccggtacggagggttacgggtacncggggtaactacgtacgtttaaagtccgtaacggtgtaaagaaacgtcgttacgagggaccggtagggggttagggaacgttacggtaacgggaaggttgttacgggtttacggtttaaccgggtttaaatttccggacccgttaccggtagttaaaccggacgttaaacggttttactacggttacccgggtacggggttaccccggggttaacgggtaaacccggggtttccgggaaacgggttaaaaccggggaaaacgtttaacgggggtaaaaacc

SEQ ID NO: 211350 - DNA, 722 bp, Homo sapiens
  misc_feature: GYAE6OF01CFSH3.26.26.C04.1.454.CMB.1.raw
  modified_base (282)..(282): a, c, t, g, unknown or other
  misc_feature (282)..(282): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctcgtgggtcccagggtccaggtggggatggttgtgatgactcagtcctccgctctcccgtcgcccgtcacccgttggacacggccgcctccagtcctccgtgctaggttctagtccaggacctcctacgtacagtaggtgacgtacgggaaccncccggtcgttacgtaacgttggtacttacgacgacgaggacggaccacggaccctaaccgccggacgtccgtacttaatttaataagttctttacgtaacggtcgggtacgttcccggggtaccaaggtacgtagtacttccggacggtcggtacgtagggtcggtaccgacgtaccgtacgtttaggtacctttacgacggtacgttaagaacgtacgtacggaacggtacgggtagggtacgggacggtacggtgggaagggtttacgttcggtttaacgggttacgttttaacgtacgtcgtacggttacgacggtaaggttacttcgttaccgtacggttcgggtcgttacggtaccgggtcggaaacggtaacgggacggtaacggaagtaaacgtacaaccggtagttcggagtcaacgtccagttcgttaccg

SEQ ID NO: 211351 - DNA, 869 bp, Homo sapiens
  misc_feature: GYAE6OF01EIUIA.26.26.C04.1.454.CMB.1.raw
  modified_base (248)..(248): a, c, t, g, unknown or other
  misc_feature (248)..(248): n is a, c, g, or t
tcagagactatactcacgaccggtgctcgatttagtctagcgactttgggtttgggggagataaaagctcagctctacccttgccttgactgatcaggactcctcagttcaccttctcacaatgaggctcctgctcagctccgtgggctgctaatgctcgtggtccagggtccaggtgggatgttgtgatgactcgagtcctccgcctcgtcctcgcccgtcacccgtggacaggccgcctcatctcngcaggtctagtcagacgtcctacgtacacgtagtgagtacgggaacctccgtcttacggaacgtggtattacgagacgtacggacggaccgacggaccctaacgtccggacgcgtaaccttaattaactaagtacttacgtaacggtacgggttacgttacccggggtaccaagacgtacggtacttacgacggacggtacgtacgggttacgggacgtaacgggtactaacgttacgttaacgttttacccgaaccgtacgttaacgggaaacgttaccgtaaccgggtaacggtacggggttaaacgggggtacgggggtaacggtaaccgggttaagggtaaggggtttaacggttttacgggggtttttaaccgggttttaaccggggttttttaaacgtttaaccccggggttcgggttaccccggttaaaccgggtaacgggtttaaaccggtttaaaccggttttaaacgggttttcccgggttaaacccggggtttaccgggggtacccggggttttaacccgggggttaacccggggttaaccccgggtaaaccccggggggtaaaaccggggttaaaaccccggggttaagggggttaaaaaaccccgggg

SEQ ID NO: 211352 - DNA, 701 bp, Homo sapiens
  misc_feature: GYAE6OF01ETM5G.26.26.C04.1.454.CMB.1.raw
  modified_base (694)..(694): a, c, t, g, unknown or other
  misc_feature (694)..(694): n is a, c, g, or t
tcagagactatactcacgaccggtgctcgatttagtctagcgactttgggtttgggggactgatcaggactcctcagttcaccttctcacaatgaggctccctgctcagctccgtggggctgactaatgctctgggtcccagggtccaggtggggatgttgtgatgactcagtctccgctcctccctcgcccgtccaccttggacacggccgcctccatctcctgcaggtctagtcagacgcctcgacacgagtgagtacgggaaccaccgtccttagaactggattcgagcaggacggccgacggacccaaccgtccggacggaccgtaccttaaagtttacgtaaagtatttactaagtccgggtaacgttcccggggtaccaagacagtacttcgagtcggacgtagggtcggtacacggctaacgttgtactttccgacgtctaggaagatacgaaggacggtaggggtagggacggtacgtagggtaagggtagtttggtttacggtttacggttttaacgtttcgtacggtccggttgaccgtaaggttacgttacgttaccgtacgggtccggtacgggttacgggtaccggttaccggaaccgggaaaccgggtaacggtaaagggtaacggaaaacggttaccgaaaacggtaacgttacgggtacggacgtacgaccgtaccgngtttccg

SEQ ID NO: 211353 - DNA, 934 bp, Homo sapiens
  misc_feature: GYAE6OF01C0CFO.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtacagtggggatgttgtgatgactcagtctccgctctccctgcccgtcacccttggacaggccggcctccatcctcctgctaggtctagtcagacgcctcgtacacgaggtgaagtgggaaaccaccccggtacccgtttaggaaacctttggggaacttttaccgacggtacgacggacgggacccaacgggacccccaaacccgtcccggtacgggacccgtacccttaaatttttaaacgtaagtaatttttccgtaaaacggttccggggttaacggtttccccggggtaccccgaaggtacctacggtaactttcgaacggccgggacgtacgggtcgggtaccgacggtacgaaccgttagttacgtttacccggaccgtcgttaacggtaaacgtaacgttaccgaaggtacccggtaagggggttacggggaacgggtccggtttaaggggaaaccgggggttagtttttaaccggggttttggggttacccgggtttttttaaagtttacccggtttacgggttaccccgttacggttaaccggttaaacgggttaaacggtttaccgttttaaccgacccgggttttacccgggggaccgggtttaccgggggttaacccgggtttaacccgggaaaccccggggtaaacggggaaacccggggttaaacgggttaaaccggggtaaaaaactacccgggtaaaaaacccgggttaacggttacccgggtaaacggggttcccgtaaaggtacccccgtaaaccgttccggttttaacccgg

SEQ ID NO: 211354 - DNA, 713 bp, Homo sapiens
  misc_feature: GYAE6OF01AE8P1.26.26.C04.1.454.CMB.1.raw
  modified_base (523)..(523): a, c, t, g, unknown or other
  misc_feature (523)..(523): n is a, c, g, or t
tcagagactatactcacgaccggtgctcgatttagtctagcgactttgggtttgggggactgatcaggactcctcagttcaccttctcacaatgaggctccctgctcagctccgtgggctgactaatcgctcgtcgggtcccgagggtccaggtgggattgttgtgatgactctacgtctccgctcctcccgtcgccctacctaccgttggacgtcggccgtcctacctactcctccgtgaccgtaggtacctagtacgacgaccgtcctacgtacacgtaggtaggacgtaccggacctaccgtcgtagacgtagtctacgacgacgacggaccgacccgacgacccgtaaccggtcggacgtaccgttaactttaaagttaacgtaacgttagtttacgaacgggttccgggtaccggttacccgggacctaagtaacgtacgtacgtcgacggccgtagtacgggtcggtacacgtctacgtagttacttacgacgtgaagtaacgtacgacgtacgggngggtacgggacggcggtacgtaggggtacttacggtttggtttacgtttaacgtttacgcgtccgtcgtagtaacgtagtacgttcacggtcgtaccgggtcgtacggtacccgtcgggaaaccggtacggaacgtaggaaccgaataccgggtaaacgtgacggttcgacgtaccgacctgtacgttcg

SEQ ID NO: 211355 - DNA, 805 bp, Homo sapiens
  misc_feature: GYAE6OF01DF34B.26.26.C04.1.454.CMB.1.raw
  modified_base (175)..(175): a, c, t, g, unknown or other
  misc_feature (175)..(175): n is a, c, g, or t
  modified_base (191)..(191): a, c, t, g, unknown or other
  misc_feature (191)..(191): n is a, c, g, or t
tcagagactatactcacgaccggtgctcgatttagtctagcgactttgggtttgggggactgatcaggactcctcagttcaccttctcaacaatgaggctccctgctcagctccgtggggctgactaatgctcgtgggtcccgagggtccaggtggggattggttgtgatgactnagtctcgctcctcccngcccgtcacccgttggacgacgggccgcctccattcctccgtgccgaggttactacgtacaggacgccttacggaacacgaggtagaaggtacgggaaccacccgtacgttacggaacgtaggtaacttcgacgacgacggaccggaccgtaaccggaaccccgtaaccggtcccgggaacggtacccggtaaccctttaaagttttaacgttaaagtttaacgttttacgtaacggttaccggggttaaccggtttccccgggggtacctaacgaacgttaagtacgtttaccgacggaccgggtacggtaacgggttcgggttaccgacgggtacctaacggttacgttacgtttacgacgtacgttacgaaacgtacgtacggaacggtacgggtagggggtacgggtaacggtccgtaggggtaggttacggtttagggttacggtttacggttttacgttaccgtgtacgtagtaacggtagttacgttacgtacgtaccggttcgggtaccggttcgggtaccgttcgggaaccggtaacgggaaacggtaacggaagtaaactaaccggaaagtacggttaggtacgtacgtacaacgtgtcgttcg

SEQ ID NO: 211356 - DNA, 737 bp, Homo sapiens
  misc_feature: GYAE6OF01DHDCE.26.26.C04.1.454.CMB.1.raw
tcagagactatactcacgaccggtgctcgatttagtctagcgactttgggtttgggggactgatcaggactcctcagttcaccttctcacaatgaggctccctgctcagtctccgtggggctgactaatgctcgtcgggtcccagggtccaggtgggattgttgtgatcgactcacgttccgtccgcctcctcccgtcgtaccccgtcctacccggttggaccgacgggccgtccctccacttcctccgtggaccgtaggttctacggtacacggtccgtacccgttacgtaaccagtaggtacgtaacggtaccgggaaaccctcccgtcgttagaacgttcggtactacgacggacgtaacgggaccgaccgaaccggacccctaaccgtccggaaggtccctaactttaagttaagtaacgttatttaccgaaacggtcggttaccgttccggaccgtaccagacgtagtctacggcgacggtacgttacggtcggacgacgttccgtagttacgttacgttcccgacgtacgtaggaaactcgtaaggacggtcggtaaggggtaggcggtaggtaggaggtttgttacgggttacgtttacgttaactcgacgtccgtagacgtatacgtctccgtaggtccggtacgaccggtcggtaccgagggtaaccggaagtaggtaacgtaactaacccgggtagttcggacgttccgaagttaccgcttacgtcg

SEQ ID NO: 211357 - DNA, 783 bp, Homo sapiens
  misc_feature: GYAE6OF01CXOCH.26.26.C04.1.454.CMB.1.raw
tcagagactatactcacgaccggtgctcgatttagtctagcgactttgggtttgggggactgatcaggactcctcagttcaccttctcacaatgagctccctgctcagctcctggggctgctaatgctcgtgggtcccagggtccaggtggggattgttgtgatgactcagtcctccgcctctccctcgcccgtcctaccgtggacacggccgtacctccattccctccgtcgacgtaacggttctacgtacgacggactccttacgtaactagtaggtagtaacggtaccggaaccacccgtacgttagtaaccgtggtaacttaccgagaccgaaggacggtacccgacgggaacccctaaccgtccggacggtccgtaaccttaatttactaagtactttacgaacgtccggtacggttcccgggtacaagtacgtagtactcggacgtcgacggtaggtcggtacaccggtacacgttacgttacttacgaccgtacgtaagaagtaccgaggaacggtacgggtaggggtacggtaacggtcggagggtaacggtagtttacgggttgtttaccgttttaaacgtcgttaccggtcgttaacggtaccgtaaacggttagttccggttaccggtacgggttacggtccggggtttaaccggaaccgggtttacccggaaaccgggtaaacgggttaaaccggtaagggttaaaccggaaacttaaaccgggaacgttaacggtgtaacccgtacgacgtaaccctaacgtgttaaccg

SEQ ID NO: 211358 - DNA, 713 bp, Homo sapiens
  misc_feature: GYAE6OF01BPZ1C.26.26.C04.1.454.CMB.1.raw
  modified_base (229)..(229): a, c, t, g, unknown or other
  misc_feature (229)..(229): n is a, c, g, or t
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
tcagagactatactcacgaccggtgctcgatttagtctagcgactttgggtttgggggagataaaagctcagctctacccttgccttgactgatcaggactcctcagttccacctttctcacaatgacggctccctgctcagcctccgtggggctgactatgctcgtcgggtccgagggtccaggtggggacttggttgtagatcgactcgcgtcctccgctccgtccncgccctccaccgtggacgcggccgtcctacnctcctacgtgacgtggtctaggtcagctccgtacgacngtagtacgagtacggaccctaccggtctagtacgtgactgagcgaacgggaccaccggtacgaccccgtaacggtccggaagttccgtaactttaaagttaacgtacgttaattaccggtaacggtccgggtaccggtttacccggggacaggtaacctaaggtcttaccggagggtccgtacggtagggtcggacgtaacgtacgtacgttacgttaacgtccggtactacggtaaaggacgtacgtacggaacggggggtaacgggtaggttacggacggttaggtaacgggttagtttccgggttaggttaacccgtttgtaccgcggttacacggtaccttaggtacttgtaccggtcggtcggtacggttaccggacggttaccgaagggacggtaaccgaaggtaaccg

SEQ ID NO: 211359 - DNA, 812 bp, Homo sapiens
  misc_feature: GYAE6OF01CE2WD.26.26.C04.1.454.CMB.1.raw
  modified_base (614)..(614): a, c, t, g, unknown or other
  misc_feature (614)..(614): n is a, c, g, or t
  modified_base (631)..(631): a, c, t, g, unknown or other
  misc_feature (631)..(631): n is a, c, g, or t
tcagagactatactcacgaccggtgctcgatttagtctagcgactttgggttgggggactgatcaggactcctcagttcaccttctcacaatgaggcctccctgctcagctccgtggggctgctaatgctccgtcgggtcccagggtccaggtggggattggttgtgagtcgacctcgtacgtcctccgtcctccgtacccgtccggtaccccgttaccgtaccccgttagggaaccgccggggtcccggtaccccttcccgaacgttcccgttacccgtcggaaccggtaccggttaccgttacgtaccgaacgtaccgtcccgttacgtaacgacgtaaggtcgacggtacggaacctcccgtactaacgtaacgtggtactcgacgacgacggtaacggaccgaccggtacccgtaacccggtccggaacggtacccgttaacctttaaaagtttaagtaaacgtttacttttaacggtaaccggtccggggttacggttacccccggggtaccaacgtaacgtaggtaacgttacggacggtacggtcggtaggtcggtacgacgtactacgttacgtaacgttcgaacgttgacggtaaactcgtacgnggcgggtaaggggcggnggtacgagggtacggttagttcggttaacggttcggttttacacggtccgttcgtgtaacgtagttacgttacgtacgtcggttcggtaccggttcgggtaccgtaccggaaacggtaacgggtacggaacggttaagaaaccgagaaaccgttggcggtacgctagtacctgttcgtccg

SEQ ID NO: 211360 - DNA, 882 bp, Homo sapiens
  misc_feature: GYAE6OF01AOD9W.26.26.C04.1.454.CMB.1.raw
  modified_base (218)..(218): a, c, t, g, unknown or other
  misc_feature (218)..(218): n is a, c, g, or t
  modified_base (260)..(260): a, c, t, g, unknown or other
  misc_feature (260)..(260): n is a, c, g, or t
  modified_base (778)..(778): a, c, t, g, unknown or other
  misc_feature (778)..(778): n is a, c, g, or t
tcagagactatactcacgaccggtgctcgatttagtctagcgacttttgggtttggggggagataaaagctcagctctacccttgccttgactgatcaggactcctcagttccaccttctcacaatgaggctcctagctcagcctcctggggctgctaatgctcgtgggtcccagggtccaggtggggtatggttgtacgatcgtacctcgagttccnccgctcctccccgtcggtccccgtacctacccgttgggaccncgggtccggtccttccacgttccgttccgtggccgtaaccggttacgtagggtccaacgggtccgtccctaccggtaacgaccgtaggtacgtacgggtaccgggaaaccgtacccggtaccgttagtacgtacggtacttcgaacggtcgaacggcggtacccggaacgggttaccccaaccggttccgggaacggtccccttaaacgtttaaatttaaacggtaacgtttaactttccgaaaggggttacccggggttaacgggtttccccggggtaacccgtaagtaaccggtacgttaccgttacggagggttaccgggacggtacgggttaccggggtaacacgggtcccttaaacgggttacgtttacctttacccggactttaacgaagggaaacgtttaccggaacgggacgggtacggttaaccggggggtagggacggttaaccgggttagggttaacgggttaggttttacgggtacggttttacgggttttaaccttaggttcccngtaccgggttagaacgggttctaaccgtaccggttggttcccgggtccggtaacgggtcccggttaacggaaccggggtacggttaaacggaggttaaaaccgg

SEQ ID NO: 211361 - DNA, 716 bp, Homo sapiens
  misc_feature: GYAE6OF01D2DRQ.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctccgtggggctgctaatgtctcgtcgggtcccagggtccaggtggggattgttgtgatgactcagtctccgctcctccctcgcccgtcctccgttgacgacggccgcctcctactcctcgtgcgtagtactacgtcaacgcgtcccgtacgtaaccagtagtacgaggtacgggaacctccggtaccttaggacgtggtacttcgagacgacggacgacccgaacgggaccccaaaccggtccggacggtaccgttaacctttaaagtttaacgtaacgttactttaacgtaacgggtaccgggtaccggttcccggggtaacacggaacgtacgtacgttacgacggcggtaggtacgggttcgggtacgaggtcctaacgtacgttacgttccaacgttctaacgagtacgtacggacgtacgggtagggtggaacgggtcctaggggtagttacggttggtttacgggtttacgtttacgttacgttcgacgttcggacgtaagtcgttactcgtacggtccggtcgtaccgggtacgggtacccgagggaaccgggtaagaagggtaaaccg

SEQ ID NO: 211362 - DNA, 789 bp, Homo sapiens
  misc_feature: GYAE6OF01A67Z1.26.26.C04.1.454.CMB.1.raw
  modified_base (185)..(185): a, c, t, g, unknown or other
  misc_feature (185)..(185): n is a, c, g, or t
tcagagactatactcacgaccggtgctcgatttagtctagcgactttgggtttgggggagataaaagctcagctctacccttgccttgactgatcaggactcctcagttcaccttctcacaatgaggcctccctgctcagctccgtgggctgctatgctcgtcggtcccgagggtccaggtgggntggttgtagagtgactcgagtcctccgtctcctcccgtcgcccgtctaccgtggacgcggccgtcctcactccgtccgtgcgtagtcgtagtcaggcgtcctacgtacacgtgtcgaggtacggaccaccgtcgttaagacgtggtactacgacggacgacggaccggaccgaacccggaccctaaccggaccggtacggttccttaaacgtttaagttaacgttaacgttaaacgtttcggtaaacgggtttacccgggttaccggttacccggggtaccctaaagtaacggtacgttacgttaccggacgggtacggtacggtacgggtcgggtacgaaccgggtacgtaacgtacgtacgttacggtacgtacgtaagaacgtacgtaccgaggtacgggtaagggtgggaacggtggtacgggtaggtaggtttcgtttacggtttacgtttacgttaccgtacggtccgtaggtacggtacggttacgttaacgttacgggtaccgggttacccggggtaccgggttacggggttaacccgggttacccggggtaacccgggtaaacggggtaaaccgggttaaacgggtaaaaccggg

SEQ ID NO: 211363 - DNA, 967 bp, Homo sapiens
  misc_feature: GYAE6OF01D1FZ8.26.26.C04.1.454.CMB.1.raw
tcagagactatactcacgaccggtgctcgatttagtctagcgactttgggtttgggggactgatcaggactcctcagttcaccttctcacaatgaggctccctgctcagctccgtggggctgctaatgctcgtcgggtcccgagggtccaggtggggattgttgtgatcgactcgtacgtcctcccgtcttccctccccgtcggtccccgtcctaccccgttacgggaccgacgggcccggtcccttacctacttcctccgtagccgtacggttctacgtaccgaacggtaccgtccgtaccgtaaccacgtaaggtaggtaacggtaaccggaaaccctaccccggtacgtttaacggtaacgttacgggtaacttaccgaacggaccggaacgggaacccgggtacccgaaccggggaccccctaaaacccgggttccggaaaccggggttacccgtttaaacccttttaaaaattttaacggttaaacgttttaaccgttttttaaaccggtaaacgggggttttacccggggtttaaccccggggtttacccccgggggtaaaccctaaaccggtaaaccgtaagggtttaaacccgtttaccggaaccggggacccgggttaacggttaaggggggttcccggtaaacggaacccgggtttaaccttaaccggttaacggttttaccgtttaaccccggtaaacgggtaccgttaaaggtaaacggtaaccgtacggtaacgggtacggggtaacggggtaacgggtacgggtaacgttaggggtaaggttaggtttacggttacgttttacggtttccgttacgtcgtacgtcgtaagttagtacgttacgtacggtcgtccgggtcggtacggtacggtaccgaacggtaaccgggaagtaacggtaacgtaaacgtacgaaacggtacgtcggtcgacgttacacgttacgtgttaccg

SEQ ID NO: 211364 - DNA, 690 bp, Homo sapiens
  misc_feature: GYAE6OF01BYNZH.26.26.C04.1.454.CMB.1.raw
  modified_base (160)..(160): a, c, t, g, unknown or other
  misc_feature (160)..(160): n is a, c, g, or t
  modified_base (192)..(192): a, c, t, g, unknown or other
  misc_feature (192)..(192): n is a, c, g, or t
  modified_base (200)..(200): a, c, t, g, unknown or other
  misc_feature (200)..(200): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgngatgactcagtctccgctctccctgcccgtcncctggacnggcgcctcatctctgcaggtctagtcaggacgcctcgtacacgagtcgagtcgggaaccaccgtccttaggaacttggattcgacgcgagacggaccgacggacccgaaccgtccggacggtcgtaccctttaaagtttaacgtaacgtacttttaccgtaacggttccgggtacgtttcccggggtcccaaggactagtacttcgacggcggtacgagggttcggacgacggcctacgttcgtactttcgacgtcgtaggaacgtacgtacgacggtacggtaggggtacggtaggtacggttagggtaggtagttggtttacggtacggtttaacttacgtccggtccgtggtacgtaaggtacgttacttccggtaacggtcggtaccggttacggtaccggttcggaaccgtaacggggtaacgtaagggtaacggaaacttacggaaacgtacgtacggtacgacgtacgactaccgtcgttccg

SEQ ID NO: 211365 - DNA, 796 bp, Homo sapiens
  misc_feature: GYAE6OF01ESNQ2.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgagtgactcgagtcctccgctcctcccgtcgcccgttccacccgttcggacgacgggccggtccctccacgttccttcccgtgaccgtaggttacgttacgtcgaacggacgtcccgttacggtaccaacgtaggtacggtaacgttacggggaaaccctacccggtacccgtttaacggtaaaccgtggtaacttaccgacgtacgacggacggtacccgaacggaccccgtaacccggtccggaacggacccgttaacctttaaagtttaacggttaaacgtttacttttaaccttaacgtacgtaacgggtttacggttaccccggggtacctaacggtacgtaacgtacgttacggaacggtcggtacgtaagggtcgggtacgacggtacgtacgtacgttaacgttcgacgtacgtaggtaacgcgtacgacggtgggtacgggtaggacgtcggtaggtaggtagtttggttacggttacggtttacgtacgtcgtcggtacgacgtaggtacctttagtccgtcggttacggtcggtacgggtaccggtttcccggaacggtaacgggtaccggtaaggtaacgtaaacgtacgaacgtacgtcggtacgacgtacgtacgtcgtacg

SEQ ID NO: 211366 - DNA, 784 bp, Homo sapiens
  misc_feature: GYAE6OF01CMD8X.26.26.C04.1.454.CMB.1.raw
  modified_base (560)..(560): a, c, t, g, unknown or other
  misc_feature (560)..(560): n is a, c, g, or t
  modified_base (703)..(703): a, c, t, g, unknown or other
  misc_feature (703)..(703): n is a, c, g, or t
tcagagactatactcacgaccggtgctcgatttagtctagcgactttgggtttgggggagaataaaagctcagctctacccttgccttgactgatcaggactccctcagttccaccttctaccaacaatggaggctcccctgcctcacgcctccggtggggctgataatcgtctcggtcgggtacccgagggtccgagggtgggtatggttgtcgagtacgctacgtacgtcctccgtcctcctccccgtcgcccgtacctaccgtacggacgccgggccgtacctccagttccctcgtcgtacgtacggtctaggtaccgacgtacgtaccgttaccgaaccacggtagggttacgaacgggtaccgggaaccctaccccggttaccgtaacgtaccgggttagtaccttacggaacggtaacgaccgggaaccgcccgtaaccggacccctaaccgggccgtaaggtccctaaacggtttaaattacggttaaacttcttaaacggtacgggtcccgggtaacggtccccggtaaacaggaactggactacggacggnggacgtaggacgggtacgacggacgttacgtagtaccgtacgtacgtacgtaagtaacgtacgtacgtaaggtcgggtagggtacggcggtacggtggtaacggtagtcgggtttagttacggtttaacgtcgtacgtaccgngtaacgagttcgtagttccggtggtacggtaccggtcgggtaccggttacggaaccggaagggaaaccggtaggtaaacgg

SEQ ID NO: 211367 - DNA, 602 bp, Homo sapiens
  misc_feature: GYAE6OF01AXLH5.26.26.C04.1.454.CMB.1.raw
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
  modified_base (472)..(472): a, c, t, g, unknown or other
  misc_feature (472)..(472): n is a, c, g, or t
tcagagactatactcacgaccggtgctcgatttagtctagcgactttgggtttggggactgatcgaggactcctcagttcaccttctcacaatgaggctccctgctcagctcctggggctgctaatgctctgggtcccagggtccaggtggggatgttggtgatgactcagtctccgctctccctgcccgtnacccgttggacnggcggcctcagtctctgcaggtctagtcagacgcctcgtacacagtgagtagggaaccnccggccttaggactggtattcgagacgaggacggacccacgggccaaacccgtccggaacggccgaccttaagtttaataacgtactttacgtaaggtccgggtacttcccggggtaccctaggacagtactcgacggcggacgtaggtggtcagggtcacgtgtacttcgacgcgtagagatcgagtacgagggtcggaagcgtaggngtagtggtagtacgttagtatcgctgtacgagtattacgtgacgtcggacgtggtacggtacggacgaaaggtcggaaggtaggaacgtacgaaacgtacgtcggtacgtacgtacgccgtacgtatcgg

SEQ ID NO: 211368 - DNA, 787 bp, Homo sapiens
  misc_feature: GYAE6OF01B39F6.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctcgtgggtcccagggtccaggtggggatgttgtgatgactcagtcctccgcttcctccctcgcccgtcacccgttggacacggccgcctccatcctacctgcaggtctagtcagacgtcctacgtacacgagtgagtacggaaccaccgtaccgttagtaacgttggtacttacgagcgtaggacggaccgacggaccctaaccgtccggacggtaccgtacctttaaagttttaacgtaagttactttacgtaaacggtccgggttaccgtttacccgggggtacccaacggacgtaacgtacgtttacgacggtaccgggtacgtaaggggttcggggtaccgtacggtacccgtacggtttagtaccgtttttaccggaaccggtccggttaaggaacgtaaccgtacgtaacgggtacgggtaagggggttacgggacggtacggtaggaagggtttagtttacggggtttacggtttacggtttttaccgtacggttaccgtcccgttaggaactaggttacgttacgttacgtacggttcgggttaccggtaccggttaccggtaccgggaaaccggtaaccgggaaggtaacgggttaaggaaacgtacgaaaccgtaggtcggtacgtacgactaccgtacgtagttcccg

SEQ ID NO: 211369 - DNA, 755 bp, Homo sapiens
  misc_feature: GYAE6OF01EV9FS.26.26.C04.1.454.CMB.1.raw
  modified_base (206)..(206): a, c, t, g, unknown or other
  misc_feature (206)..(206): n is a, c, g, or t
  modified_base (244)..(244): a, c, t, g, unknown or other
  misc_feature (244)..(244): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtcctccgctcctccctgcccgtcacccgttggacgnggccggcctcctactcctcctgctaggtctagtcagcncctcgacacgtagtgagtacggaaccaccgtccttagaacgtggtatcgagacgaggacgccgacggaccctaaccgtccggacgccgtaaccttaatttacgtaagttactttacgtacgttcggtaccggttcccgggacctaagacgagtatacgaggtcggagtacgggtggtacacgggctacgtggttaccttacgacggtacgtaagaagtcgtacggacgggtgggtaaggggtggaacggtcggtagggtacgggttacggtttgggtttacgggtttaaccgttttaagttcccggtggttacccggttaaggtacggttaaaacggtgttttaccggtaccggtaccgttacgggggttacccgggttacgggttacccgggttacccgggaaaccggtaaaccgggggtaacccggtaaaggggttaaaccggtaaaccgttaacgggaaacggttacgtacggggtcgtaccgtacgacccgttaaacgtcgttacgg

SEQ ID NO: 211370 - DNA, 782 bp, Homo sapiens
  misc_feature: GYAE6OF01BAX40.26.26.C04.1.454.CMB.1.raw
  modified_base (229)..(229): a, c, t, g, unknown or other
  misc_feature (229)..(229): n is a, c, g, or t
  modified_base (609)..(609): a, c, t, g, unknown or other
  misc_feature (609)..(609): n is a, c, g, or t
  modified_base (662)..(662): a, c, t, g, unknown or other
  misc_feature (662)..(662): n is a, c, g, or t
  modified_base (759)..(759): a, c, t, g, unknown or other
  misc_feature (759)..(759): n is a, c, g, or t
tcagagactatactcacgaccggtgctcgatttagtctagcgactttgggtttgggggactgatcaggactcctcagttcaccttctcacaatgaggctccctgctcagctccgtgggctgctaatgctcgtgggtcccagggtacaggtggggatgttgtgatcgactcagtcctccgctcctcccgtcgcccgtactacccgttggaccgacggccggtccctaccncgttcctcctcggtacgtacggttccgtaggtaccgaagaccggtacctaccggtaacgaacgaggtacgtacggaccggggaaccctacccggtccgttaagtaaccgtgggtactacgaaggacgtaacggaccggaccaaccgggaccccaaacccgttccggaacgggtccttaacctttaaattttaacggtaaactttacgtttacggttaaacggttcccggggtaaccggtttaccccgggtaacccgaaggtaaacctaggttacctacggacggcggacggttaggttacgggtacgacggaccttagtacgttaactttcggacgtatacggaaagtgtacgaggaacgggtgggtacggagttacggngtacggtagttcggttacggttagtttttacctcggtcctacggtgtaaccgngttacgttaccgttcgacggtcggacggtacggtcggtaccgtacggaaacggtacggtaacgtaactaacggaacgtaaccggagttacgcggtancccgtaacgcccgtaggttaccc

SEQ ID NO: 211371 - DNA, 720 bp, Homo sapiens
  misc_feature: GYAE6OF01B4BZ3.26.26.C04.1.454.CMB.1.raw
  modified_base (75)..(75): a, c, t, g, unknown or other
  misc_feature (75)..(75): n is a, c, g, or t
  modified_base (384)..(384): a, c, t, g, unknown or other
  misc_feature (384)..(384): n is a, c, g, or t
tcagagactatactcacgaccggtgctcgatttagtctagcgactttgggtttgggggactgatcaggactcctnagttcaccttctcacaatgaggctccctgctcagctccgtggggctgctaatgctctgggtcccaggtacaggtgggatgttgtgactgactcagtctccgcttctccctcgcccgtactacccgttggacacgggccgtcctcctatcctcctggtaccgtacggttctaacgtcacgacgtaccttaccggtaacacgtagtgacgtacgggaacctaccgtccttacggaacgttacgtacttacgagacgaagaccgggtaccgacggtacctaacccgtcggaacggcctacttaaagtttaanaacgttatttacgtaacggtcggtacgtttcccgggtacagactacgacttacgcggcggtacgtacggtacgggtacacgggtctacgttacgtacgttacgtactacggtaacgtaagcgttacagggtacggtaagggtcgggaagttcgtagggtagtagttacggttgttaacgttttacgtacgtccgtcgaacgtaacggtacgtacgttctaccgtacggttaccggcggttacggtaccggtacggtacgaacgggtaacgtaacgggtagaaacgttaccgaaacggtagtacgggtaccgtacgtaaccgtacacgttcgtaccg

SEQ ID NO: 211372 - DNA, 823 bp, Homo sapiens
  misc_feature: GYAE6OF01CLZL3.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcaacaatgaggctccctgctcagctccgtggggctgactaatgctcgtcgggtccgagggtcaggtggggtatggttgtgatgactcagtcctccgctcctccctcgcccgtactacccgttaggacgacggtccggccctctacgtcctccgtgcgtaggtactagtacacgacgtcctacgtaaccagtagtaggagtaccgggaacctacccggtccttaggaacgtggtactacgaggacgtaggaccggaccgtaccggaccctaaacccggtccggaacggtaccttaaaccgtttaaagtttaaacttaaacgttaacgttttaacgtaaacgggttcccggggttaaccggtttaccccgggggaaccctaaggtaaccgttaagtacgttaccggacggtacgggacggtacgggtacgggtacggacggtactacgttagtaacgtttaccgacgtagtacggaaacgtactacggaggtaccgggtaagggtcgggtaaacggtcggtaagggtaggttacggtttgggtttaacggtttacggttttaataccgggttacgtaccggttacgtaacgtaacggtaacgtttaccgttaccggttacggggtacccgggttaccgggttaccggggttaccgggtaaccgggtaacccgggtaaaacgggtaaccgggtaaacggggtaaaacgg

SEQ ID NO: 211373 - DNA, 894 bp, Homo sapiens
  misc_feature: GYAE6OF01E1K50.26.26.C04.1.454.CMB.1.raw
  modified_base (577)..(577): a, c, t, g, unknown or other
  misc_feature (577)..(577): n is a, c, g, or t
tcagagactatactcacgaccggtgctcgatttagtctagcgactttgggtttgggggactgatcaggactcctcagttcaccttctcacaatgaggctccctgctcagctccgtggggctggactaatcgctcgtcgggtcccgagggtccgaggtggggtattggttgtacgatcgtaccgtcgtacgtcctcccgtcttccctccgcgtccccgttaccgtcccggttaggaaccgcggtccgccctaccacttccctccgtgaccggtaacggtctaacggtccgtaacggtaccgtacccgtacggtaacacggttacggtacggtaacggaccgggtaaacccgtacccggtaccggtttaacgtaacgttaccggtacgtttacggacgtaaccggacggaacccggacccgaacccggtaaccccgtaacccggttcccgggacggtacccgttaacgttttaaaccgtttaaagtaacgttttaacgtttaaccgtaaggttccggggtaacccggttcccgggtaacccgtgtaaccgtacggtattcgcggacgtaggtaccgggngtacggcgtactaccggtcgttaacgttaccgagttcggtaagtaaactacggtacgacggtacggagggggtacggaccgggttaacggtagggtaaccgggtttgggtttacgggtttaccgttttaaagggtttccgtttaacggttccgtacgttacggcggtttaacggttacgttacggttaacccgtaccggtttacggggaccggttaccggttaacggggtaccggttaaaacccggaggttaaaccggtacgtaaacgtacggtaaacggaccgtagtcgtacggtaccaggccttacgtcgttacg

SEQ ID NO: 211374 - DNA, 807 bp, Homo sapiens
  misc_feature: GYAE6OF01CDQ2G.26.26.C04.1.454.CMB.1.raw
tcagagactatactcacgaccggtgctcgatttagtctagcgactttgggtttgggggactgatcaggactcctcagttcaccttctcacaatgaggctccctgctcagctccgtggggctgctaatgctcgtcgggtcccgagggtccgaggtggggattggttgtgagtgactcagtcctccgcttcctcccgtcgcccgtcctacccgttcggacgcggccgccctccgtactcctccgtgacgtaggtacgtagtcgacgtactccgtacgaacacgtagtagacgtacggaactacccgtaccgttagaaccgtggtactacggagacgaggacgaccgaccggacccgaaccggtccgacggtacgtacctttaagttaagtaacgttagtttaacgtaacggttccgggtaaccggttacccgggaccgaagtaccgagttacgtacggacggcggtaacgtcgggtacggtacgacgcgtacgttagtacctttacgacgtacgtaagtaacgtagtaccggagggtacgggtacgggtacgggaacgttacggtagggtaacggtttcggtttaggtttaccgggtttaacgttttaacgttacccggttccgtaacggttcgtaccgtaaggtttaacgttaccggttaaaccgtcggggttaccgggtttaccggtaacggggttaacccggttaccgggaaacccgggtaaaagggaaccgggttaaaggtaaacggtaaccgtaaacgaaacgggttcgacgggttacgaccgtaacgcccttacgtacgttcg

SEQ ID NO: 211375 - DNA, 900 bp, Homo sapiens
  misc_feature: GYAE6OF01BEK8T.26.26.C04.1.454.CMB.1.raw
tcagagactatactcacgaccggtgctcgatttagtctagcgacttttgggtttgggggtgatcaggactccctcagttcaccttctcacaatgaggcctccctgctcagctccgtggggctgactatgcctcgtcgggtcccgagggtccagggtgggattgttggtagatgactcgtacgtcctccgtcttcctccccgtcgcccccttactacccggttggaccgcggccgtcctctattccgtacgtgcgtaggtctagacaacgccgtccgtacacagtagtcgacgtacggaacctccgtaccgttagaacgtagtagttacgagacgacgggcgtaccgaacccggtacccgaaccgacccgggtacggtaccgtaacccttttaagtttaacgtaaacgttttagttaaccgttaccgggttaccggggttaacgttaccccggggttaccaacgtaaccgagtttacgtacgccgggtacggtacggtcgggtacggtacggaacggtacgtttaaccgttacggttacttccggtaacgtacgttaaacgacgtttaccgaccgggtaagggttccggggtaaggggtaagggtaccggtaaagggtgggttttaagggttaccgggttttacgggttttacggggttttaaaacccggttttcgtacggggttacccctagggttccggtaaagggttacccgtttaaggtttaccggttaccgttaacgggttcccgggttaccgggttaccggggttaaccccgggtaaacgggtaccggaaaccggggttaacgggaaacgggttaaacggtaaccggtaaacgtaaccgagggtaccggttaagtcccgtaaacccggaacggtacccttcgtttcgtttacccg

SEQ ID NO: 211376 - DNA, 880 bp, Homo sapiens
  misc_feature: GYAE6OF01B84GU.26.26.C04.1.454.CMB.1.raw
  modified_base (682)..(682): a, c, t, g, unknown or other
  misc_feature (682)..(682): n is a, c, g, or t
  modified_base (739)..(739): a, c, t, g, unknown or other
  misc_feature (739)..(739): n is a, c, g, or t
  modified_base (872)..(872): a, c, t, g, unknown or other
  misc_feature (872)..(872): n is a, c, g, or t
tcagagactatactcacgaccggtgctcgatttagtctagcgactttgggtttgggggactgatcaggactcctcagttcaccttctcacaatggaggctccctgctcagctccgtggggctgctaatgctcgtcgggtccagggtacaggtgggattggttgtcgattcgactcgacgtcctcccgtccttccgtccccgtccggtacccgttaccgtacccgttacgggaccgtaccggggcccggttcccctaccgtaccgttccgttccgtacggtaccggtaacgggttaccttacggtaaccgacggtaacccggtcccgttaaccgttaaccgaacggtaaggttacgggtaacggtaaccgggtaaacccgttacccggttaccggttaaaggtaaacgttcgggtaacgttaccgacgccggaacgggtaaccggtaccggaaccggtaaccccgttaaccggtaccgggaaccggtacccgttaactttaaagttttaacgtaactttacgttttaccggtaacgggtaccgggtaccggttcccgggtaccctaaggtaacgtacgttacgtcggaccggcggtacggtacgggttcggtacgacggtactacgtcgttacgttacgagtacgtaaggattacggcgaacgggtacgggttggacggggtntaaggtcgggtaagtcggttaacgggtttcgtttaaccgtttagacgtcggtaccgngttagacgttagttcgtaccggtcgggttaccggtacggttacggtacgggtaaccgtaccggaaaggtaacggtacggtaacgaaccgtaaacgggtacgtcgggtacgtaccgtacggactacttcccgtntttcccgg

SEQ ID NO: 211377 - DNA, 753 bp, Homo sapiens
  misc_feature: GYAE6OF01C9R2J.26.26.C04.1.454.CMB.1.raw
  modified_base (172)..(172): a, c, t, g, unknown or other
  misc_feature (172)..(172): n is a, c, g, or t
  modified_base (254)..(254): a, c, t, g, unknown or other
  misc_feature (254)..(254): n is a, c, g, or t
  modified_base (540)..(540): a, c, t, g, unknown or other
  misc_feature (540)..(540): n is a, c, g, or t
  modified_base (723)..(723): a, c, t, g, unknown or other
  misc_feature (723)..(723): n is a, c, g, or t
  modified_base (742)..(742): a, c, t, g, unknown or other
  misc_feature (742)..(742): n is a, c, g, or t
tcagagactatactcacgaccggtgctcgatttagtctagcgacttttgggtttggggactgatcaggactcctcagttcaccttctcacaatgagcctccctgctcagctccgtgggctgactaatgcttcgtcgggtcccgtaggtccgaggtggggattggtttgtagnttacgactcgcgttccctcccgtccttccctcccccgtccgtccccgttacctaccggttcgaccgcggcccgtccctaccnttcctccgtaggtctacggttactacgtacacggtacctacccgtaccgtaaccgagttaggtacggtaacggtacccgggaaaaccctcccggttcttaacggacgtggttaactcgaacgtacgacgggaccggtaccgaaccggccctaaccggtcggacgtaaccgtttaactaaagttttaacaggtttaacctttacggaacgggtttccggtaaccgttcccggaacaagacctaagttacctagaccgttggacgtagggtcgacgtacgataccgtnttacgtaacgcgtatacgagtacgtagacggtaggtacgggtaggagtcggtaggtagttggttcgtacgtttacgtttcgacgttcgtgtacgattacgtacgttcgacgttcggcgggtcgtacggtaccgtaccggacggtaacggacggtaacgaacgttaaacggccaaggttaccgngtaccgaagacgtaacccngttccgttacg

SEQ ID NO: 211378 - DNA, 741 bp, Homo sapiens
  misc_feature: GYAE6OF01C5TVJ.26.26.C04.1.454.CMB.1.raw
  modified_base (163)..(163): a, c, t, g, unknown or other
  misc_feature (163)..(163): n is a, c, g, or t
tcagagactatactcacgaccggtgctcgatttagtctagcgactttgggtttgggggactgatcaggactcctcagttcaccttctcacaatgaggctccctgctcagctcctggggctgctaatcgctcgtcgggtcccgaggtccaggtgggattgttgngatgactcagtcctccgctccgtccctcgcccgtctacccgtggacgaggcccgcctccgactcctccgtcgcgtaggttactacgtacgacggaccgtccttacgtacacgtaggtagaacgtaccgggaacctaccggtcctagtaaccgtggtacttcgacgacacggacggccgaaccggaccctaaccgtccggacggtaccgtacctttaaatttacgaattactttaacgacggtccggttaccgtcccgggacagtacgtagtactacggcggcgagtaggtcgtacgacgacgtatagttacttacgacgtacgtagaacgtacgtacgacggtacggtagggtagggtacgtacggtagtaggttacggttacggttacggttacggttttacgttacggtcgtacgtacggtagtaacgttacgttaccgtacgtacggttacggtccggtacggttaccgggtaaccggaaccggtaacgggtaacggtaacgggtaaacggtaaaccgtacggtaaaacggtcggttacggtacgttacgtaccggaacctcggttcgttacccg

SEQ ID NO: 211379 - DNA, 845 bp, Homo sapiens
  misc_feature: GYAE6OF01BKX2M.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctcgtgggtcccagggtccagtggggatgttgtgatgactcagtcctccgcctctcccgtcgcccgtctacccgttggaccacgggccggtccctccacttcctccgtagtcgaggtctagtcagcgtcctcgtacacgatggagtacgggaaccaccgtcgttagaacgtggtactcgagtacgacggacggacccgtacggacccctaacccgtccgggacggtaccgtaacgtttaaatttagtaaacgttacgtttacgtaaacgggtccgggttaaccgttcccgggggtacccaaggtaaccgaaggttacttacggaacgggtccgggtcgttaacggggttcgggtaccgacggggtaccctaccggttggttaaacctttccggaaccggttagtaacgggaaacgttaacggtaccgtaacggggtaccgggtaagggggtacggggtacggtacgggttacgggtaacgggttaggttttaggggtttaccggtttacggttttaacgttacccggtaccggttacgtaccggtaaccgttagggttaaccgtttaaccggttaccggtaccgggtttcggggttaaccccgggttacggggtaaccccggggtttacccgggaaacccgggggttaaaccgggttaaaccccggggtaaagggttaaaccccgggg

SEQ ID NO: 211380 - DNA, 814 bp, Homo sapiens
  misc_feature: GYAE6OF01CL9KA.26.26.C04.1.454.CMB.1.raw
  modified_base (201)..(201): a, c, t, g, unknown or other
  misc_feature (201)..(201): n is a, c, g, or t
  modified_base (622)..(622): a, c, t, g, unknown or other
  misc_feature (622)..(622): n is a, c, g, or t
tcagagactatactcacgaccggtgctcgatttagtctagcgactttgggtttgggggagataaaagctcagctctacccttgccttgactgatcaggactcctcagttccaccttctcacaatgacggctccctgctcagctccgtgggctgactaatgctcgtcgggccaggtccaggtgggtatggtgtgatgactcngtcctccgccttcctccctcgcccgtcctaccgttggacgacggccgcctactactcctcctgccgtgttacctaagtccgagtaccgtccgttaaccgtaacacgtaagttacggtacggacggggtaaacccctcccggtacttttaacggaaccgttagggaacttcggaaccgcggaagggacccgacccgtaacgggaccctaacccgtccgggaacggttccccgttaaacttttaaagttaacgttaaaggtccttttaaccgaaagggtttcccgggtaaccggttttcccccgggacaaacgggaaccttgttaccgttccggaacggggtcgttacgtacggggttaggcgtaaccgggtcttagttacgttaaccttccgaacgggtcgttaaggaaacgtctaacgggngggttaaccgggggagggtttacgggaagtccggtagggtaacgttcggtttaggttccggtttaggttttacttccgggacgttctacggtaagtacccggttaagttacgtaccgggtcgttaggggtccccggtaggttcccgggttaaacgggacggttaaaccggggaaacgttacgggtaaaacgg

SEQ ID NO: 211381 - DNA, 751 bp, Homo sapiens
  misc_feature: GYAE6OF01BVV5C.26.26.C04.1.454.CMB.1.raw
  modified_base (164)..(164): a, c, t, g, unknown or other
  misc_feature (164)..(164): n is a, c, g, or t
  modified_base (291)..(291): a, c, t, g, unknown or other
  misc_feature (291)..(291): n is a, c, g, or t
  modified_base (453)..(453): a, c, t, g, unknown or other
  misc_feature (453)..(453): n is a, c, g, or t
  modified_base (478)..(478): a, c, t, g, unknown or other
  misc_feature (478)..(478): n is a, c, g, or t
  modified_base (559)..(559): a, c, t, g, unknown or other
  misc_feature (559)..(559): n is a, c, g, or t
tcagagactatactcacgaccggtgctcgatttagtctagcgacttttggggtttgggggactgatcaggactcctcagttcaccttctcacaatgaggctccctgctcagcctccgtggggctgctaatgcttcgtcgggtcccgagggtccgaggtggggtnttggttagtgagtcgacttcacgttcctccgtccttcctccgtccgtacccgttccaccgttacggacgcggccgcctcctactctcgtagcgtagtcgtagtcgacgtcgcgtacgactacgtagngacgtaaccggacctacgtcttaaggactacgtactacgagacgacggaccgcgaccgaccgtaccgtgacgtactacttaatacgtaacttacgttacggacgttacggtaccggtccgacagtacgtagtcgtacgcggacgtgtacggtggacgacgtnacgtgttaccgtacgcgtaacgtanaagtcgtacggaggttcgggaggtaggtaacggtgtaagggacgtttagttacgtttagttcgggtttactctcggtacgngtaacgttaaggtacctttaggtaaccggtggtacccgggttacgttacgggttaacccggtaccgggtaaaacgggtaaaccgggtaaacggttaaaggtaacgggttaaaaccgaaacggttaaacccgggttaagtacccgggttccgttaaacggtacccaacggttaaaccccgtgttttaacccgg

SEQ ID NO: 211382 - DNA, 720 bp, Homo sapiens
  misc_feature: GYAE6OF01BNVMF.26.26.C04.1.454.CMB.1.raw
  modified_base (292)..(292): a, c, t, g, unknown or other
  misc_feature (292)..(292): n is a, c, g, or t
tcagagactatactcacgaccggtgctcgatttagtctagcgactttgggtttgggggactgatcaggactcctcagttcaccttctcacaatgaggcctccctgctcagcctccgtggggctgctaatcgctcgtcgggtcccagggtccaggtggggtatgttgtgatcgactcacgtcctcccgcttcctccctcgcccgtccacccgttggaccgacggccgtcctccacttctcctggccgaggtctagtccagcgtccgtacgtacagtgtgacgtacggaaaccnccgtaccgttacgaacgttgacttccgagacgacgacggacccacggaccgtaaccgtccggacggccgtaacttaatttagtaacgttactttacgttaacggtcggtaaccggttcccgggtacccagacgagtacgttacgacggtccggagttacgggtcggacgacgggtacctagttcgtactttaccgacggtacgtacgaagtacgtacgacgggtacgggtagggtacgggaggtacggtagggtaaggttcggttaggtttaccggttaggttttacgttcgttccggcgttacgacgtaaggttacctacggtttcgaccggttcgggcgttacgtcggtaccggaacggtacgggaacggtagtaagaaccgtacaaacggtcttagggaccgtcgtacgtaccctgttaccgtcg

SEQ ID NO: 211383 - DNA, 753 bp, Homo sapiens
  misc_feature: GYAE6OF01AXL1U.26.26.C04.1.454.CMB.1.raw
  modified_base (614)..(614): a, c, t, g, unknown or other
  misc_feature (614)..(614): n is a, c, g, or t
tcagagactatactcacgaccggtgctcgattttagtctagcgacttttgggtttgggggagataaaagctcagctctacccttgccttgactgatcaggacctcctcagtttccacctttctaccacaatgaggcctcctgctcagcctccgtgggctgactagtgctcgtccgggtcccgagggtccaggtggggtattggttgtgatgacctgtaccgtcctcccgccttccctcccgtccggtcccctcctaccccgttaggaccgcggtcccgaccctccacttccgtcctgccgtagtctagaccgtaggaccgtcccgttactaacgacgtaggtacggacggtaccggacccgtacccttaccgttaggaccgtagtacgtacgacgaccgaggccgaccgaccgacccctaccggaccggaccgtaccgttaactttaagttacgtacttacgtttactacgggttaccgtaccggtacccgggtaaccctagaaccgttggtaccttacggaccgggtcggtacggttacgggtacgggtactaccggtaccgttaacgttacgttaccgttaccgaccgttacgaagtaacgttcgagtacgnggggtagacgggtgtacgtaggtagttaccgtttggttacgtttacgtacgttcgcgtcgtagtacggtagttcgttactccggccggttaggtcccgtacgggttcggtacccggagttaaccggagtaacggtaacg

SEQ ID NO: 211384 - DNA, 715 bp, Homo sapiens
  misc_feature: GYAE6OF01BEDGB.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtcctccgctcctccctcgcccgtcaccccgttggaccagggccggtccctccatcctcctgccgtaggtctagtcgagacgcctcgtaacacgtagtagagtacgggaaacctacccggtccttagaactggaacttcaacggacaggacggacccgacggaccccgtaacccgtccgggacgtaccggtaccttaaagttttaagaaacgtacttttaccgaaggttaccggggtacgttccccggggtaaccaaggaacgtacgtaacttcgaacggtccggacgtaacgggtcggggtacacggggtacctacgtaggttaccttacgaccgtactagaaagtctacgacgacggtagggacggtaggcgtagggacgtagttggtacggttacgtttctacgtcgactgacgtagtacgttacgtcgtacgtcggtccgtagaccggttacggaccgtaaacgggaccggtaaagggtacgtaaacgtaacggaaaccgtaacggtaggttacggacttagaccctaccgtagttaaccgg

SEQ ID NO: 211385 - DNA, 863 bp, Homo sapiens
  misc_feature: GYAE6OF01D92DA.26.26.C04.1.454.CMB.1.raw
  modified_base (172)..(172): a, c, t, g, unknown or other
  misc_feature (172)..(172): n is a, c, g, or t
  modified_base (230)..(230): a, c, t, g, unknown or other
  misc_feature (230)..(230): n is a, c, g, or t
tcagagactatactcacgaccggtgctcgatttagtctagcgactttgggtttgggggactgatcaggactcctcagttcaccttctcacaatgaggctccctgctcagctccgtggggctgctatcgctcgtcgggtcccagggtacaggtggggatggttgtgatgactnacgtcctccgctcctccctcgcccgtcacccgtggacgcggccgcctccgatcctcgngctaggtctacgtcgacgacgtccgtacgtacacgtggtagacgtacggaacctacccggtacgtacgtacgttgtacttacggaagtacgacggtaccggaccgtaaccgggaacccctaaacccggtcccgggaagggttaccccttaaacgtttaaaacgtttaacgttaaacgtttaccgtttaacgttaaaccgggttacccgggttaaccccgggtttccccggggtaacccgtaaggtaacccgtaagggtaacctttaccggggaaacgggtccgggtaacggttacggggttacccgggggtacctaccggggtaccttacggtttaacgttacccgtttaacggacccggtaacgttaacggaacgttaacgtaccgggtaacggttaccgggtagggggtaacggtaacggtacggtacggggtaacggttacggtttagggtttacggtttaacggttttaccgttacggtccggtgtaacgtacggttagttacgttacgttaccggtcggtcgggtacgtccgggtaacgtccggtaacgggtaacgggtaacggtaacggaagttaacgacggtaaacgtgttacgggtacgtacggtccgtaacgtcgttcgtaccg

SEQ ID NO: 211386 - DNA, 776 bp, Homo sapiens
  misc_feature: GYAE6OF01B3B1Y.26.26.C04.1.454.CMB.1.raw
tcagagactatactcacgaccggtgctcgatttagtctagcgactttgggtttgggggactgatcaggactcctcagttcaccttctcacaatgagctccctgctcagctcctgggctgctaatgctcgttgggtcccgagggtccaggtgggattgttgtgatcgactcagtcctccgtctcctcccgtgccccgtcgacccgttggacgacggccgcctccactcctcgtgcgtagtctagtcaggacgtcctacgtaacacgtagttcgacgtacgggaaccaccgttccgttaggaacgttggacttacgacgacgtacggaccggacccgaacggtacccctaaccggtccggacggtaccgtaaccgtttaaagtttaacgtaacgtttaactttacggtaaacggttccgggttaccgtttaccccgggtaccaaggtactacgtacttacggaccggtcggacggtcgggttacggacgacgctacgttacgtacttaccgaacgtacgtaagtacgtagtaccggaggtacgggtaacgggtaggtacggtacgtagggtaacggttagttcggtttaggtttaccgtttaagtcgtacgtccgtaagtacgtaacgtacgttacgttacgacggttcggaccgggtttacgtaaccgggttccgggaaaccgaaacgggttaacccggtaagggttaaccgtaaaacggtaccgaaaccggtttagtcgggtaccgtaccgtaccaaccgttaccgtcgttacccg

SEQ ID NO: 211387 - DNA, 732 bp, Homo sapiens
  misc_feature: GYAE6OF01A83MN.26.26.C04.1.454.CMB.1.raw
  modified_base (559)..(559): a, c, t, g, unknown or other
  misc_feature (559)..(559): n is a, c, g, or t
tcagagactatactcacgaccggtgctcgatttagtctagcgactttgggtttgggggactgatcaggactcctcagttcaccttctcacaatgaggctccctgctcagctccgtggggctgctaatgctcgtgggtcccgagggtccaggtggggatgttgtgatgactcagtcctccgctcctccctcgcccgtccaccgttggacgacgggccgtcctccattcctccgtcgacgtaggttacctagtccaacggtaccgtcccgtacggtaacacgtaggtggaacggtaccgggaaacctacccggtaccgttaagtaacgttggtaacgttcgaacggtcgaacggaccggtacccgaaccggtaccccaacccggtacccgggaacggtacccgttaaccttttaaaagtttaacgtaaacgtttacgtttaacgtaacggttccgggtaaccggttacccgggaccaaggaacgtagtacgtcgacggtcgtcgacggtcggatcggactacgtgtacttcgacgtagtagaagcgtagacggtggagggngacgtgtagtaggtgttggtacgttcgttatcgtcgacgtacgagtacgtatcgtacctacgggttcggaccggttacggtacggttaccgggaaacgtacgggaacggtaaggttaacggaaactccggtaaagtaccggttcggtacgacgtacgtacccgtgtcgttccg

SEQ ID NO: 211388 - DNA, 784 bp, Homo sapiens
  misc_feature: GYAE6OF01BGNNI.26.26.C04.1.454.CMB.1.raw
  modified_base (268)..(268): a, c, t, g, unknown or other
  misc_feature (268)..(268): n is a, c, g, or t
  modified_base (512)..(512): a, c, t, g, unknown or other
  misc_feature (512)..(512): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcgtgggctgactatgctcgtcgggtaccagggtccaggtgggattggttgtgatgactctagtcctccgcctcctcccgtcgcccgtcctaccgttgaccgacgggccgtacctccgacttccgtcncgtacgtaggttctagtacacggtaccgtccctacggtaccacgtaggtagtacggtaccgggaacctacccggttacgtacggtaacgttgtaacttcgagacgacgggacgtccgaaccgtacccgtaacccgtcgacggtacctaacgtttaactttaagtaacgttactttacgtaacgggtaccgggttaccgttccccggggaacccaagtacggtacgttacgtacgcggtaccggngtagggttacggtaccgacggtacttacgtacgtacgtttaccgacgtagaacgtacgacgttacgcgggttacggacggggtggtacgggtacgtacgggttacggttacggttttaagggtttccgtttaaccgggtttaacttcggtacggttaccggtaaagttaccggttaaaggttcctttaaaccgtccgggtaccgttacggggtacccgggttaacgttccgggaccgggtaaacggtacgggtaaaacggtggtaaaacccg

SEQ ID NO: 211389 - DNA, 525 bp, Homo sapiens
  misc_feature: GYAE6OF02GQCEC.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaattataagatttctaatcgggattccggggtccagacagattcagcggcagtgggtcaggcactgatttcacgctgaagatcagcagggtggaggcgtgaggatggttgtcggtttattacgtgcctgcagagttattcgactggccgtggacgttcggacgaagggaccgaagggtaggaaatacgaaacgacgtaggtggcttaggctaccgatcg

SEQ ID NO: 211390 - DNA, 524 bp, Homo sapiens
  misc_feature: GYAE6OF02I5ABC.26.26.C04.1.454.CMB.1.raw
tcagagactatactcacgaccggtgctcgatttagtctagcgactttgggtttggggactgatcaggactcctcagttcaccttctcacaatgaggctccctgctcagctcctgggctgctaatgctctgggtcccagggtccagtgggatgttgtgatgactcagtctccgctctccctgcccgtcacccttggacaggcggcctccatctcctgcaggtctagtcagagccctcgtacacagtgatgggaacaccgccttgaactggattcagcagaggccaggccaacctccgaggcgcctaattataagatttctaatcgggattccggggtccagacagatttcagcggcagtgggtcaggcactgatttcacgctgaagatcagcagggtgaggatgaggatgttgcggtttattactgcctgcagagtattcactggccgttggacgttcggccgaagggaccgaagggttacggaaatacgaaacgtaacgtagttacggcttgctaccgattccg

SEQ ID NO: 211391 - DNA, 511 bp, Homo sapiens
  misc_feature: GYAE6OF02GC70C.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcgggtttattactgcctgcagagtattcactggccgtggacgttcggccaagggaccaagggtggaaatcaaacgaactggtggctgcaccatcg

SEQ ID NO: 211392 - DNA, 502 bp, Homo sapiens
  misc_feature: GYAE6OF02GFTCB.26.26.C04.1.454.CMB.1.raw
  modified_base (439)..(439): a, c, t, g, unknown or other
  misc_feature (439)..(439): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtgaggctgaggatgttgcggtttattactgcctgcagagtattnactggccgtggacgttcggcagggaccaaggtggaatcgaaacgactgtggctgcacatctcg

SEQ ID NO: 211393 - DNA, 513 bp, Homo sapiens
  misc_feature: GYAE6OF02G21EV.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtctagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagatttcagcggcagtgggtcaggcactgatttcacgctgaagatcagcagggtggaggctgaggatgttgcggtttattactgcctgcagagtattcactggccgtggacgttcggccgaagggaccaaggtacgg

SEQ ID NO: 211394 - DNA, 508 bp, Homo sapiens
  misc_feature: GYAE6OF02GQMAO.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtccagacagattcagcggcagtgggtcaggcactgatttcacgctgaagatcagcagggtggaggctgaggatgttgcggtttatactgcctgcagagtattcactggccgtggacgttcggccaagggaccgaaggtaggaaatcgaaacgatggtggctgcaccatcg

SEQ ID NO: 211395 - DNA, 507 bp, Homo sapiens
  misc_feature: GYAE6OF02GM96R.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtccagacagattcagcggcagtggtcaggcactgatttcacgctgaagatcagcagggtggaggctgaggatgttgcggtttattactgcctgcagagtattcactggccgtggacgttcgccgagggaccaaggtggaaattcgaaacgtactgtggctgacaccatctcg

SEQ ID NO: 211396 - DNA, 786 bp, Homo sapiens
  misc_feature: GYAE6OF02GMSSX.26.26.C04.1.454.CMB.1.raw
tcagagactatactcacgaccggtgctcgatttagtctagcgacttgggttgggtgatctaggggactcctcacgttcaccttctcgaacaatcggaggtctcccttggctcagctcctggggctagctaatggctctcgggtcccaggggtcctaggtggggatgttgtggtactggtactcagttactccggctcctccctgccccgtcgacccttggacaggcgggcctccatcggtccgtggccgacggtctacgtcgaagacgcctcggtacacacgtgatgggaacacccgccttgaacttggattcagcgagaggccaggccaaccgtccgaggcggcctaacttaagtaacgactttacgtaatacggggattccgggggtccaggtacgagaattcaagtcggacgaaggtgggttacgaagggtcaacgtacgaacttttaccgaacgtccgttacggaaaggaacgtccgaaggtccgaacgggggttcgggacgggacgtaggaacggtaagttacggttaggtaccgggttttaacttaaccgttcggtacccgttaggtaccgtaaggtaacgttaacgttttaccgtaaccgttacgggtaccccggttaacgggtaaccggttttaccggggacccggtaaacgggggaacccgtaaacgggggttaacgggtaaaaccgttaccggtaaaaacggttaaccgttaaggggttaccgggtaccggttacgggacccccgtaacccgtacggttacccggtttaccccggg

SEQ ID NO: 211397 - DNA, 515 bp, Homo sapiens
  misc_feature: GYAE6OF02IK0ZJ.26.26.C04.1.454.CMB.1.raw
  modified_base (468)..(468): a, c, t, g, unknown or other
  misc_feature (468)..(468): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgccccgtcacccttggacaggcggcctccatctcctgcaggtctagtcagagcctcgtacacagtgatgggaacaccgccttgaactggattcagcagaggccaggccaacctccgaggcgcctaattataagatttctaatcgggattccggggtcccagacagattcagcggcagtgggtcaggcactgatttcacgctgaagatcagcagggtggaggctgaggatgttgtcggtttattactgcctgcagngtattcactggccgtggacgttcggaccgaagggaccgaggtaacgg

SEQ ID NO: 211398 - DNA, 520 bp, Homo sapiens
  misc_feature: GYAE6OF02F6ODQ.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcaggtgggtcaggcactgatttcacgctgaagatcagcgagggtggaggctgaggatgttgcggtttattctgcctgcagagtattcacgtggccgtggacgttcggaccgaagggaccaagggtaggaaatcgaaacgtactaggtacggctaggcaccatcg

SEQ ID NO: 211399 - DNA, 510 bp, Homo sapiens
  misc_feature: GYAE6OF02GW8CW.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgatctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtccagacagattcagcggcagtgggtcaggcactgatttcacgctgaagatcagcagggtggaggctgaggatgttgcggtttatactgcctgcagagtattcactggccgtggaccgttcggccaagggaccaagggtggaaatcgaaacgaactgtcggctagcacatcg

SEQ ID NO: 211400 - DNA, 505 bp, Homo sapiens
  misc_feature: GYAE6OF02IH9ZY.26.26.C04.1.454.CMB.1.raw
  modified_base (491)..(491): a, c, t, g, unknown or other
  misc_feature (491)..(491): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtatagtcagagcctcgtacacagtgatgggaacaccgccttgaactggattcagcagaggccaggccaacctccgaggcgcctaatttataagatttctaatcgggattccggggtccagacagattcagcgcagtgggtcaggcactgatttcacgctgaagatcagcagggtggaggctgaggatgttgcggtttatactgcctgcagagtattcactggccgtggacgttcggccaacgggacaagggtgaaatcaaacgaatgnggctggcaccatcg

SEQ ID NO: 211401 - DNA, 515 bp, Homo sapiens
  misc_feature: GYAE6OF02FRUSM.26.26.C04.1.454.CMB.1.raw
tcagagactatactcacgaccggtgctcgatttagtctagcgactttgggtttgggggactgatcaggactccctcagttcaccttctcacaatgaggctccctgctcagtctcctgggctgctaatgctctgggtcccagggtccagtgggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccgggtccagacagattcagcggcagtgggtcaggcacgtgatttcacgctgaagatcagcagggtggaggctggaggatgttgcggtttatactgcctgcagagtattcacgtcggccgtggacgttccggccgaaggaccgaaggtaggaaactcgaaacgacgtgtggctgcaccgatcg

SEQ ID NO: 211402 - DNA, 526 bp, Homo sapiens
  misc_feature: GYAE6OF02IH1N2.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtccagacagattcagcggcaggtgggtcaggcactgatttcacgctgaagatcagcagggtggaggctggaggatggttgcggtttattacgtgcctgcagtagtattcacgtcggccgtggacgttcggaccgaagggaccgaagggtaggaaataccgaaacgaacgtggtaggcctgacaccatc

SEQ ID NO: 211403 - DNA, 820 bp, Homo sapiens
  misc_feature: GYAE6OF02G8X6B.26.26.C04.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (301)..(301): a, c, t, g, unknown or other
  misc_feature (301)..(301): n is a, c, g, or t
tcagagactatactcacgaccggtgctcgatttagtctagcgactttgggtttgggggaggaactgctcagttaggacccagccggaaccatggaagccccagcgcagcttctcttcctctgctactctggctcccagataccactggagaaatagtgatgacgcagtctccagccacctgtctgtgtctccgaggggaanagtcacctntcctgcagggccagtcagagtgttagtcgcggcttagcctggtaccagcagacaccgtgggcagacctcccgaggtcctcctctatttacngctggcctatcccgaaccgagggccctaacgttcgggtaacctccccgaggcccgtaagggtttaccaaggttcggacctagggttcggggtacctagggggaactaagggtacgtttccgaaccgtttccgtaccctaaccctaagttaccgaacggtaccgaacggtccccgttacggaccgtaacggtttaccgttaacggtaaaaggttaacgttttacgggtacggttaaccgttttaaaagttttttaacgtttaaaccgttggttaaccgtaacgggtaaccttaaaaagtttaacgtttaaaaccgttaacccggttaccgggtacccctttacccgggttaccctttaaccgttaaccggtttttcccggggaaccggggttaacggggtaaacccggttaaaggggtttacggtaaacggttaaacgttaaacccggtaaaaaccggttaacggtttacgggttaccgggtacctttacgggtaacccgtaacccgtacgtttacccgg

SEQ ID NO: 211404 - DNA, 525 bp, Homo sapiens
  misc_feature: GYAE6OF02GWW6X.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaattataagatttactaatcgggattccggggtcccagacagattcagcggcagtgggtcaggcacgtgatttcacgtctgaagatcagcgagggtggaggcgtgaggatgttgtcggtttattacgtgcctgctaggagtattcgacgtggccgtggtacgttcggaccgaagggaccgaaggtacgg

SEQ ID NO: 211405 - DNA, 552 bp, Homo sapiens
  misc_feature: GYAE6OF02JIBV2.26.26.C04.1.454.CMB.1.raw
  modified_base (463)..(463): a, c, t, g, unknown or other
  misc_feature (463)..(463): n is a, c, g, or t
tcagagactatactcacgaccggtgctcgatttagtctagcgactttgggtttgggggtaggagtaaaagactcagctctacccttgccttgactgatcaggactcctcagttcaccttctcacaatgaggctccctgctcagctcctgggctgctaatgctctggtcccagggtccaggtggggatgttgtgatgactcagtctccgctctccctgcccgtcacccttggacaggcgcctcatctcctgcaggtctagtcagagcctcgtacacagtgatgggaaccaccgccttgaactggattcagcagagccaggccaacctcggaggcacctaatttataagatttactaagtcggggtacttccggggtacccaagaccaggtacttcgagcggctaggtggtcgaggcactgtactttcgacgctagaagatcagcgagggtggaggctagggagnttggttcgaggttttatacgtgcctgcaggtaagttctacgacgtggtcggtaggtaccggttcgaccgaacgggaccgtaaggtacgg

SEQ ID NO: 211406 - DNA, 608 bp, Homo sapiens
  misc_feature: GYAE6OF02JC3DT.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccgggtccagacagattcagcggcaggtgggtcaggcactgatttcacgtctgaagatcgagcgaggggtggacgggtcgtggaggtattggtttggtcgggttttattacgtggtcctggaccaggtagttattccgacgttgggtcccggttagggtaccggtttaccgggacccgtaacggggaacccgtaaaggggttacggaaaacgttaccgaaaaccggtaaccgttagggtacgggtaccgttacggaccctaacccgtagttacccg

SEQ ID NO: 211407 - DNA, 502 bp, Homo sapiens
  misc_feature: GYAE6OF02F7OIO.26.26.C04.1.454.CMB.1.raw
tcagagactatactcacgaccggtgctcgatttagtctagcgactttgggtttggggactgatcaggactcctcagttcaccttctcacaatgaggctccctgctcagctcctgggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttatactgctgcagagtatcactggccgtggacgttcggacgaagggacgaaggtggaaatcgaacgatagtggctgcacatcg

SEQ ID NO: 211408 - DNA, 530 bp, Homo sapiens
  misc_feature: GYAE6OF02I5BSQ.26.26.C04.1.454.CMB.1.raw
  modified_base (425)..(425): a, c, t, g, unknown or other
  misc_feature (425)..(425): n is a, c, g, or t
tcagagactatactcacgaccggtgctcgatttagtctagcgactttgggtttgggggtacgtgatcaggactcctcagttcacctcctcacaatgaggctccctgctcagctcctgggctgctaatgctctgggtcccagggtccagtggggatgttgtgatgactcagtctccgctctccctgcccgtcacccttggacaggcggcctccatctcctgcaggtctagtcagagcctcgtacacagtgatggaacaccgccttgaactggattcagcagaggccaggccaacctccgagcgcctaattataacgatttctaatcgggattccgggtccagacagattcagtcgcagtggtcaggcaactgatttcacgctcgaagatacagcagggtgaggctgaggatgtgtcggttattacngtcctgccagagtattcgactggtcgtcgggacgttcggccgaagggacctaagggtaggaagtacaaaccgaagtacgtacggtcgtcggacgacctagttacg

SEQ ID NO: 211409 - DNA, 520 bp, Homo sapiens
  misc_feature: GYAE6OF02I4NCX.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtacagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccgggtccagacagattcagcggcagtggtcaggcactgatttcacgctgaagatcagcaggggtgaggctgaggatgttgcggtttattactgccgtgacagagtattcacgttggccgtggacgttcggaccgaagggacccgaaagggtggaaatacgaaacgtagtgtaggcctagcaccatcg

SEQ ID NO: 211410 - DNA, 509 bp, Homo sapiens
  misc_feature: GYAE6OF02HTPJ0.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggttttatactgcctgcagagtattcactggccgtggacgttcggccaagggaccaagggtggaaatcgaaacgaactgtggctgcaccatctcg

SEQ ID NO: 211411 - DNA, 528 bp, Homo sapiens
  misc_feature: GYAE6OF02J060I.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctgggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaattataagatttctaatcgggattccggggtcccagacagattcagcgcagtgggtcaggcactgatttcacgctagaagatcagcgagggtggaggcgtgaggagttgttgtcggttttatacgtgccgtgcgtagtagttattcacgtggccgtggtaccggttcggaccgaagggtaccgaggtaacgg

SEQ ID NO: 211412 - DNA, 511 bp, Homo sapiens
  misc_feature: GYAE6OF02HOBYN.26.26.C04.1.454.CMB.1.raw
  modified_base (462)..(462): a, c, t, g, unknown or other
  misc_feature (462)..(462): n is a, c, g, or t
tcagagactatactcacgaccggtgctcgatttagtctagcgactttgggtttggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgagcgcctaattataagatttctaatcgggattccggggtccagacagattcagcggcagtgggtcaggcatgatttcacgctgaagatcagcagggtgaggctgaggatgttgcggtttattacgtgcctgcagngtattcacgtggccgtgggacgttcggccgaagggaccaagggtaacgg

SEQ ID NO: 211413 - DNA, 638 bp, Homo sapiens
  misc_feature: GYAE6OF02HXYKU.26.26.C04.1.454.CMB.1.raw
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
tcagagactatactcacgaccggtgctcgatttagtctagcgactttgggtttgggggtacgtggagtcaggactcctcagttcaccttctcacaatgaggctccctgctcagctcctgggctgctaatgctctgggtcccagggtccagtggggatgttgtgatgactcagtctccgctcctccctgccccgtcacccttcggacaggcggcctccatcctcctgccaggtctagtcagancctcgtanaccagtgatgggaacaccgctagactggattcagcagaggccaggccaacctccgaggccgcctaacttataaacgtatttactaattcgggtacgttccggggtaccagaccagtacttacgagcggcaggtgggtcgaggcacgttcgatttcgacgtcgtagtaacgagtcacggcgtaggggtggagggcgtaggacgggtagttaggttggttacggttttaagttacgtcggttccgtacggacgtacggtagttacttaccgtacgttcgggtaccggtcgggtaccggtttccggaccggtaacgggaccgaaagggtacgggtaaataccggtaaaacgaccgttaggtcgggtaccgttaggaccgtaccgattaccg

SEQ ID NO: 211414 - DNA, 511 bp, Homo sapiens
  misc_feature: GYAE6OF02GE79X.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtacagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccgaagggaccgaaggtggaaatcgaaacgacgtgtggctgcaccatcg

SEQ ID NO: 211415 - DNA, 537 bp, Homo sapiens
  misc_feature: GYAE6OF02I7VF0.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgagtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagagccaggccaaccgtccgaggccgacctaatttataagtatttctaaagtcgggacttccggggtaccagacagtattcaggcgcagtggtcaggcactgatttcacgctagaagatcgagcgagggtggaggctggaggtatgttgtcgtttatacgtgcctgcgagtagtattcacgtggcgtgtacgttcggacgtaacgggacgtaaggtaggaaatacgaaacgtacgtggtggtacgtcgaccgtactacg

SEQ ID NO: 211416 - DNA, 509 bp, Homo sapiens
  misc_feature: GYAE6OF02FPZUP.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctgggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtccagacagattcagcggcagtgggtcaggcactgatttcacgctgaagatcagcagggtggaggctgaggatgttgcggtttattacgtgcctgcagagtattcactggccgtggacgttcggccaagggaccgaaggtaggaaagtcaaacgactgtggctgcaccatcg

SEQ ID NO: 211417 - DNA, 502 bp, Homo sapiens
  misc_feature: GYAE6OF02F7IEX.26.26.C04.1.454.CMB.1.raw
  modified_base (488)..(488): a, c, t, g, unknown or other
  misc_feature (488)..(488): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagagccaggccaacctccgaggcgcctaatttataagatttctaatcgggattccggggtccagacagattcagcggcagtgggtcaggcactgatttcacgctgaagatcagcagggtgaggctgaggatgttgcgtttatactgcctgcagatatcactggccgtggacgttcggcaagggaccaaggtgaaacgtcaaacgactggnggctggcaccatcg

SEQ ID NO: 211418 - DNA, 520 bp, Homo sapiens
  misc_feature: GYAE6OF02I90NQ.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgccccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtccagacagattcagcggcagtggtcaggcactgatttcacgctgaagatcagcgagggtggaggcgtggaggatgttgtcgtttatactgcctgcagagtattcacgtgtccgtggtaccgttcgggaccgtagggacctaaggtggaaactcgaaacgactggtaggctagcactatcttcg

SEQ ID NO: 211419 - DNA, 548 bp, Homo sapiens
  misc_feature: GYAE6OF02FVVS3.26.26.C04.1.454.CMB.1.raw
  modified_base (255)..(255): a, c, t, g, unknown or other
  misc_feature (255)..(255): n is a, c, g, or t
tcagagactatactcacgaccggtgctcgatttagtctagcgactttgggtttgggggactgatcaggactcctcagttcaccttctcacaatgaggctccctgctcagctcctgggctgctaatgctctgggtcccagggtccagtggggatgttgtgatgactcagtctccgctctccctgcccgtcacccttggacaggcggactccatctcctgcaggtctagtcagagcctcgtacacagtgatggaacncgccttgaactggattcagcagaggccaggccaacctccgaggcgcctaatttataagatttctaatcgggattccggggtccagacagattcagcggcaggtgggtcaggcactgatttcagctgaagatcgagcagggtggaggctggaggatgttgtcggtttatacgtgcctgacagtagtatcgacgtggccgtggtaccgttcggaccgtaacggggaccgtaagggtacggtaaacgtaccgaaaacggtacgttggtacggacgtacggacctaccgagttaccg

SEQ ID NO: 211420 - DNA, 546 bp, Homo sapiens
  misc_feature: GYAE6OF02FSOCA.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccgggtccagacagattcagcgcagtggtcaggcactgatttcacgctgaagatcagcagggtggaggctggaggatgttgcggtttaattacgtgccttgactagagttattcacgtggccgtgggtacgttccggaccgaaggggaccgaagggtacggaaaagtaccgaaaacggaacgtggtacgggaccgttcggaccaccgagttccg

SEQ ID NO: 211421 - DNA, 554 bp, Homo sapiens
  misc_feature: GYAE6OF02F8GLR.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtacagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaaccgtccgaggcgcctaatttataagatttctaatcgggattccggggtccagacagattcagcggcagtgggtcaggcacgtgactttcacgtctagaagatcagcgaggggtggaggctggaggagttggttggtacggtttaattacgtgtccgtgccagtagttacttcacgtggccgtggacgttcggaccgaagggacccgtaagggtacggaaacgtacgaaacggtactaggtcggacgtcgacacccgtatccg

SEQ ID NO: 211422 - DNA, 529 bp, Homo sapiens
  misc_feature: GYAE6OF02FSOEY.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggtattccggggtccagacagattcagcggcagtgggtcaggcactgatttcacgctgaagatcagcagggtggaggctgaggatgttgtcggtttattactgccgtgcagagttattcacgtggccgtggacgttcggccgaagggaccgaagggtaggaaacgtaccgaaacggtaacgtggtggacctggctaccatcg

SEQ ID NO: 211423 - DNA, 543 bp, Homo sapiens
  misc_feature: GYAE6OF02JWJMJ.26.26.C04.1.454.CMB.1.raw
  modified_base (396)..(396): a, c, t, g, unknown or other
  misc_feature (396)..(396): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggccgcctaatttataagatttctaatcgggaattccggggtcccagaccagatttcagcggcaggtgggtcaggcacgtgactttcacgctgaagntcagcagggtgaggctggaggatgttgtcggtttatacgtgtcctgcagtagtattcgacgtggtccgtggacgtttcggaccgtaagggaccgaagggtacgaaacgtacgaaacgacgtaggtcggacgtgaccgacctattccg

SEQ ID NO: 211424 - DNA, 509 bp, Homo sapiens
  misc_feature: GYAE6OF02G8IGX.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaattataagatttctaatcgggattccggggtccagacagattcagcgcagtggtcaggcactgatttcacgctagaagatcagcagggtgaggctgaggatgttgcggtttattactgtcctgcgagtagtattcacgttggccgtggacgttcgccgagggaccaaggtggaaatcgaaacgacgtgacggctgcaccatctcg

SEQ ID NO: 211425 - DNA, 506 bp, Homo sapiens
  misc_feature: GYAE6OF02HBO38.26.26.C04.1.454.CMB.1.raw
  modified_base (461)..(461): a, c, t, g, unknown or other
  misc_feature (461)..(461): n is a, c, g, or t
tcagagactatactcacgaccggtgctcgatttagtctagcgactttgggtttggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaattataagatttctaatcgggattccggggtccagacagattcagcggcagtgggtcaggcactgatttcacgctgaagatcagcagggtgaggctgagatgttgcggtttatactgcctgcagngtattcactggccgtggacgttcggccaagggtaccaaggtacgg

SEQ ID NO: 211426 - DNA, 712 bp, Homo sapiens
  misc_feature: GYAE6OF02JB1AM.26.26.C04.1.454.CMB.1.raw
  modified_base (268)..(268): a, c, t, g, unknown or other
  misc_feature (268)..(268): n is a, c, g, or t
tcagagactatactcacgaccggtgctcgatttagtctagcgactttgggtttgggggactgatcaggactcctcagttcaccttctcacaatgaggctccctgctcagctcctgggctgctaatgctctgggtcccagggtccagtggggatggttgtgatgactcgagtctccgctctccctgcccgtcacccgttggaccaggccggcctccatcctcctgctaggtctagtcagacgtcctacgtacacgagtgagtaggaacnccgtccttagacgtggtactcgagcgagacggccgacggtacccaccgtccggacggccgtaccttaagtttacgtaagttactttacgtaacgttccgggtacgttcccggggtaccaggtacgtagtacttacgacggccggtacgtagggttcgggtaccgtacggtacctacgtcgtacgtttccgacggtcgtagaacgtacgtacgacggtcggtaacgggtacggacggtcgtaggtaggttagttgggttcggttacggtttacgttacgtcggtccgttcggacgtagtacgttacgttaccgtacgttcgggtaccggttacgggtaccgggttaccggaccggtaacgggtaaccggtaagggtaacggtaaacggtaaccgtaaacggtaccgttaggtaccggtaccgtacggacccgtaccgtacgttcg

SEQ ID NO: 211427 - DNA, 552 bp, Homo sapiens
  misc_feature: GYAE6OF02HPDIU.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaattataagatttactaatcgggattccggggtacccagaacagattcagcggcagtgggtcaggcaactgatttcgacgctagaagatcagcagggtggaggctgagatgttgtcggtttattactgcctgcaagagttattcacgtgggccgtagggacgttcgggaccgaagggaacccgaagggtacggaaaacttcgaaaaaccgtaacgtaggtcggaccgtacggacgacccagttccg

SEQ ID NO: 211428 - DNA, 613 bp, Homo sapiens
  misc_feature: GYAE6OF02F6RBQ.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatcctcctgcaggtctagtcagagcctcgtacacagtgatgggaacaccgccttgaactggattcagcagaggccgaggcccaaccgtccgaggccgtaccttaaatttaataaagtacttttacgtaaacgtcggggtacgttcccgggggtacccaacgacgtagtactttacgaaggtccggacgtagggtgggtcgtacggctacgtgtacgtttccgacgtacgtagaagtatcgacgacgtagggtggaggtcgtaggaggtagttggttgtacggtttattacgtcgtccgtgcgagtagttacttacgtacgttcggtcggtacgggtaccggttcggaccgtaacgggtaccgtaaggtaacgg

SEQ ID NO: 211429 - DNA, 644 bp, Homo sapiens
  misc_feature: GYAE6OF02IWGJ6.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagacgcctcgtacacagtgatgggaacaccgccttgaactggattcagcagacggccaggccaacctccgaaggccgaccttaatttataaagtattttactaatcgggattcccggggtaccagacagattcagcgcaggtggtcaggcactgatttcacgctagaagatcgagcgagggtggaggctggaggtattggttcgtacgggttttaattcgtgtccgttaggccgtaaggtacgttatttaccgtaacggttcgggtacccggttacggtaaccggtttaccggggacccgtaaacgggggtaacccgtaaaggggtaacgggtaaaaccgttaaccggaaaaaaccggtaaccggtttagggtacgggtaccgttaacgggaccctaacccgtaagtttcccgg

SEQ ID NO: 211430 - DNA, 533 bp, Homo sapiens
  misc_feature: GYAE6OF02JBOJL.26.26.C04.1.454.CMB.1.raw
  modified_base (529)..(529): a, c, t, g, unknown or other
  misc_feature (529)..(529): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtccagacagattcagcggcaggtgggtcaggcacgtgattttcacgtctagaagatcagcgaggggtggaggctggaggtatgttgtcggtttatactgcctgcagtagtattcacgtggccgtggacgttcggaccgaagggaccgaagggtcgaaacgtacgaaacgaacgtggtacggctagcctacnttcg

SEQ ID NO: 211431 - DNA, 644 bp, Homo sapiens
  misc_feature: GYAE6OF02I6GZP.26.26.C04.1.454.CMB.1.raw
  modified_base (132)..(132): a, c, t, g, unknown or other
  misc_feature (132)..(132): n is a, c, g, or t
  modified_base (146)..(146): a, c, t, g, unknown or other
  misc_feature (146)..(146): n is a, c, g, or t
  modified_base (177)..(177): a, c, t, g, unknown or other
  misc_feature (177)..(177): n is a, c, g, or t
  modified_base (186)..(186): a, c, t, g, unknown or other
  misc_feature (186)..(186): n is a, c, g, or t
  modified_base (270)..(270): a, c, t, g, unknown or other
  misc_feature (270)..(270): n is a, c, g, or t
  modified_base (430)..(430): a, c, t, g, unknown or other
  misc_feature (430)..(430): n is a, c, g, or t
  modified_base (640)..(640): a, c, t, g, unknown or other
  misc_feature (640)..(640): n is a, c, g, or t
tcagagactatactcacgaccggtgctcgatttagtctagcgactttgggttgggggacctgatcaggactcctcagttcaccttctcacaattgacggtctaccctgtactcagctcgtcgggctagctanggcgtctgggtccngggtccaggtgggatgttacgagatggactnaagtctcgntcgtcctgccgtcaccgtgactcggccgcctccatctcgtgacgacgtactagcacgtcgctcgtacacagtgagtacggaccncgctagaacgtggaactcgagtcgagtacggtccaggacccgtaaccgccgggaccggaccccgaccgtttaaagtttaacggtaacgtaacttacggtacggtccggggtaacgttcccggggtacctaagaccgtaggtacgttaccgacggtacggngtacggtcggtacagtcgactcgtacttacgacgcgtacgtagtctccgacgcgtacggtacggacggtacgtaggtacggtacgttcgggttacggtaccgttaagtccggtcggaccgttggacctagggtcgtagttcgaacgttcgacgtcgtacgtcgacgacgacgtaggacgactacgaacggtacgtggcgtcacggcacgntacg

SEQ ID NO: 211432 - DNA, 511 bp, Homo sapiens
  misc_feature: GYAE6OF02FNBYQ.26.26.C04.1.454.CMB.1.raw
tcagagactatactcacgaccggtgctcgatttagtctagcgactttgggtttggggactgatcaggactcctcagttcaccttctcacaatgaggctccctgctcagctcctgggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaactccgagcgcctaatttataagatttctaatcgggattccggggtcccagacagattcagcggcagtgggtcaggcactgatttcacgctgaagatcagcagggtggaggctgaggatgtttgcggtttattactgcctgcagagtattcactggccgtggacgttcggaccaagggaccgaaaggtggaaagtcaaacgaacgtagtggcgtgcaccatc

SEQ ID NO: 211433 - DNA, 655 bp, Homo sapiens
  misc_feature: GYAE6OF02I39X6.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagacgcctcgtacacagtgatgggaacaccgccttgaactggattcagcagaggccaggcccaacgtccgaggccgaccttaatttataagtatttactaaagtcgggacgtttcccggggtacccagaccagtacttcgaggtcggcgtaaggtgggtacaggcacgtgatttccaacgctagaagtacgtacaggacgagggtggacggtcgtaggaaggtattggtttaggtacggttttaacttacgtcggtcccgttaggaccgtaaggtacgttacttaccgaacgttgggtacccggttacggtaaccggtttccgggacccggtaaggggtaccgaaaggggttacgggaaaactaccgtaaaaccggtaacgttagggtacggtaccgttacggaaccgtacccgtaagtccgttacgg

SEQ ID NO: 211434 - DNA, 614 bp, Homo sapiens
  misc_feature: GYAE6OF02G9FL2.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgcttgaactggatcagcagaggccaggaccaaccgtccgaggccgaccttaatttataaagtacttttactaagtcgggtacgttcccgggggtacccagacagtattcgagcggcaggtgggtcaggcacgtgactttcgacgctagaagatcgaggacgagggtggaggtctaggaggtagttggttgtcggtttattacgtgtcgtagacgtagtagttacgttcacgttcgggccggttaggaccgtttcgggaccgtaacggggtaaccgtaaaggggttacggaaaacgttaaccgaaaacggttacgttagggtacgggtaccgtaggtaccctaaccgtagttccgttacg

SEQ ID NO: 211435 - DNA, 830 bp, Homo sapiens
  misc_feature: GYAE6OF02ICJKT.26.26.C04.1.454.CMB.1.raw
  modified_base (240)..(240): a, c, t, g, unknown or other
  misc_feature (240)..(240): n is a, c, g, or t
tcagagactatactcacgaccggtgctcgatttagtctagcgactttgggtttgggggactgatcaggactcctcagttcaccttctcacaatgaggctccctgctcagctcctgggctgctaatgctctgggtcccagggtccagtggggatgttgtgatgactcagtctccgctctccctgcccgtcaccttggacaggcgcctccatctcctgcaggtctagtcagacgcctcgtanacagtgagtacgggaacacccgtccttgaacgtggtattcgagcagacggccacggacccaaaccgtcccggacggtccgtaccctttaaattttaacgtaaacgttacttttacgtaaacggttccggggtaacgtttcccgggggtaccccaaggaaccgacggttactttccgaaggccggtacgtaacgggttcggggttaccgaagggacctacgttacgttaacgtttttacccgaacggtccttaagggaaacgtaacgttacgaacggtacgggtaaggggggttacggggaacgggtcggttaagggtaacgggttaacggttttacgggttttacgggtttaccggggttttttaaacgtttaaccggttccggtacccggttacggtaccgtaagggtaacgtttacgtttacccgtaacggttccgggggtaccggttacggggttacccgtttaccggggaacccggtaaacgggggtaacccgtaaaagggggttaacggtaaaacgttaaccggtaaaaccggtaacggttacgggtacggtaccgtaccgggtacctacccgtaacgtttccgg

SEQ ID NO: 211436 - DNA, 610 bp, Homo sapiens
  misc_feature: GYAE6OF02FWF3E.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatcctcctgcaggtctagtcagagcctcgtacacagtgatcgggaacaccgccttgaacgtggattcgagcaggacgccgagggcccaaccgtccggaggccgtacctaaagttttaataaagtattttacgtaaacgtcgggtaacgttccccgggggtacccaaggtaaccgagtaactttcgaggccggacagggtcgggtcgaagggcctacgtgtactttaccgaccgtcgtagaagtactcgaagcgaggggtggaggctaggaggtagtggttagtcgtttactacgtgtccgtgcgtagtgtacttcgtacgtcgggtccgtggtaccgttaccggacgtaacgggaccgaagggtaacgg

SEQ ID NO: 211437 - DNA, 550 bp, Homo sapiens
  misc_feature: GYAE6OF02IY5YT.26.26.C04.1.454.CMB.1.raw
  modified_base (424)..(424): a, c, t, g, unknown or other
  misc_feature (424)..(424): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgccaggtctagtcagagcctcgtacacagtgatgggaacaccgccttgaactggattcagcagaggccaggccaaccctccgaggcgaccctaattataagtatttttaagtcgggatttccggggtccagacagattcagcggcagtgggtcaggcactgattcacgtctgaagntcgagcgagggtggaggcgtagaggtatggttgcgttttaatactagcctgccgtagacgttattactacgtcggcccggtggtaccggttcgggacccgaaggggtacctaacgggtggtaaacg

SEQ ID NO: 211438 - DNA, 603 bp, Homo sapiens
  misc_feature: GYAE6OF02GEXGB.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaattataagatttctaatcgggattccggggtcccagacagattcagcggcaggtgggtcaggcactgagtttcacgctgaagatcagcgagggtggaggcgtggagggtagttggttgtacgggtttattacgtcgtccgtgtaccgaaggtagttacgtttccgacgttcgggtccggttcgggtaccggtttccgggacccgtaacggggaacccgtaagggtaacgggaaacgttaaccgaaaccggtaacgttaggtacggtaccgtacggacctaaccgtacgttcgttaccgg

SEQ ID NO: 211439 - DNA, 588 bp, Homo sapiens
  misc_feature: GYAE6OF02H8CJ6.26.26.C04.1.454.CMB.1.raw
  modified_base (310)..(310): a, c, t, g, unknown or other
  misc_feature (310)..(310): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagacgcctgtacacagtgatgggaaccaccgccttgaactggattcagcagaggccaggcccaacctcgaggcgctaatttanaagatttctaagtcggacgttccggggtccagacagtacttcgagcggacgtaggtggtcaggcagtgatttcacgctagaagatcgagcgagggtggaggctggaggtagttggtttagtacggtttattacgtgtccgtgacgagtagttagttcacgtcgggtccggtggtaccggttcgggaccgtaaggggtacccgtaagggtaggtaaaacgtcgaaaacggttaaccgtggtacggacgtacggtacctaaccgtacgttacgttaccgg

SEQ ID NO: 211440 - DNA, 588 bp, Homo sapiens
  misc_feature: GYAE6OF02JYAI2.26.26.C04.1.454.CMB.1.raw
  modified_base (341)..(341): a, c, t, g, unknown or other
  misc_feature (341)..(341): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctgggctgctaatgctctgggtcccagggtccagtgggatgttgtgatgactcagtctccgctctccctgcccgtcacccttggcagcggcctccatcctcctgcaggtatagtcagagccttcggtacacagtgatgtaaccacccgtccttgaactggaattcagcagtacggccaggcccaacctccgagggtccnccttaaattactaacgattttcaaatcggggtacttcccggggtcccagccagacttcagcgcagtggtcaggcactgactttcacgtctgagatcagcacgggttggacggctaggacggtattcgtttggacgttttattacgtgcccttgaccaggtaacgttaacgttcccgtaacgttcggggcccgttagggacccggtttaccgggacccgtaacggggtacccgtaagggttaaccggg

SEQ ID NO: 211441 - DNA, 534 bp, Homo sapiens
  misc_feature: GYAE6OF02FTHYF.26.26.C04.1.454.CMB.1.raw
  modified_base (390)..(390): a, c, t, g, unknown or other
  misc_feature (390)..(390): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctgggctgctaatgctctgggtcccagggtccagtggggatgttgtgatgactcagtctccgctcctccctgcccgtcacccttggacaggcgcctccatctcctgcaggtctagtcagagcctcgtacacagtgatgggaacaccgccttgaactggattcagcagaggccaggcccaacctccgaggccgcctaaatttataagatttactaatcggattcccggggtcccagacagatcagcggnagtgggcaggcacgtgtatttcacgtctgaagatcgagcaggtgtggaggctggaggattggttgtcggtttaattacgtgtcctgacgaagtagttattcacgtggccgtggtaccgttccggaccgtacgggaccgtaaggg

SEQ ID NO: 211442 - DNA, 551 bp, Homo sapiens
  misc_feature: GYAE6OF02GC9HH.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggcccaacctccgaggcgcctaatttataagatttctaatcgggattccggggtccagacagattcagcggcaggtgggtcaggcactgatttcacgctagaagatcgagcgagggtggaggtcgtggaggtagttggttgtacggtttattacgtcgtccgtgcgaggtagttattcgtacgtgggccgtggtaccgttcggaccgacgggaccgtaagggtaggaaatacgaaacggaacgtggtacggctagccactagtcttcg

SEQ ID NO: 211443 - DNA, 676 bp, Homo sapiens
  misc_feature: GYAE6OF02IX1HI.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctgggctgctaatgctctgggtcccagggtccagtggggatgttgtgatgactcagtctccgctctccctgcccgtcacccttggacaggccgcctccatctcctgcaggtctagtcagagcctcgtacacagtgatgggaaccaccgcttagaactggattcagcagagccaggtacccaaccgtcgaggcgaccctaattaactaagtatttactaagtcgggtaattcccgggggtaccaagaccgaagtactttaccgagtaccggacgtacggtgggtacaacgggctaaacgtcggtaacgtttaccgacgtccttaggaacgtaagttaccgaggtaccgaggggttagggacggtacgttagggaacggtacgttgggtttacggttaccgggttttaatttaccggtagtcccgttacgggacgtaaggtaacggttaagtttccgtaaccggttcgggtaccggttaccgggtacggttacccgggtacggtaaaccgggtaacccggtaagggttaaaccggg

SEQ ID NO: 211444 - DNA, 539 bp, Homo sapiens
  misc_feature: GYAE6OF02F082P.26.26.C04.1.454.CMB.1.raw
  modified_base (390)..(390): a, c, t, g, unknown or other
  misc_feature (390)..(390): n is a, c, g, or t
  modified_base (533)..(533): a, c, t, g, unknown or other
  misc_feature (533)..(533): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggccgcctaatttataagatttctaatcgggattccggggtcccagacagattcagcggcagtgggtcaggcactgatttcacgctgaagntcagcgaggggtggaggctggaggatggttgtcggtttattactgtcctgcagagtattcacgtggccgtggacggttccggccgaacgggaccgaagggtaggaaagtaccgaaacgtaacgtggtaggcctgacctaccgnttaccg

SEQ ID NO: 211445 - DNA, 532 bp, Homo sapiens
  misc_feature: GYAE6OF02IB4AP.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctgggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgcttgaactggattcagcagaggcaggccaacctccgaggcgcctaatttataagatttcaagtcggattccggggtccagacagattcagcgcagtggtcagcactgatttcacgtctagaagatcagcgagggtggaggcgtaggaggtagttgttgtcggttttatacgtgcttgacagtagtattcgacgtcggcgtggacgttcggaccgaagggtaccgaaggtacggaaagtacgaaacgacgtgtaggcctagaccgtacagttcg

SEQ ID NO: 211446 - DNA, 572 bp, Homo sapiens
  misc_feature: GYAE6OF02HOUIU.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagacgcctcgtacacagtgatgggaacaccgccttgaactggattcagcagaggccaggccaacctccgaggcgacctaatttataagatttactaatcgggacttccggggtccagacagtattcagcggcaggtgggtcaggcactgatttcgacgctagaagatcgagcgagggtggaggctaggaggagttggttgtacggttttatacgtgtcctgcgtaagtatattcacgttggccggtggtaacgttccgggaccgtaacgggacccgtaaggggtaacggaaacgtacgaaaaccggtaacgtaggtcgggactcggacccaacgtatcgttacgg

SEQ ID NO: 211447 - DNA, 618 bp, Homo sapiens
  misc_feature: GYAE6OF02GL4PD.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtacagtggggatgttgtgatgactcagtctccgctctccctgcccgtcacccttggacaggccggcctccatctcctgcaggtctagtcagagcctcgtacacagtgatgggaacaccgccttgaactggattcagcagaggccaggccaaccgtccgaggcgacctaatttataagatttcaagtcgggattccggggtcccagacagattcgagcggcaggtgggtacaggcacgtgactttcgacgctagaagatcgagcgtaggggtggaggcgtaggaggtagtggtttagtcgggttttattacgtgtccgtgcgtagtagttattcgacgttcggtccggtagggtacccggtttacgggaccgtaaacgggggtacccgtaaaggggttaacggtaaaacgtaacccgaaaacggttaaccgtagggttacgggtaccgttacggacccgttaaccgtacgttaccgg

SEQ ID NO: 211448 - DNA, 566 bp, Homo sapiens
  misc_feature: GYAE6OF02IKHCT.26.26.C04.1.454.CMB.1.raw
  modified_base (392)..(392): a, c, t, g, unknown or other
  misc_feature (392)..(392): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaaccgtccgaggcgcctaatttataagatttactaatcgggattccggggtccagacagattcagcggcagtgggtcaggcactgatttcacgtctgaaagntcagcgtagggtggaggcgtggaggtattggttggtacggttttattactggcctggacctagtagttattcacgttcggccggttagggtacgttccggaccgtaacggggaccgaagggtacggaaacgtaaccgaaacgtaacgtggtcggtacctggacctaccattccg

SEQ ID NO: 211449 - DNA, 570 bp, Homo sapiens
  misc_feature: GYAE6OF02I3IK8.26.26.C04.1.454.CMB.1.raw
  modified_base (399)..(399): a, c, t, g, unknown or other
  misc_feature (399)..(399): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtacagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggccgcctaatttactaagtatttactaagttcgggtattccggggtccagacagtattcgagcggcagtgggtcaggcacgtgatttcgacgctagaanagtcagcgagggtggagggctaggaggtagtgtttggtacggtttattacgtgtcctgacagtagttattcacgttcgggccgttgggaccgttccggaccgtaagggaccgtaagggtaggtaaactacgaaacgacgttcggtacggtccgtacgaccaaccgtattcg

SEQ ID NO: 211450 - DNA, 807 bp, Homo sapiens
  misc_feature: GYAE6OF02JYNH8.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccgatctcctgcaggtctagtcagagcctcgtacacagtgatgggaaccaccgccttagaactggacttcgagcaggacggccaacggccctaaccgtccggaggccgtacccttaaattttacgaaagtacttttacctaaagttccggggtaactttcccgggggtacccctaaggacccgtaaggtacgtttacgaacggtccgggtaccgtaagggttcggggtaccgacggggtacctaacccggttggtaactttttcccgaacggtaccgttaggaaacggtacttaccggaacggtaccggtaagggggtacgggtaacgggtccggttagggtaaccggggttagtttacgggtttacgggttacgggtttttaacgttaaccggtttcgggttaccgttaggtaccgttaaagggttaacggtttaacgttaccgtaacgtttcggggaccggttacggggtacccggtttaccgggacccggtaaacggggtaaccggtaaacggggtaaccggtaaacgtaacccgtaaaaccggtaacgttacgggtaccgggtaccgtacggtaaccgtacccgtagtttaccgg

SEQ ID NO: 211451 - DNA, 508 bp, Homo sapiens
  misc_feature: GYAE6OF02FJYYI.26.26.C04.1.454.CMB.1.raw
  modified_base (495)..(495): a, c, t, g, unknown or other
  misc_feature (495)..(495): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtggtcaggcactgatttcacgctgaagatcagcagggtggaggctgaggatgttgcggtttattactgcctgcagagtattcactggcgtggacgttcggccaagggaccgaaggtggaaatcaaacgaacgtgnggctgcaccatcg

SEQ ID NO: 211452 - DNA, 593 bp, Homo sapiens
  misc_feature: GYAE6OF02JTAIN.26.26.C04.1.454.CMB.1.raw
  modified_base (424)..(424): a, c, t, g, unknown or other
  misc_feature (424)..(424): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatcctcctgcaggtctagtcagagcctcgtacacagtgatgggaacaccgccttgaactggattcagcagaggccaggcccaaccgtccggacggccgaccttaatttagtaagtactttacgtaaagtccgggtaagttcccggggtacccaaggacaggtacttcgaggcgcgagtgggcagggcacgtggtactttcgacgtctaggaanatacgaggacgagggtaggaggcgtaggaggtagtggttagtcggtttatactgtactgcagtagttattcgacgtcgggtccgtaggtaccgtacggaccgaagggtaacccgtaagggttaacgaagtaaccgaaacgtgtaggtacgacgtgaccgacacgttacg

SEQ ID NO: 211453 - DNA, 519 bp, Homo sapiens
  misc_feature: GYAE6OF02F6UWO.26.26.C04.1.454.CMB.1.raw
  modified_base (513)..(513): a, c, t, g, unknown or other
  misc_feature (513)..(513): n is a, c, g, or t
tcagagactatactcacgaccggtgctcgatttagtctagcgactttgggtttggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgccttgaactggattcagcagaggccaggccaaccgtcgaggcgcctaatttataagatttctaatcgggattccgggtccagacagattcagcgcagtggtcaggcactgatttcacgtctagaagatcagcgagggtggaggctgaggatgttgcggtttatactgcctgcagtagtattcactggccgtggacgttcggcaacgggaccgtaaggtaggaaacgtcgaaacgactggtggcgtgacctaccgnttaccg

SEQ ID NO: 211454 - DNA, 554 bp, Homo sapiens
  misc_feature: GYAE6OF02HR4E7.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccggaggcgcctaatttataagtatttctaagtcgggattccggggtcccagacagattcagcggcaggtgggtcaggcactgattttcacgctgaagtatcgagcgaggggtggaggcgtggaggagttggttggttcggtttattacgtcgctgcagtagttattcacgtcggtccggtggtacgttcggaccgaacgggaaccggaagggtcggaaatacgaaacgacgtcggtcggcctacgacgacctattacg

SEQ ID NO: 211455 - DNA, 577 bp, Homo sapiens
  misc_feature: GYAE6OF02H0SRP.26.26.C04.1.454.CMB.1.raw
  modified_base (312)..(312): a, c, t, g, unknown or other
  misc_feature (312)..(312): n is a, c, g, or t
  modified_base (557)..(557): a, c, t, g, unknown or other
  misc_feature (557)..(557): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagacgcctcgtacacagtgagtgggaaccaccgccttgaactggattcagcagaggccaggccaacctcgaggcgacctaatttanaagtatttactaagtcgggtattccggggtcccagacagattcgagcggcaggtcggtcaggcactgtatttcacgctagaagatacgagcgagggtggagcgtaggagtagttggttgtacggttttatacgtcgccgttgacgtaggtagttatccgtacgtcgggtccggtgggtaccgtttcgggacccgtaaggggtaccgaaggggtagaaactacggaaacgtacgtggtacggacgngtaaccacctgtacgttacg

SEQ ID NO: 211456 - DNA, 723 bp, Homo sapiens
  misc_feature: GYAE6OF02GG3AR.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacacccgcttgaactggattcagcagaggaccaggccaaccgtccggaggcgacccgttaaatttaataagtattttacctaaagttccgggtacttcccgggggtaccccaggtaaccaacggtatttccgaaggccggacgaacgggttggggttaccaaggggtacaaccgttggtaacttttaccgaacggtcctaggaaagacttacgaagcggtaaggggttgggaggccgttagggaagggttagttagggtttcggtacgggtttttaattaccgttcgtcccgttaggacccggtaaggttacgttaatttaccgtaacggttccgggtccggttagggtaacccggtttaccgggacccgtaaacggggaacccgtaaaggggttaagggaaaacttaccggaaaacccggtaacgttcgggtacgggtaccgtacggaccgaacccgtacgttccgttaccg

SEQ ID NO: 211457 - DNA, 611 bp, Homo sapiens
  misc_feature: GYAE6OF02F0IH2.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctcgtggtcccagggtccaggtggggatgttgtgatgactcagtctccgctctcctgcccgtcaccttggacaggcgcctccatctcctgcaggtctagtcagacgtcctcgtacacagtgagtgggaacaccgcttgaactggattcagcagacggccgacgaccaacctccggaggccgacctaaatttaataagtactttactaaagtcgggtacgttcccggggtaccagacagtacttacacgcgacgtaggtcgggtacgacggctacgtagtactttcacgcgtagaagactcagacgagggtaggagggctaggacggtaattggttggtacggtttattacgtcgccgtgacgtagagttacttcgacgtcggaccgtcggtacgttcggaccgtacgggaaccgtaagggtacggaaacgtacgtaaaaccgtaagttcggttacgggacttcggacctaccgtacgttcttaccgg

SEQ ID NO: 211458 - DNA, 594 bp, Homo sapiens
  misc_feature: GYAE6OF02H0M7W.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggccggcctcatctcctgcaggtctagtcagagcctcgtacacagtgagtagggaacaccgccttagaactggattcagcaggacggccaggcccaaccgtccgaggcctaccttaatttactaagtatttctaaagtcgggtacttcccggggtaccagacagtattcgagcggcgtaggtggcgaggcacgtagtattcgacgactagagtactcgagcgagggtggaggtcgtaggaggtagtggtttcgtcggttttagtacgttcgccgttagccgagtacgtttactacgtacggtcggtaccggttacgggttacggtttaccgggaccggtaacgggaccgtaaggggtaaacgg

SEQ ID NO: 211459 - DNA, 602 bp, Homo sapiens
  misc_feature: GYAE6OF02H2HPJ.26.26.C04.1.454.CMB.1.raw
  modified_base (441)..(441): a, c, t, g, unknown or other
  misc_feature (441)..(441): n is a, c, g, or t
  modified_base (466)..(466): a, c, t, g, unknown or other
  misc_feature (466)..(466): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctgtacacagtgagtagggaaccaccgccttgaacttggattcagcaggaggaccgaggacccaaaccgtccggaggccgaccttaatttaataaagtatttactaagtcgggtacgttcccggggtacccagacagattcaggcgacgtaggtgggtacagggctacgtgtatttcacgtctagaagatcgagcgtagggtggaggcnggagtagtgttggtcgtttattcgngtacctgacagtagttattcacgttgggtccggtggtaccggttaccgggaccgtaacggggaaccgtaagggtaaggtaaaccgtaccgaaaacgtaacgttggacggtcgtcgaacctaaccgtagtcttacgg

SEQ ID NO: 211460 - DNA, 658 bp, Homo sapiens
  misc_feature: GYAE6OF02IH7MA.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctcgtgggtcccagggtccaggtggggatgttgtgatgactcagtctccgctctccctgccccgtcacccttggacaggccggcctccatctcctgcaggtctagtcagacgcctcgtacacagtgagtgggaacacccgtaccttgaactggattcagcagacggccaggccaacccgtccgacggccgtaccttaaatttaactaaaggtactttacttaaagtcggggacgtttccggggtcccaagaccagtactttcgaggcggacgaggtgggtcgacggcctacgtgtaactttcgacgtcgttagaagtacgtacagggacgtaagggggttggacggtacgtcggaggtagttcggtttaggttaccggttttaagttacgtacgtccgtgtaccgtaaggtagttacgttcgtaacggttcgggtacccggttacggggtacccggtttaccgggacccggtaaacggggtacccggtaaaggggtaacgg

SEQ ID NO: 211461 - DNA, 548 bp, Homo sapiens
  misc_feature: GYAE6OF02ICJUZ.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccggaggcgcctaattataagtatttctaatcgggattccggggtccagacagattcagcgcagtgggtcaggcactgatttcgacgtctgaagatcagcgaggggtgggaggcgtaggaggtattggttaggtcggttttaatacgtgcctgcgtagagttattcacgttcggccgtggtacgttccggaccgaagggaccgaagggtacggaaacgtcgaaacgacgtggtacggcgtacgacaccgatcg

SEQ ID NO: 211462 - DNA, 569 bp, Homo sapiens
  misc_feature: GYAE6OF02IT7E1.26.26.C04.1.454.CMB.1.raw
  modified_base (440)..(440): a, c, t, g, unknown or other
  misc_feature (440)..(440): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccaggtggggatgttgtgatgactcagtctccgctctccctgcccgtcacccttggacagggccgcctccatcctcctgcaggtctagtcagagcctcgtacacagtgatcgggaacacccgccttgaactggattcagcagaggccaggcccaacctccgaggcgcctaaattactaagtatttactaagtcgggtacttccggggtacccagacagattcgagtcggcaggtgggtcgaggcacgtgtatttcgacgtctgaagntacagcgagggtggagggctggaggtagtggttgtcggtttattactgccttgacgtaggtagtacttcgacgttcggtccggttaggtaccggttccgggaccgaacgggtaccgtaagggtaacggg

SEQ ID NO: 211463 - DNA, 713 bp, Homo sapiens
  misc_feature: GYAE6OF02JQ0L5.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacgagtgatgggaacaccgcttgaactggattcagcagaggccaggccaacctccggaaggccgaccttaaatttaacgtaagtactttactaagtccggggtaagttcccgggggtaccccaaggaccgtaagtaactttcgaacggtccgggtacgtaagggttcggggtacgaacgggtccaacgttacggtacttttaccgaacggtcctaggaaacgtaacgtaccgaaggtccgaagggggttgggaacgggtcctagggacgggtaagtttggtttaggtcgggttttaattacggtcgtaccgttggactaggtaacgttacttacgtacgttcgggtccggttacgggtaccggtttccgggaccgtaaacggggtacccgtaaaggggtaacggtaaagttaacccggaaaacggttacgtacggttgggtaccgtacggtaccgtaccgtacgttaccgg

SEQ ID NO: 211464 - DNA, 662 bp, Homo sapiens
  misc_feature: GYAE6OF02IJ51F.26.26.C04.1.454.CMB.1.raw
  modified_base (250)..(250): a, c, t, g, unknown or other
  misc_feature (250)..(250): n is a, c, g, or t
tcagagactatactcacgaccggtgctcgatttagtctagcgactttgggtttgggggactgatcaggactcctcagttcaccttctcacaatgaggctccctgctcagctcctgggctgctaatgctctgggtcccagggtccaggtggggatgttgtgatgactcagtcctccgctcctccctgcccgtcacccgttggacaggccgcctccatctcctgcaggtctagtcaagcgtcctcgtacacngtgagtcggaacaccgtcttgaactggattcgagcaggacggaccgacggcccaaccgtccggaggtccgtaccttaaagttttactaaaggttacttttacgtaaaacgttccggggtaacgttcccggggtaaccaaggtacctaggtacttacgacggcggtacgtacggttgggtaccaagggtcctaacgttggtactttacgacgtcgttaggaaagtcgtacgacggacgtacggggtagggaacggtctgggaagggtagttgggttgtaccggttttaatacgcggtcgtgagtaagtacgttcgtcgacgtttcgggacgtcggtacgtacggaccgaacggtaccgaggtaacggaagtaaccgaaacgtgtacggtacgcgtaccgtactccgtattacg

SEQ ID NO: 211465 - DNA, 749 bp, Homo sapiens
  misc_feature: GYAE6OF02HMDFF.26.26.C04.1.454.CMB.1.raw
  modified_base (252)..(252): a, c, t, g, unknown or other
  misc_feature (252)..(252): n is a, c, g, or t
tcagagactatactcacgaccggtgctcgatttagtctagcgactttgggtttgggggacgtgatcaggactcctcagttcaccttctcacaatgaggctccctgctcagctcctggggctgctaatgctctgggtcccagggtccagtggggatggttgtgatgactcagtctccgctcctccctgcccgtcacctggacaggcgcctcatctcctgccaggtctagtcagagtccctcgtacaccaggtnagtcgggaacaccgccttagaactggtaattcgacgctaggacggaccgagacccaaccgtaccggaggccgtacccttaagtttaataacggttacttttactaaacgttaccgggtaacgtttacccgggggtacccaggaacctaggtaacttcggaacggtcggtaacgtagggtacgggttcgaaacggggtctaacgttaggtacttttaccggacgacgttaggtaaacgacgttacgacgacgggtaagggtcgggtaacgggtcgtacgggtaggtaacgttgggtttacggtacgggtttacttaacgtcgtaccgtaggaccgttaggaacgtttagtaccgtaccgttacggtcccggttacgggaccggtttaccggaccggttaaaccggggtaccggtaaacggggttaacgtaaacgtaaccgggttaaaccgtacggttacggtacggtcccgtaggtaccctaccgtaaccgtttccgg

SEQ ID NO: 211466 - DNA, 564 bp, Homo sapiens
  misc_feature: GYAE6OF02HNDRD.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatgggaacaccgccttgaactggattcagcagaggccaggccaacctccgaggcgcctaatttataagatttctaatcgggattccggggtccagacagattcagcggcaggtgggtcaggcactgatttcacgtctagaagatcagcgagggtggaggcgtgaggtattggttgtcggtttaattacgtcgtctgacgagtagttattcacgttcggccggtggtacgttcggaccgaagggtacccgtaaagggtacggtaaaactacgaaaaccgtaacgtaggttacggacgttacggacctaccgattcccg

SEQ ID NO: 211467 - DNA, 574 bp, Homo sapiens
  misc_feature: GYAE6OF02I8CKD.26.26.C04.1.454.CMB.1.raw
  modified_base (417)..(417): a, c, t, g, unknown or other
  misc_feature (417)..(417): n is a, c, g, or t
  modified_base (437)..(437): a, c, t, g, unknown or other
  misc_feature (437)..(437): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtacagtggggatgttgtgatgactcagtctccgctctccctgcccgtcacccttggacaggcggcctccatctcctgcaggtctagtcagacgcctcgtacacagtgatgggaaccaccgccttagaacctggattcagcagaggccaggcccaaccgtccggaggccgaccttaaatttagtaagtatttctaagtcgggtaacgttcccggggtacccagaccagtacttcgagcggcaggtgggtcaggcacgtgactttcacgctagaagntacagcgagggtggaggcgnggaggattgttaggtcgtttattactgtcctgcagagttacttcacgtggccggtggtaccggttcggaccgaacgggacgtaagggtacgaaagtacgaaacgtacgttaggtcggtacgcgaccaccgtattccg

SEQ ID NO: 211468 - DNA, 606 bp, Homo sapiens
  misc_feature: GYAE6OF02HAK5W.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatggaacaccgccttgaactggattcagcagacggccaggccaaccgtccggaggccgaccttaaatttataaagtatttactaagtcgggtagttccggggtcccagacagtacttcgagcggcaggtgggtcgaggcacgtgtatttcgacgtctagaagactcgagcgaggggtggaggtcgtagggaggtagttggtttcggttacggttttaacgttacgttcgtccgttggacgtaaggtacggttacttccgtaacgttcgggtaccggttcgggtaccgggttccggacccggtaaacggggtaccgtaagggttaaacgg

SEQ ID NO: 211469 - DNA, 526 bp, Homo sapiens
  misc_feature: GYAE6OF02GHC1Q.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgccccgtcacccctttggaccaggcggcctccatctcctgcaggtctagtcagagcctcgtacacagtgatgggaacaccgccttgaactggattcagcagagccaggccaacctccgaggcgctaatttataagtatttctaatcgggtattccggggtcccagacagattcagcggcagtgggtcaggcactgatttcacgctgaagatcagcaggggtgggaggctgaggatgttgcggtttatacgtgcctgcagatattcacgtggccggtggacgttcggaccgaagggaccgaaggtggaaactacgaaacgaacgtggtggctgcgacctagtcg

SEQ ID NO: 211470 - DNA, 606 bp, Homo sapiens
  misc_feature: GYAE6OF02GP062.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgccccgtcacccttggacaggccggcctccatcctcctgcaggtctagtcagagcctcgtacacagtgagtgggaacaccgccttgaactggattcagcagaggccaggcccaacctccgaggccgccttaatttataaagtactttactaaagtcgggtattcccgggggtcccagaacaggtattcgaggccggcgaggtcgggtcgaggcgactgtaatttccgacgtgtaggaagactcgaagcgaggggtggaggcgtaggaggtgttggttggtacggttttacttacgtgtccgtgcgtaggtaacgttatttaccgaacgttcggtaccggttcgggttaccggttcccgggtaaccggaacgggtaccggtaaggtaaaccggg

SEQ ID NO: 211471 - DNA, 550 bp, Homo sapiens
  misc_feature: GYAE6OF02HZ30T.26.26.C04.1.454.CMB.1.raw
  modified_base (529)..(529): a, c, t, g, unknown or other
  misc_feature (529)..(529): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatcctcctgcaggtctagtcagacgcctcgtacacagtgatgggaacaccgccttgaactggattcagcagaggccaggccaacctccggagggccgcctaattttataaagtatttctaatcgggattccgggggtcccagacagattcagcggcagtgggtcaggcactgatttcacgctgaagatcagcgagggtggaggcgtggaggtattggtttggtcggttttattacgtgtccgtgacaggtagttattcgactcgggtcgtggtaccggttcggacgacgggaccaagggtagaaactacgaaacgtaacgngtcggactgaccacatctacg

SEQ ID NO: 211472 - DNA, 609 bp, Homo sapiens
  misc_feature: GYAE6OF02HKNSY.26.26.C04.1.454.CMB.1.raw
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
tcagagactatactcacgaccggtgctcgatttagtctagcgactttgggtttgggggactgatcaggactcctcagttcaccttctcacaatgaggctccctgctcagctcctgggctgctaatgctctgggtcccagggtccagtggggatgttgtgatgactcagtctccgctctccctgcccgtcacccttggacaggcggcctccatctcctgcaggtctagtcagagcctcgtacacgagtgatgggaacaccgccttgaactggattcagcagaggccaggcccaactccgaggccgctaattataagatttactaatcgggattccggggtccagacagattcgagcggcagtgggtcagggcacgtgatttcacgctgaagatcagcagggtggacggtntaggnggtagttgttcgtaggtttacttacgtcgtccgtggacgtaggtagttacttcgaaccgttgggtacccggtaggggttaccgttccggggtaccgaaacgggggtaacccgtaaagggtacggtaaaacgttaaccgaaaaccggtaacgtcgggttaccggacgttaaccggccgtaacccttagttacccgg

SEQ ID NO: 211473 - DNA, 593 bp, Homo sapiens
  misc_feature: GYAE6OF02IBR1Z.26.26.C04.1.454.CMB.1.raw
  modified_base (215)..(215): a, c, t, g, unknown or other
  misc_feature (215)..(215): n is a, c, g, or t
  modified_base (437)..(437): a, c, t, g, unknown or other
  misc_feature (437)..(437): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctcatctcngcaggtctagtcagacgcctcgtacacagtgagtagggaacaccgtccttagaactaggattcagcgagacggacacggacccaaaccgtccggaggccgtaccttaaatttaactaagtaacttttactaaagttacgggacgttcccggggtacccaaggaacagtattcgagcggcgaggtgggtcaggcacgtgatttcgacgtctagaagatcaggngacggggtggtaggcgtaggaggtagttgttaggtacggttttatacgtgtcctggacagtagtattccgacgttcggcggtcggtacgtcggaccggaacggacgaagggtagaaactaacgaaacgacgtgcggtactacggacaccgtatccg

SEQ ID NO: 211474 - DNA, 609 bp, Homo sapiens
  misc_feature: GYAE6OF02GNLW3.26.26.C04.1.454.CMB.1.raw
  modified_base (416)..(416): a, c, t, g, unknown or other
  misc_feature (416)..(416): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctcatctcctgccaggtctagtcagagcctgtacacagtgatggaaccaccgcttgaactggattcagcagaggccaggccaacctccgaggccaccgttaaatttagtaagtatttactaaagttcgggaacgtttcccggggtaccccaggactaggtacttcgaggcggcaggtgggcaggcacgtgactttcgacgtctagaagntcgaggcagggtggaggctaggagagttgttcggtacggtttatacgtcgacctgacgagtagttacgttcaacgtcggtccggtaggtaccgttcggaccgtaacgggacccgtaaagggttaccgaaacgttaaccgaaaacggtaccgttacggttacggaccgttacggaccgtaacccgtgttacccg

SEQ ID NO: 211475 - DNA, 562 bp, Homo sapiens
  misc_feature: GYAE6OF02GYB1V.26.26.C04.1.454.CMB.1.raw
  modified_base (395)..(395): a, c, t, g, unknown or other
  misc_feature (395)..(395): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagtatttctaagtcgggtattccggggtccagacagattcagcggcaggtgggtcaggcacgtgtatttcacgtctagaanatcaggcaggggtggaggtctggaggtatgttgtcggtttatacgtgctgacgagtagttacttcacgtcggtccgtagggtaccgttcggaccggaaagggacccgtaaggggtaggaaacgtacgaaaccggaacgttggtacggcttacggcctaccgtattcg

SEQ ID NO: 211476 - DNA, 598 bp, Homo sapiens
  misc_feature: GYAE6OF02HWKNN.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagacgcctcgtacacagtgagtgggaacaccgccttgaactggattcagcagagccaggcccaactccgaggccgacctaatttataagtactttctaatcgggtattccggggtaccagacagattcagcggctaggtggtcgaggcacgtgtacttcacgctagaagatccagcgtagggtggaggtctaggaggtagttggtttcggtacggttttactttaacgtgtaccttgacgtagtaagtactttacgacgttcgggcccggttaggtaccggttacgggaccgaacgggtaccgtaaagggtaggaaacgtacggaaaacggtaacgtggtacggacgtacgccaacgtacgtcgttaccgg

SEQ ID NO: 211477 - DNA, 601 bp, Homo sapiens
  misc_feature: GYAE6OF02F5GAL.26.26.C04.1.454.CMB.1.raw
  modified_base (410)..(410): a, c, t, g, unknown or other
  misc_feature (410)..(410): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggacaaacctccgaggccgacctaaatttataagtattttactaagttcgggactttcccgggggtacccaggacagtattcgagcggacaggtgggtcagggcacgtgtatttcacgctaggaagntacgagcgagggtgaggcgtaggaggtagttggttgtacggttttattacgtgtccgtgtacgaggtagttaattccgacggttcgggtccgttaggtaccggttaccggaccgtaagggaacccgaagggtacggaaacgtacgaaacgtaacgtggtacggtcgtaaacgcctaacgtacgtacttacg

SEQ ID NO: 211478 - DNA, 530 bp, Homo sapiens
  misc_feature: GYAE6OF02FTJ7S.26.26.C04.1.454.CMB.1.raw
  modified_base (246)..(246): a, c, t, g, unknown or other
  misc_feature (246)..(246): n is a, c, g, or t
  modified_base (438)..(438): a, c, t, g, unknown or other
  misc_feature (438)..(438): n is a, c, g, or t
tcagagactatactcacgaccggtgctcgatttagtctagcgactttgggtttgggggagataaaagctcagctctacccttgccttgactgatcgggactcctcagttcaccttctcacaatgaggctccctgctcagctcctggggctgctaatgctctgggtcccagggtccagtggggatgttgtgatgactcagtctccgctctccctgcccgtcacccttggacaggcgcctcatctccngcaggtctagtcagagcctcgtacacagtgatgggaacaccgccttgaactggattcagcagagccaggccaacctccgaggcgcctaatttataagatttctaatcgggattccggggtcccagacagattcagcggcagtgggtcaggcagtgatttcacgctgaagatcagcaggtggaggctggaggntgttgcgggtttattacgtgtcctgcagtagtattcgactggccgttagggaccgtttacgggccgaagggacccgtaagggtacgtaaacg

SEQ ID NO: 211479 - DNA, 537 bp, Homo sapiens
  misc_feature: GYAE6OF02FLQXO.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggccggcctccatcctcctgcaggtctagtcagagcctcgtacacagtgatgggaacaccgccttgaactggattaagcagaggccaggccaaccgtccgaggcgcctaatttataagtatttctaatcgggattccgggggtccagacagattcagcggcagtgggtcaggcactgatttcacgctgaagatcgagcgaggggtggagggcgtggaggaagtgttgtcggtttattacgtgtcctgcagtagtattcacgttggccgtggacggttcggccgaacgggacaagggtaggaatacgaaacgaacgtgtggctagacacctatctcg

SEQ ID NO: 211480 - DNA, 557 bp, Homo sapiens
  misc_feature: GYAE6OF02IYKXU.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacacggcgcctccatctcctgcaggtctagtcagagcctcgtacacagtgatgggaacaccgccttagaactggattcagcagaggccaggccaacctccgaggcgaccttaattataagtatttactaagtcgggtacttcccgggggtcccagaccagtacttcgagcggcaggtgggtacaggcacgtgtatttcacgtctagaagatacgagcgtaggggtggagggtcgtaggaggattggttgcgtaattttattactgtcctagcgaaggtgttattcgacgtggccgttggaccgttcggaccgtaagggaccgtaacggg

SEQ ID NO: 211481 - DNA, 609 bp, Homo sapiens
  misc_feature: GYAE6OF02G2NYF.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtacagtggggatgttgtgatgactcagtctccgctctccctgcccgtcacccttggacaggcggcctccatctcctgcaggtctagtcagacgccctcgtaacacaggtgagtgggaacacccgccttagaactggattcagcagaggcccaggccaacctccgaggccgcctaatttataagtatttctaagtcgggattcccggggtccagacagattcaggcgcaggtggtcaggcactgactttcgacgctagaagatcgagcgaggggtggaggtcgtggaggtagttggttggtacggttttagttacgtacggtccgtggtacgaggtacgttacgttcgtacgttcgggtccggtagggtaccggttccggaccggaaacggggtacccgaaagggttacggaaaacgtaacgaaaccggtaacgttaggtacggtccgtacggaccgaccgtattccg

SEQ ID NO: 211482 - DNA, 580 bp, Homo sapiens
  misc_feature: GYAE6OF02I721E.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggccggcctccatctcctgcaggtctagtcagacgcctcgtacacagtgatgggaaccaccgccttgaactggattcagcagaggccaggcccaaccgtccggaggcgcctaatttataagtatttctaatcgggtacttccggggtccagacagattcgagcggcaggtggtacaggcacgtgtatttcgacgtctagaacgtatacgaggacgaggggtagggacggcgtgggaggtagttgttggtacggttttattacgtgtcgtgaccgtagagttacttacgacgttcgggtccggtggtaccgttccggacgaacgggtaccgtaagggtacgaaagtacgaaacgagttgtggactcgactacctgttacg

SEQ ID NO: 211483 - DNA, 675 bp, Homo sapiens
  misc_feature: GYAE6OF02H6AOI.26.26.C04.1.454.CMB.1.raw
  modified_base (234)..(234): a, c, t, g, unknown or other
  misc_feature (234)..(234): n is a, c, g, or t
  modified_base (503)..(503): a, c, t, g, unknown or other
  misc_feature (503)..(503): n is a, c, g, or t
tcagagactatactcacgaccggtgctcgatttagtctagcgactttgggtttggggtgatcaggactcctcagttcaccttctcacaatgaggctcctgctcagctcctggggctgctaatgctctgggtcccagggtccaggtggggatgttgtgatgactcagtcctccgctcctccctcgcccgtcacccgttggacaggcgcctaccatctcctgcaggtctagtcagngcctcgtacacagtgagtacgggaaccaccgtccttagaacgttggaacttcgagcaggacggccaacggcccaaccgtccggaaggtccgtaccttaaatttagaacgtacttttacgtaaagttccggggtaacgttccccgggggtaccaaggtaacaagtacttcgaacggcggtactaagggtcgggtacgaacggtccagttacggtactttaccaacggtctaggaagtaactcggaggcgaggggtcgaggcgttaggagngttggttacgtacgtttactcgtcgtaccgtggacgttaaggtactaacgttcgtacgttgggtaccgggtaggtaccggttacggaccggacgggtaacctaacggggtaacgtaaacgtacgaaaacggtaacgttggtcggacgtaccaaccggtactcgttacgttcg

SEQ ID NO: 211484 - DNA, 597 bp, Homo sapiens
  misc_feature: GYAE6OF02H38EK.26.26.C04.1.454.CMB.1.raw
  modified_base (254)..(254): a, c, t, g, unknown or other
  misc_feature (254)..(254): n is a, c, g, or t
  modified_base (303)..(303): a, c, t, g, unknown or other
  misc_feature (303)..(303): n is a, c, g, or t
  modified_base (314)..(314): a, c, t, g, unknown or other
  misc_feature (314)..(314): n is a, c, g, or t
  modified_base (407)..(407): a, c, t, g, unknown or other
  misc_feature (407)..(407): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacnccgccttgaactggattcagcagaggccaggcccaacctccgagggccnccttaatttanaagtattttactaatcgggattccgggggtcccagacagattcgagtggcaggtgggtcagggcactgtatttcacgtctagaagtcagacgngggtagggaggcgtggaggagttggttggttacggtttagtttacgttgccgtgacgtagtaagttacttacgtacgtcggtccggtcgggtaccggttccggtaccggaacgggtaccggaacgggtaggtaaactaaccgtaaacggtaaacgtcgtaggtcgtacgccgacctaactcgtgttaccg

SEQ ID NO: 211485 - DNA, 599 bp, Homo sapiens
  misc_feature: GYAE6OF02HTKQK.26.26.C04.1.454.CMB.1.raw
  modified_base (371)..(371): a, c, t, g, unknown or other
  misc_feature (371)..(371): n is a, c, g, or t
  modified_base (399)..(399): a, c, t, g, unknown or other
  misc_feature (399)..(399): n is a, c, g, or t
  modified_base (414)..(414): a, c, t, g, unknown or other
  misc_feature (414)..(414): n is a, c, g, or t
tcagagactatactcacgaccggtgctcgatttagtctagcgactttgggtttgggggactgatcaggactcctcagttcaccttctcacaatgaggctccctgctcagctcctgggctgctaatgctctgggtcccagggtccagtggggatgttgtgatgactcagtctccgctctccctgcccgtcacccttggacaggcgcctccatctcctgcaggtctagtcagacgcctcgtacacagtgagtggacaccgcttgaactggattcagcgagacggaccacggaccaacccgtccggagccgtactaattataagtatttactaagtcgggtacgttccggggtaccagacgagtattcaggcgnaggtggtcaggcacttagactttcacgngtagaagactcgagnggtagggtggaggcgtagaggagtttggttgtacggtttatacgtcgtcgtgactaggtagttacttaccgagtcggtccggtgggtaccggttaccggacgtaaacggggtacgtaagggtaacggtaaacgtaccgtaaaacggtacggttacggtcggacctacggtacaccgtaagttccg

SEQ ID NO: 211486 - DNA, 654 bp, Homo sapiens
  misc_feature: GYAE6OF02JTQIB.26.26.C04.1.454.CMB.1.raw
  modified_base (242)..(242): a, c, t, g, unknown or other
  misc_feature (242)..(242): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagacgcctcgtacanagtgatgggaacaccgccttagaactggattcagcagacggccacggacccaaccgtccggaggccgaccgttaaatttaataaacgtatttacgtaagtcgggtacttacccggggtaccagacagtattcgagcggacgtaggtgggtcacggtcacgtgtactttacgacgtcgtagaagtactacgaggcgtaaggggtcggaggtcgtaggaggtagttggtttacggttacggttttaacttacgttcgtaccgttggtaccgaggtacgttaacgttcgtaacgttcgggtaccggttcgtaacgggttccggaccggtaagggtaaccgtaagggtaacggtaaacgtaacgaaaccggtaacgttgggtaccgacgttaccggactaccgtacgtcgttacgg

SEQ ID NO: 211487 - DNA, 538 bp, Homo sapiens
  misc_feature: GYAE6OF02FVP9I.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcgcagtgggtcaggcactgatttcacgctgaagatcagcgagggtggaggctggaggatgttgcggtttattacgtgctgcagagtattctacgtggccgtggacgttcggacccgaagggaccgaagggtggaaacttaccgaaacggtaacgtaggtacggcgtagaccaccgtagttcctacgg

SEQ ID NO: 211488 - DNA, 660 bp, Homo sapiens
  misc_feature: GYAE6OF02F4BOW.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctgggctgctaatgctctgggtcccagggtccaggtggggatgttgtgatgactcagtctccgctctccctgcccgtcacccttggacaggccgcctccatctcctgcaggtctagtcagacgcctcgtacacagtgatgggaacaccgccttgaactggtattcgagcgagaggccacggaccaaccgtccggacggccgtaccttaaatttaataaggtatttacgtaagtcgggtacgttccggggtaccagactagtactcgagcgcgaggtgggtacgaggcacgttcgtactttcgacgtcgtaggaagagtaccgaggacggaggggtaggacgggtacgtggagggtagttggtttacggtacggttttaattacgtcgtacgttcgacgtacgtagttacgttcgtaaccgttcggtccggttagggtacccggttccggacccgggtaaacgggtaccgtaaaggggtaacgtaaaccggtaaccgtaaaaccggtacggtaggtcgggtaccgtacggaaccgtacccgtattccgg

SEQ ID NO: 211489 - DNA, 562 bp, Homo sapiens
  misc_feature: GYAE6OF02FWHAH.26.26.C04.1.454.CMB.1.raw
  modified_base (418)..(418): a, c, t, g, unknown or other
  misc_feature (418)..(418): n is a, c, g, or t
tcagagactatactcacgaccggtgctcgatttagtctagcgactttgggtttgggggactgatcaggactcctcagttcaccttctcacaatgaggctccctgctcagctcctgggctgctaatgctctgggtcccagggtccagtggggatgttgtgatgactcagtctccgctctccctgcccgtcacccttggacaggcgcctcatctcctgcaggtctagtcagagccctcgtacacagtgatgggaacaccgccttgaactggattcagcagaggccaggcccaacctccgaggccgcctaatttataagtatttctaatcgggattcccgggtccagacagattcgagcggcagtgggtcaggcacgtgtatttcacgctagaagatcagcgagggtgaggcgtggaggtntggttgtacgtttattacgtgcctgctagagttattacgtacgtcggccgttgggtaccgtttccgggaccgaaagggaccgtaaaggtacggaaactaccgaaaacggtacgtaggtacggtacgtaggacctacctatccgg

SEQ ID NO: 211490 - DNA, 740 bp, Homo sapiens
  misc_feature: GYAE6OF02H115D.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccaggtgggatgttgtgatgactcagtcctccgcctcctccctcgcccgtcacccttggacaggccggcctcccactcctcctgcgacggtctagtcaggtacgccctcgtaacacagtcgagtacggaaccgaccgtaccgttagaacgtggtacttacgagcgagacggtacccgacggacccctaacccgtccggacgggtaccgtaccgtttaaattttaacgtaaacgttacgttttaccgttaaacggttaccggggttaacggtttaccccgggggttaccccgaacggtaacgaacggtaacgtttacgacggtaccggtacgtaaggttcgggggtacgacgggacctaacgttagttaactttcgaccggtacgtaggaacgtacgtacgaggcgaagggggtcgacggtgtaggaggtacgtttgggtttcggttacggttttaactaccgtcgtacccgttgaccgtaggtacgtttacgttcgtaccggtggtccggtaggtaccggttccggaacgtaacgggacgtaaggaagtaacgtacaacgttaccgtgttaccggctcgtaacctaccgtcttcgttacg

SEQ ID NO: 211491 - DNA, 780 bp, Homo sapiens
  misc_feature: GYAE6OF02J1DZ6.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccaggtggggatgttgtgatgactcagtctccgctcctccctgcccgtcacccttggacaggcgcctccatcctcctgcaggtctagtcagagcctcgtacacaggtgagtcgggaaccaccgccttaggaactggaacttcgaagcacggacggccgacggacccaacccgtaccggacgggccgaacccttaaattttaacgtaaacggttaattttacctaaaaggttccggggtaacgtttaccccggggggtaccctaacggaacctacggtaacgttccgaaacgggccggtacggtaacgggttcggggtacgaacggggtccaacgttacggttaaacgttttacccgaaccgggtccgttaagggaaaacgtaccgttaccgaagggtacccggtaggggggtacggtaaggggtcgttacgggaacgggttattttccgggtttagggtttaccgggtttttaactttacgtacggtcccgttagacgtaacgtagtttacgtttaccggacgttcggggaccgttacgggtaaccgggtttcgacccggaacgggtaccgtaagggtaaggaaacgttacgaaaaccggtacgttaggtcggacgtcgtaaccgaccttagtacgtccg

SEQ ID NO: 211492 - DNA, 806 bp, Homo sapiens
  misc_feature: GYAE6OF02I1O5N.26.26.C04.1.454.CMB.1.raw
tcagagactatactcacgaccggtgctcgatttagtctagcgactttgggtttggggtgatcaggactcctcagttcaccttctcacaatgaggctccctgctcagctcctgggctgctaatgctctggtccagggtccagtgggatgttgtgatgactcagtctccgctctcctgcccgtcacccttggacaggcggcctccatctcctgcaggtctagtcaggacgcctcgtacactagtgtagtcgggaacacccgtcttgaactggattcgagcagaggtccgaggacccaaccgtccggaggccgtaccttaatttaactaagtacttttacgtaaagttccggggtacgtttccccgggggtaccctaggaaccgtaggtacttacgaacgggtccggacgtaacgggttcgggtaccgtaaacggggcctaaccggtttacgtaaaccgttttcccgaaaccggtcgtttaacgggaaaacggtacgtaacggaacggtacgggtaacggggggttacgggaacgggtcggttagggaaacgggttgtttacggggttttacggttacccggggttttttaaattaccccggtttggtacccgtttacggacccgttaaggggttaacgtttaacgtttccggaccgggtttacgggttaccgggtaccgggttaacgggttacccgggaaccggttaacggggtaaccgtaaaggggttaccggtaaaactaaccgggtaaaacgtaccggttcggtacgggtccgtaacgtaccgtaacccttagttaccgtttacc

SEQ ID NO: 211493 - DNA, 689 bp, Homo sapiens
  misc_feature: GYAE6OF02IEKVG.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagacgcctcgtacacagtgagtgggaaccaccgtccttagaactggattcagcagaggccaggcccaaccgtccggaggccgaccttaaatttactaagtacttttactaaagtccgggtaactttcccggggtacccagacagtattcgagcggcagggttggtcaggcacgtgtacttttcgacgtctagtaagtactcgaaggcgtaaggggttacgggacgggtcgttagggaacgggttaagttgggtttacggttacggtttttaacgttaacgtcggtccgtacggtccgtaaggtacgttaacttcgaacggttcgggtcccggttaggtaaccggtttaccgggaccgtaacggggtaacccgtaaaggggttaacggtaaaaccgttaaccggaaaaccggttaacgtcgggttacgtaccggtacgtaaccgtaacctagttccttaacgg

SEQ ID NO: 211494 - DNA, 687 bp, Homo sapiens
  misc_feature: GYAE6OF02GC9S1.26.26.C04.1.454.CMB.1.raw
  modified_base (171)..(171): a, c, t, g, unknown or other
  misc_feature (171)..(171): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgctaaaacngtctccgctctccctgcccgtcacccttggacaggcggcctccatctcctgcaggttctagtcagagcctcgtacacagtgagtgggaacaccgtccttgaactgattcagcagagccaggccaaccgtccgaggccgtacctaagtttacaagtactttcgtaaagtcgggtaacttcccggggtacccaggacagtacttcaggcggctaggtcggtacaggtcacgttggtaacttttcgaaccggtactacggaaagtacgttaccgacggtaccgtaagggggtacggaacgggtccggtagggtaagggtagtttagggtttcgtaacgggtttttaattaccggttggtcccgtaggaccgtagtacgttacgtttacgaccggttcggtacccggtagggtaccgtttaccgggacccgtaaggggtaacccgtaaagggttacggtaaaacgtaccgaaaacggtaccggttagtacgggtactacggaccgtaccgtagttacccg

SEQ ID NO: 211495 - DNA, 533 bp, Homo sapiens
  misc_feature: GYAE6OF02F2FHS.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagagccagccaacctccgaggcgcctaatttataagatttctaatcgggtacttccggggtcccagacagtattcagcggacaggttgggtcaggcactgtatttcgacgctagaagatcagcgagggtggaggcgtgaggtatgttgtcggtttattcgtgctgacagagtattcacgtggccgtggacgttcggacgaaggaccgaaggtaggaaactacgaaacgacgtggtacggtctagacctacattcg

SEQ ID NO: 211496 - DNA, 538 bp, Homo sapiens
  misc_feature: GYAE6OF02GALY6.26.26.C04.1.454.CMB.1.raw
  modified_base (353)..(353): a, c, t, g, unknown or other
  misc_feature (353)..(353): n is a, c, g, or t
  modified_base (384)..(384): a, c, t, g, unknown or other
  misc_feature (384)..(384): n is a, c, g, or t
  modified_base (411)..(411): a, c, t, g, unknown or other
  misc_feature (411)..(411): n is a, c, g, or t
tcagagactatactcacgaccggtgctcgatttagtctagcgactttgggtttgggggacgtgatcaggactcctcagttcaccttctcacaatgaggctccctgctcagctcctgggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaagtcgggtattccgggtccagacagacttnagcggcaggtgggcaggcactgatttcacgntagaagatacgagcagggtggaggcgnggagatggttgtcgtttatacgtgccgtgcagagttactcgacgtggccgttggacgttcggaccgaagggaccgtaaggtacggaaacgtacgaaaacgactcggtagacgtggaccgacattccg

SEQ ID NO: 211497 - DNA, 645 bp, Homo sapiens
  misc_feature: GYAE6OF02IHO0B.26.26.C04.1.454.CMB.1.raw
  modified_base (247)..(247): a, c, t, g, unknown or other
  misc_feature (247)..(247): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtgggatgttgtgatgactcagtctccgctctccctgcccgtcacccttggacaggccggcctccatcctcctgctaggtctagtcagacgcctcgacacngtgatggaacaccgcttgaactggattcagcaggacggccacggacccaaccgtccggacggccgtaccttaaattttaagtaagtattttcgtaagtccgggttacgttcccggggttcccaagaccagtaactttacgacggtcggctacgggtcgggtaccgacggtctaccgtgtatttcccgacgtacgtaggaaagatcgaggcggagggtaggaggcttaggaggtacgttgttcggtacgttttagtcgtcgcgttgacgtacgtagttacgttacacgttcggtacggttacgggtaccggttaccggaccgtaaggggaccgtaaggtagggaaaacgtaccgaaacggtaaccgtagggtacgtaccgtgaccgtaccctgttcccg

SEQ ID NO: 211498 - DNA, 640 bp, Homo sapiens
  misc_feature: GYAE6OF02I3YVA.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccgttggacaggcgcctccatcctcctgcaggtctagtcagacgcctacgtacacagtgagtcgggaacacccgtcttgaacgtggattcagcagcggccaggcccaaccgtccggaggacctaccttaaattataaagtactttactaagtcgggtacgttcccggggtacccagaccgagtacttcgacggccggacgtaggtacgggtacacgggactacgtcgtaacgtttccgacggtacgttaggaaacgtacgtaccgaggtacggaggggtacgggagggtacgtaggaagggtagttggttacggttacggttttaacttaacgtcgtaccgtgacgtaaggtagttactacgtacgtcggtcggtacgggtaccgttacgggaccgtaacgggtacgaacggtaacgg

SEQ ID NO: 211499 - DNA, 568 bp, Homo sapiens
  misc_feature: GYAE6OF02GZYNT.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgagtggaaccaccgtccttcgaactggattcgagtcaggaggcccaggcccaacctccgaggccgaccttaatttataagtatttactaagtccgggtagttcccggggtacccagacagtatttcgagcggcaggtcgggtcgaggcacgtgtactttcacgtctagaagatacgagcgagggtgaggcgtaggagtattgttgtcggttttattacgtgtcctgctaggtacgttattcacgttcggtcggtacggtacgttccggaccgaacgggtaccgaaggtaacg

SEQ ID NO: 211500 - DNA, 610 bp, Homo sapiens
  misc_feature: GYAE6OF02F9SCU.26.26.C04.1.454.CMB.1.raw
  modified_base (568)..(568): a, c, t, g, unknown or other
  misc_feature (568)..(568): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggccggcctccatctcctgcaggtctagtcagacgccctcgtacacagtgatgggaaccaccgccttagaactggattcagcagaggccaggccaaccgtccgacggccgacctaatttaataagtatttactaagtcgggaacgtttcccggggtaccagacagtattacgagcggcgaggtgggtacgaggcacgttgtactttccacgtcgtagaagactcgagcggaggggtagggaggctaggaggtagttggttggttacgggttttaattacgtcggtaccgtgacgtagtagttattcgtacgtcgggtccggtacggtacggttccggaccgaacgggaccggtaaggtacggtaaanaaccgaaacgtacgtggtacggctacggacctaccgtattcg

SEQ ID NO: 211501 - DNA, 633 bp, Homo sapiens
  misc_feature: GYAE6OF02IZ8V0.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacagggccggcctccattcctcctgcctaggtcctagtcagacgccctcgtacactagtgatgggaaccaccgccttgaaactggattcagcagacggccaggcccaacctccggaggccgacctaatttaataagtatttactaagtcgggtacttccggggtccagacagattcgagcggacaggtcgggtcgaggcacgtgtactttcgacgtactgaacgtatcgagcggtaggggtcggacgggtcgtggaaggtgttggtttcggtacgggtttattacgtcggtctggtacgtagtacgttacttccgtacgttcgggccggttaggaccggtttcggacccgtaagggtaaccgtaagggttaacggaaagtaacccgaaaagtaaccggttaggtacggtaccgacggtaccgaccgtagttaccg

SEQ ID NO: 211502 - DNA, 548 bp, Homo sapiens
  misc_feature: GYAE6OF02GPW62.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgccccgtcacccttggacaggcggcctcatctcctgcaggtctagtcagagcctcgtacacagtgatgggaacaccgccttgaactggattcagcagaggccaggcccaaccgtccgaggccgcctaatttataagtatttctaagtcgggattccggggtccagacagattcagcggcagtggtcaggcatgattacgacgctgaagatcagcgagggtgaggctgaggtatggttgtcggtttattacgtgcctgcagagtatcgacgttgggccggttaggacgttcggaccgtaagggaccgaagggtaggaaacgttacgaaacggtaacgtggtacggtcgtcgaccgaccgtactcttacg

SEQ ID NO: 211503 - DNA, 638 bp, Homo sapiens
  misc_feature: GYAE6OF02GZUL0.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctctccctgccctcacccttggacaggcggcctccatctcctgcaggtctagtcagacgcctacgtacacagtgagtgggaacaccgccttagaactggtattcagcaggacggccacggccaacccgtccggacggccgtaccttaatttagtaagtatttacgtaagtcgggtacgttcccggggtaccagacagtattcgagcggactaggtgggtacacggctacgtgtactttcgacgcgtagaagtactcgagcgagggtggacggtctaggaggtagttggttaggttacggtttattacgtgtccgtgtaccgtagtagttacttccgtacgtcggtaccggttacggtaccggttacgggacccgaacgggtaccggtaaggggttaacggaaactaaccgaaaaccggttacgttacgggacggtaccgtacggaccctacgtacgttaccg

SEQ ID NO: 211504 - DNA, 666 bp, Homo sapiens
  misc_feature: GYAE6OF02FLIRQ.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcatctctgctctccctgcccgtcacccttggacaggcggcctcatcctcctgcaggtatagtcagacgtcctacgtacacgagtgagtacgggaaccaccgtccttaggaacttgggtacttccgagcgaggacggcccgaggacccctaaaccgtccggaggccgtaccttaaattttaactaagttacttttactaagtcgggtacgttcccggggtaccaggtacagtacttcgacggcggacgtagggtacgggtcgaggtactacgttacggtactttacgacggtactacggaacgtacgtacgacggtcggtaaggggtgggacggagtagggaggtaagtttgggttaggttacggttttacttacgtcggtacgtcgtacgtaacggtattacgttccgacgttcgggccggttacgggtaaccggttaccgggaacccggtaacggggaccgtaaagggg

SEQ ID NO: 211505 - DNA, 641 bp, Homo sapiens
  misc_feature: GYAE6OF02I259Y.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccacggccaaccgtccggaggcgacctaatttataagtatttctaaagtcgggtagttccggggtccagacagtacttacgagcggcaggtgggtcgaggcacgttgtactttccacgtctaggaaagtatcgagcgaggggtcgggaggcgtaggacggtagttggttacggttacggttttaattaccgtcgtaccgttggactaaggtaagtttacttaccgtacgttcgggtaccggttaggggaccggtttccgggaccggaaacggggtaccggtaaaggggtaacggtaaaacgtaccgtaaaacggtaacgttgggtacggtaccttacggaccgtaccgtagttaccgg

SEQ ID NO: 211506 - DNA, 573 bp, Homo sapiens
  misc_feature: GYAE6OF02F5JO7.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagacgcctcgtacacagtgatgggaacaccgccttgaactggacttcagcagaggccaggccaacctccggaggccgtacctaatttaataagtactttactaagtcgggtaattcccgggggtacccagaccgagacttcgacgcggctaggtgggtcgaaggcgactgtatttacacgtcagaagactcgagcgaggggtggaggcgtaggaggtattggttagtcggtttatacgtgcctggcagtagttattcgacgtggccgtggtacgttcgaccgaagggaccgaagggtacggaaataccggaaacgacgtagtcggtacgtgaccacgtatcgttacg

SEQ ID NO: 211507 - DNA, 734 bp, Homo sapiens
  misc_feature: GYAE6OF02GET5G.26.26.C04.1.454.CMB.1.raw
  modified_base (728)..(728): a, c, t, g, unknown or other
  misc_feature (728)..(728): n is a, c, g, or t
tcagagactatactcacgaccggtgctcgatttagtctagcgacttttgggtttgggggactgatcaggactcctcagttcacctcctcacaatgaggctccctgctcagctcctggggctgctaatgctctgggtcccagggtccaggtggggatgttgtgatgactcagtctccgctctccctcgcccgtcacccttggacaggcggcctcatctctgcaggtctagtcagacgcctcgtacacagtgatagggaaccaccgtcttagaactggattcagcagacggccaacggcccaaccgtcggacggcccgtaaccttaaagtttaagtaagtaacttttacgaacgttacggggtacgtttcccggggtaccaaggaaccgtaagtactttacggacggtaccggtacgtaaggggttacgggggtacaaacgggtacctaacgggtttacgttaacctttttaccggaacggtacgttaacgggaaaacggtaacttaccgggaacggtaaccggtaaggggggtagggtaacggtacgtagggtaagggtacgtttaggtttacgggttacggttttaacttacgtcggtaccgttgaacgtacgtaattacgtacgacgttcggtacggtcgggtaacgttcggaaccgtaacgggtaacgaaagggtacgtaaacgtaacaaacggttagtcggtacgggtacctacgaccgaccgtnttaccg

SEQ ID NO: 211508 - DNA, 529 bp, Homo sapiens
  misc_feature: GYAE6OF02FL2OC.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtccagacagtattcagcggcagtggtcagcactgatttcacgctagaagatcagcgagggtggaggctaggaggtatgttgtcggtttattactgccgtgctagagttattcgactggccgttggaccgttcggaccgtaagggaccaagggtgaaactacgaaacgactggtacgcgtagcaccgtatcg

SEQ ID NO: 211509 - DNA, 612 bp, Homo sapiens
  misc_feature: GYAE6OF02JOJTP.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggccggcctccatcctcctgcaggtctagtcagagcctcgtacacagtgatggaaccaccgccttgaactggattcagcagagccaggccaaccgtccgaggcgacctaatttataacgtatttacaatcgagacgttccggggtaccagacagattacgaggcgcgaggtcgggtacacgggcaacgtggtaactttcacgtacgtacgtaagatacaaggcgaaggggtacgggaggcgtaggaggtagttggtttaggtacggtttaattacgtcgtacctgacgtaaggtacgttaattcgacgtcggaccgttagggaccgttcgggacgtaacgggaccgtaaaggtacggtaaacgtaacgaaaccggtacgtacggtacggtacgtacggtaccgacctacgg

SEQ ID NO: 211510 - DNA, 616 bp, Homo sapiens
  misc_feature: GYAE6OF02F1JX2.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctgggctgctaatgctctgggtcccagggtccagtggggatgttgtgatgactcagtctccgctctccctgccccgtcacccttggacaggcggcctccatctcctgcaggtctagtcagagcctcgtacacagtgatgggaacaccgccttagaactggattcagcagaggccaggccaacctcgaggcgcctaattataagtatttactaagtcgggattccggggtccagacagtattcagcggcaggtggtacaggcacgtgatttccacgtctaggaagtacgtacgagcgaaggggtgggacgggacgtggaaggtagtggtttagtcgggttttaattaccgtaggcccgttaggcctaaggtaacgtttagttccgaacggttcgggacccggttggggtaaccgtttccggggacccgtaaaggggacccgtaaagggtacggtaaaagtaccgtaaaacgtacgtggtacggccgtagaccacccgtattccgg

SEQ ID NO: 211511 - DNA, 713 bp, Homo sapiens
  misc_feature: GYAE6OF02I2P16.26.26.C04.1.454.CMB.1.raw
  modified_base (198)..(198): a, c, t, g, unknown or other
  misc_feature (198)..(198): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccaggtggggatgttgtgatgactnagtctccgctcctcctcgccccgtctacccgttggacagggccggccctccatcctcctgcgaggttctagtcgagacgtcctcgtacacgagtgagtagggaaccaccgtcttagaacgtggattcagcgaggacggccgaggacccaaccgtccggacggcgtaccttaaattataaacgttactttacgtaagtcgggtacggtttacccggggtaccaacgacgtagtacgtttcgaggtccggacgtacgggttcggggtacgaacgggtcctaacgttacgtacgttttcgaaccggttacgtaggtaaagtaccgtacgaaggacgggtaggggttagggacggtcgttagggaagggtgtttgggttacggttaacggttttaagttaccgtcgtcccgtagggtactaagggttacggttacgttacgaccggttacggggtcggttacggggtaccgggttaccgggtaaccggaaaccggggtaccggtaagggttaaaccggg

SEQ ID NO: 211512 - DNA, 712 bp, Homo sapiens
  misc_feature: GYAE6OF02IJL0H.26.26.C04.1.454.CMB.1.raw
  modified_base (260)..(260): a, c, t, g, unknown or other
  misc_feature (260)..(260): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgccccgtcacccttggacagggccggcctccatctcctgcaggtctagtcagacgcctcgtacacagtgagtgggaaacnccgccttagaactggatcagcagacggccacggacccaacccgtccggaggccgtaccgttaaattttagtaaagtattttactaaagtcgggtacgttccccggggtacccaaggaccaagacgttacgacggccggacgtaaggttggggtacgacgggactaaacgttggtaactttacgaccggtcgttaaggaaagtacgttacaaggtaccgggaggggggttagggaacgggtccgtaagggaacgggtaggtttcggtttacggggttacggtttttaacgtttacggttcggtacccgttgggactaagggttacgtttacttaccgtacggttcggggtaccggttacgggtaaccggttccgggaaccgaacggggaccgaaacgggtggaaaacgtacgaaaacggtacgtaggtcggactggaccaacgtactcgttcg

SEQ ID NO: 211513 - DNA, 825 bp, Homo sapiens
  misc_feature: GYAE6OF02F24VF.26.26.C04.1.454.CMB.1.raw
tcagagactatactcacgaccggtgctcgatttagtctagcgactttgggtttgggggactgatccaggactcctcagttcaccttcttcacaatgaggctccctgctcagctcctggggctgctaatgcttcgtgggtcccagggtccaggttgggattgttgtgtatgactcagtctccgctctccctgcccgtcacccgttggacggaggcggcctccactcgtccgtgcgaggtcctagtcagagcctcggtaccacaggtgatcgggaacaccgtaccttaggaacctggacttcaggccagaggccaggccaacctccggaggtccgaccttaagtttactaaggacttttacgtaagttccgggtaatttccccgggggtaccccaaggtaaccgtaaggtaactttaccgaacggtccgggaccgtaaggttcggggtaccaagggggaccctaaccgttaggttaacctttttacccgaaccggtccttaacggaaacggtaacgttaccgaaacgggtacccgaaaggggggttacgggaacgggtaccttagggtaaacgggttatttcgggtttacggtaaccgggtttttaagttaacccgttacggtacccgttaggtaccgtaagggtaacggtttaacttacccgtaaccgtttcggggttacccggtttaggggtaacccggttttaccggggaacccggtaaacggggggtaacccgtaaagggggtaacggtaaaacgttaccgaaaaccggtaaccgttacggttacgggtaccttaccggtaccgtaacccgttagttacccgg

SEQ ID NO: 211514 - DNA, 725 bp, Homo sapiens
  misc_feature: GYAE6OF02HMGZL.26.26.C04.1.454.CMB.1.raw
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
tcagagactatactcacgaccggtgctcgatttagtctagcgactttgggtttggggtgatcaggactcctcagttcaccttctcacaatgaggctccctgctcagctcctggggctgctaatgctcgtgggtcccagggtccaggtggggatgttgtgatgactcagtctccgctctccctgcccgtcaccttggacaggcgcctcatctcctgctaggtctagtacagacgcctacgtacanagtgagtggaaccnccgtccttagaactggtacttcgagcaggacggccacggacccaaccgtccggaggtccgacctttaaagtttaataagtatttactaaggtcgggtacgttcccggggtaccaagacagtacttcgagcggtcgtaggtcgggacaggcctagtgtactttcgaacgtcgtaggaacgtacgtacgaggtccggtaagggggtacggacgggtacgtagggaagggttagtttacgggtttcgggttacggtttttaacgttacgtcggtaccgttaggaccgtaagggttaacgtacgtttccgaaccggttcgggtacccggttagggtaacccgtttaccgggaaccggtaacggggtaaccgtaaacggggttaacggtaaaccgttaaccggaaaaccggtttaccggttacgggttacggtacctcggttaacccctaaccgttacgttccgtttaccgg

SEQ ID NO: 211515 - DNA, 606 bp, Homo sapiens
  misc_feature: GYAE6OF02GAF76.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctcatctcctgcaggtctagtcagacgcctcgtacacagtgatgggaacaccgccttgactggattcagcagagccacgccaaccgtccgaggccgacctaattataatatttactaagtcggtagttccggggtccagacagtacttcgagcggacgtaggtgggtacgaggcacgtagtactttacgacgtctagaagatacgagcgaggggtgggaagggcgtaggaggtagttgggtttagttacgggttttattacgtcgtaccgttacgacgtaggtagttacgttaccgtacggttcgggaccggttacgggtaccggtttccggggaacccggtaacggggtaaccggtaagggtaaccggg

SEQ ID NO: 211516 - DNA, 597 bp, Homo sapiens
  misc_feature: GYAE6OF02H7I9Y.26.26.C04.1.454.CMB.1.raw
  modified_base (310)..(310): a, c, t, g, unknown or other
  misc_feature (310)..(310): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggccccagggtccagtggggatgttgtgatgactcagtctccgctcctcctgcccgtcaccttggacaggcgcctcatctcctgcaggtctagtcagacgcctcgtacactagtgatacgggaacaccgtcttagactggattcagcagagcaggccaaccgtcgagcgctaatttanaacgtatttcaagtcgggattccgggaccagacgtagacttcgaggcgacgtaggtgggtcaaggtctaacgtgtattttccgacgtctagaacgtatcgagacgtagggtaggaggtcgtaggaggtagttgttaggtacgttttatacgtcggtaccttggacgtagtagttacgtacgtacgtcgggtacggtacgggtaccgttccgggaccgtaacgggaccgtaagggtacggtaaactacgaaaacgtacgtggtacggtctacggactacctagttccg

SEQ ID NO: 211517 - DNA, 650 bp, Homo sapiens
  misc_feature: GYAE6OF02H0TAH.26.26.C04.1.454.CMB.1.raw
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctctccctgcccgtcacccttggacaggccgcctccatcctcngctaggtctagtcagacncctacgtacacgtagtgagtcgggaaccaccggtccgttagaactggtacttcacggcgaggacggccgaggaccctaaccgtccggaggccgtaccttaatttaataagtactttactaaggtcggtacgttacccgggtccacgacagtacttcgaggcgcgtacggtggtcaggtcacgttagtactttccgacgtcgtagaacgtactacgaggcggtagggtacgggagtcgtaggtagtagttcgggtttacgtacggttttactccgtcggtacgtacgacgtaaggttattacgtacgacgttgggtccggtagtaccggttcggacgtaacgggtaccgtaaggtaacggtaaacgtaccgtaaacgtcgtacgggtcgtaccgtacgaccgtacgtattaccg

SEQ ID NO: 211518 - DNA, 799 bp, Homo sapiens
  misc_feature: GYAE6OF02I1UB9.26.26.C04.1.454.CMB.1.raw
tcagagactatactcacgaccggtgctcgatttagtctagcgactttgggtttggggtgatcaggactcctcagttcaccttctcacaatgaggctccctgctcagctccgtggggctgctaatgctcgtgggtcccagggtccaggtggggatgttgtgatgactcagtctccgctcctccctcgcccgtcacccgttggacaggcgcctccatctctgcaggtctagtcagcgcctacgtacacgagtgagtacgggaaccgaccgtaccgttacgtaacgtacggtacgttacgacgacgaacggacggaccggaccggaccccgtaaaccccgtaggacccccccccccccccccccccccccccccccgggaggtaacccttaaacgtttaaagttaaacgttaacgttttaacgttaaacggttaccggggttaccggttaccccgggggttacccgtaacggtaaccgtaacgtacgttacgacggccggtacgtacgggttacggggtacggtacggtacgtacgttacgttacgtttaccgtaccggtacgtacggtaaagtacgtacgacggacggtaggggtacgggtacgggtcggtaggtaggtagttggtttacggttacggtttacgttacgtcgtaccgtcgtacgtagtacgttacgttacgtacgtcggtaccggtcggtacggttacgggtaccggtacgggaacggtaacgggtaacggtaacgtaacgtaaacgtaacgtacggtacggtacgtacgtaccgtacctacgtacgtacg

SEQ ID NO: 211519 - DNA, 582 bp, Homo sapiens
  misc_feature: GYAE6OF02HQDVE.26.26.C04.1.454.CMB.1.raw
  modified_base (471)..(471): a, c, t, g, unknown or other
  misc_feature (471)..(471): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctctccctgcccgtcacccgttggacaggccgcctccatcctcctgcaggtctagtcagacgcctcgtacacagtgatgggaaccaccgccttgaactggattcagcagagccagccaacctccgaggcgcctaattataagtatttactaatcgggattcccggggtacccagacagacttcagcggcagtgggacaggactacgtgtatttcgacgctagaagtatacaggctaggggtggaggccgtaggagggattggtgttacggtttattaccgtcgtctagactaagngttaactcgtaccgtgggccgtgggtaccgttcggaccgaaggggtaccgtaagggtacgtaaagtacgaaacggtacgtacggtacggcgtacggacctacgtagttccg

SEQ ID NO: 211520 - DNA, 865 bp, Homo sapiens
  misc_feature: GYAE6OF02JDXWT.26.26.C04.1.454.CMB.1.raw
  modified_base (208)..(208): a, c, t, g, unknown or other
  misc_feature (208)..(208): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctcgggtcccagggtccaggtggggattgttgtgatgactcagtcctccgctcctccctcgcccgtcacccgttggacngggccgcctaccattcctcctgcgaggtctacgtcacgtacggtcccttacggtacactaggtagagtacgggaaccacccgtccttagacgtaggtacttcgacgtacgaggacggccgtacggacccaacccgtccgggaacggtcccgtacctttaaagtttaagttaagttaactttaccgttaaacggttaccgggggtacccggtttacccgggggtacccccgtaacggtaaccgtaaggttaaccgttaccgtaacgggtaccgggtaccggttacggggttacggggtaccggtaaaccggggcccgttaaacggttacggttaccgttttaacgaccgggtaccgttaaggaacgtaacggttacgaacgggtcggtaaacggggggtgggaacgggtcccggtagggaacggtttaggttacggtttacggttaaccggggtttttaacttccggttacggtcccggtaggacccgttaaggttagtttaccgttaccggtaccggtccgggttaccggtacggttaccgggtaccggggtaccgaaccggggtaaccggtaacgggtaaccggtaaacgttaaaccggtaaacgtaaccggttggtaaccgggtccgtacggtacccgtaagttccgttaaccgg

SEQ ID NO: 211521 - DNA, 571 bp, Homo sapiens
  misc_feature: GYAE6OF02HLD70.26.26.C04.1.454.CMB.1.raw
  modified_base (398)..(398): a, c, t, g, unknown or other
  misc_feature (398)..(398): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgccccgtcacccttggacaggcgcctcatctcctgcaggtctagtcagagcctcgtacacagtgatgggaacaccgccttgaactggattcagcagaggccaggccaacctccgaggcgccttaatttataagtatttactaagtcgggtacttcccggggtccagacagattcagcggcaggtgggtacaggcacgtgtactttcacgctgaantcgaggcaggggtggaggctaggaggtatggtttgtacggttttattacgtggtcctggctaggtacgttacttcgtacgtgggtccgtgggtaccggttccggaccgaagggaccgaaggtaaggaactaaccggaaacgtacgtaggtcgacgtgtacccgactacgttcg

SEQ ID NO: 211522 - DNA, 609 bp, Homo sapiens
  misc_feature: GYAE6OF02JBB2J.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctctccctgcccgtcacccttggacaggccggcctccatcctcctgcaggtctagtcagacgcctcgtacacaggtgatcggggaaccaccgccttagaacctggacttcagcgaaggacggccgaagggcccaaaccgtccggaacggccgtaccttaaatttaacgtaaagtacttttacgtaaagttcggggtaacgtttcccggggaccctaagacctagactttcgaggccggctaggtcgggtacagggctaacgtgtactttcgacgtcgtagaagatcaggtcgaggggtggaggctaggaggtagttggttgtacggtttattacgcgtccgtgactagagttatcacgtcggcgttaggcgttcggacgaacggtacgaaggtagaaatacgaaacgtagtcggtacgctcgacacctagtcg

SEQ ID NO: 211523 - DNA, 741 bp, Homo sapiens
  misc_feature: GYAE6OF02GTVAY.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtacaggtggggatgttgtgatgactcagtctccgctctccctgctcgtcaccttggacaggcgcctccatctcctgcgagtctagtcagacgcctcgtacacagtgagtacgggaacaccgtccttgaacgttgggacttcgaagcgaggacggccgacggcccaaccgtcccggaggaccgtaccgttaaatttacgtaaagtacttttacgtaaagttaccgggggtacgtttacccgggggtacccaacggtaaccgtaagtacgtttccgaagggaccggtacgtaagggtcggggtaccgagggtcaccgttagtaacttttaccgacgtacgtaggtaaacggtactacggaggtaccgggagggggttacgggtaacggcggttaaggagggttaaggtttcggtttagggtacggtttttaacgtcgtttacgaccgttagtacgtaacgtacgttaacttcggtacggtcggtaccgggttacgggtaccggttaccgggaccggtaaacggggtaacaacggggttaaggtaaaccgtaacgaaacgggttacgtacgggtacggtaccgttacggacctaccgttacg

SEQ ID NO: 211524 - DNA, 598 bp, Homo sapiens
  misc_feature: GYAE6OF02IF5SW.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctcctccctgcccgtcacccttggacaggcgcctccatctcctgccaggtctagtcagagcctcgtacacagtgatgggaacaccgccttgaactggattcagcgagaggccaggccaaccgtccgaaggcgacctaatttataagtattttacgaattcgggtagttccggggtccagacagtattcagcgctaggtggtcaggcacgtgtatttcgacgtcgtcgaaagtacgttagacgtaggggtggaggcgtggaggtacgttggtttagtcggttttattacgtcgtaccgtagcgtagtacgtacttcgacgttcggccggtaggtaccggttcgggaccgtaacgggacgtaagggtaacggtaaacgtacgaaacgtacgtagtcggtacgtacgacaccgtagttcttaccgg

SEQ ID NO: 211525 - DNA, 777 bp, Homo sapiens
  misc_feature: GYAE6OF02FN1PE.26.26.C04.1.454.CMB.1.raw
  modified_base (257)..(257): a, c, t, g, unknown or other
  misc_feature (257)..(257): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctcctccctgcccgtcacccttggacaggcgcctcatctcctgcaggtctagtcagcgcctcgtacacagtgagtggaaccnccgtccttagaacttggattcgagcaggacggccacggacccaaccgtccggacggaccgtaccttaaagttttaacgtaaacgttacttttaccgtaaacggttccggggtaacggtttccccgggggtacccaagggtaaccgtaacggtaactttccggaacggtaccggggtacgtaaggggttcgggggtaacctaacggggacccttaacggttacggttaaccgttttacccgaacgggtccgttaaagggaaacgtacgtaccgtaacgggtaccgggtaagggggtacgggaacgggtaccggtaggtaacgggttagttgggtttacggttacggttttattaccgtacggtccgtggacgtaggtacgttacgttccgtacgttcgggtaccggttagggtacccggttacgggaccgtaacggggtaccggtaaagggtaacggtaaacgtaaccgtaaacggtacgttacggtacggtaccgtacggacccttaccgtagttacccg

SEQ ID NO: 211526 - DNA, 775 bp, Homo sapiens
  misc_feature: GYAE6OF02G96UR.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccgttggacaggccggcctccatctcctgcaggtctagtcagacgcctcgtacacagtgagtacgggaacacccgtccttagaacctgggtacttcaggtaccaggacggaccgacgggccccaaacccgtccggaaggccggtaccttaaattttaacgtaaagtattttacgtaaagttccggggtaacgtttcccgggggtacccaacggtaaccgtaaggtactttccgaacggccgggtactaaggggttcgggttacaacggggtcctacgttaggtaacgttttccgaacgtccgttagggaaacgtaacgttccgaaggtacggaagggggttgggaacgggtcgttagggaacgggttagttgggtttacggttacgggttttaactttacgttccggtacgttacggtccgtaaggtacgtttacgtttaccgacggttcgggtacccggttacgggtaccgggttacccgggaccggaaacgggtacgggtaaacgggtaaggtaaaccgttaaccggaaaacggtacggttacggtacgtaccggtaggtaacccctacggtacttaccgg

SEQ ID NO: 211527 - DNA, 692 bp, Homo sapiens
  misc_feature: GYAE6OF02HSGUM.26.26.C04.1.454.CMB.1.raw
  modified_base (180)..(180): a, c, t, g, unknown or other
  misc_feature (180)..(180): n is a, c, g, or t
  modified_base (248)..(248): a, c, t, g, unknown or other
  misc_feature (248)..(248): n is a, c, g, or t
  modified_base (262)..(262): a, c, t, g, unknown or other
  misc_feature (262)..(262): n is a, c, g, or t
  modified_base (328)..(328): a, c, t, g, unknown or other
  misc_feature (328)..(328): n is a, c, g, or t
tcagagactatactcacgaccggtgctcgatttagtctagcgactttgggtttggggtgatcaggactcctcagttcaccttctcacaatgaggctccctgctcagctcctgggctgctaatgctctgggtcccagggtccagtggggatgttgtgatgactcagtctccgctctccctncccgtcacccttggacaggccgcctaccatcctcctgcctaggtctagtcaggacgcctacgtacacngtgagtgggaaccnccgtcttgaactggattcgagcagacggccacggaccaaccgtcgacggccgtaccttaaatttanaacgttattttacaacgttcgggtacgttcccggggtaccaagacgtagtacttacgacgacggctaagggttggacgacggactacgtcgtactttcgaccggtagtaggaaacgtaactacgaacggcggtaacggggttgggaacgggtctagggaacgggtagtttgggtttacggtacggttttttaacgtaccgtggtaccgttgaccggttaagtacgtttacgttacgtaccgttcgggtaccggtggtaccggttaccggacccggtaaacggggtacgaaagggtaacgtaaaaccgtaacggtaaacgtacggtacggtacggtcggtacgacctaacgtcgttacgttaccg

SEQ ID NO: 211528 - DNA, 656 bp, Homo sapiens
  misc_feature: GYAE6OF02GVNOO.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagacgcctcgtacacagtgatacgggaaccaccggccttagaactggattcagcagacggccaggaccaaccgtccgacggcgacctaatttaataagtatttacgtaacgttcgggtacgttcccggggtacccagtacagtacttacgaggccggctaggtcgggtacgaggcctacgtgtacgtttacacgtacgtagtaagatcgaggacgtaggggtacggaggtccgaggtaagggtagttggtttcggttacgggtttttacttaacgttcggccgttagacgtagtaagttattccgtacgttgggtaccggttcgggtaccgttaccgggaccggtaacgggaaccggtaagggtaacggtaaacgtaacgtaaaccgtaacgttcggtacggtcgtacgggcctaccgtattccgg

SEQ ID NO: 211529 - DNA, 673 bp, Homo sapiens
  misc_feature: GYAE6OF02JD7X7.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagacgcctcgacacgagtgatgggaaccaccgcttgaactggattcagcgagacggccgacggacccaacccgtccggacggcgtaccttaaatttaataagttactttactaagttcgggtacgttcccgggtccgacgacgagacgttacgacggccgggacgtacggtgggtacgacggactaccgttgtacgtttccgacggtcgtaagaacgattacgaggtacggaggggtggaggcgtaggaaggtgttacgttggtacgtttacgtttcgtgtccgttgtacgagtacgttatcgtaacgttcgggccgggttacgggtacccgggttacgggtacccggtaacggggaaccggtaaggggttaacggaaaacgttaccggaaaacggtaaccggttacggacgggtaccgtaggtacccgtaccgttgttaccgg

SEQ ID NO: 211530 - DNA, 640 bp, Homo sapiens
  misc_feature: GYAE6OF02IBZOT.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagttgagtgggaaccaccgccttagaactggacttcagcagacggccacgggacccaacccgtccggacggccgtaccttaaattttaactaacgtaacttttacgtaagttccgggtacgttcccggggtacccagacagtacttcagcggacaggtcgggtcagggtcacgtgtacttttcgacgtctaggaaagtctacgaggacgtaggggtgggaggtcgtaggaggtagttaggttcggtacggttttagttaccgtcgcgttcgacgtaggtacgttacgttcgtaacgttcgggaccggttggtaccggttccggaccggaaggtacccggtaagggtaacgaacgtaaccgaacgtacgtaggtacggccgtagcctaccgtatccg

SEQ ID NO: 211531 - DNA, 554 bp, Homo sapiens
  misc_feature: GYAE6OF02FVQSI.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttagaactggattcagcagaggccaggccaacctcgaggcgcctaatttataagatttactaatcgggattccggggtccagacagattcagtcggcaggtgggtcaggcacgtgactttcgacgtctagaagatacagacgtagggtggaggcgtggaggtagtggttgtccggtttaattcgtagtccgtggactagtagttattctacgtcggtaccgtggtacgtcgaccgaagggaccgtaagggtacgaagtacgaacgaacgtggtacgcgtcgacacgtatccg

SEQ ID NO: 211532 - DNA, 703 bp, Homo sapiens
  misc_feature: GYAE6OF02IARGD.26.26.C04.1.454.CMB.1.raw
  modified_base (235)..(235): a, c, t, g, unknown or other
  misc_feature (235)..(235): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctccgtggggctgctaatgctctgggtcccagggtccaggtggggatgttgtgatgactcagtcctccgctcctcctcgcccgtcacccgtggacnggccgcctccatcctctgctaggtctagtcagacgtcctacgtacacgtagtgacggtacggaaccacccgtccgttacgaacgttggattcgagcgacgacggccgacggccctaacccgtccggacggaccgtacgtttaaagtttaaacgtaagttactttacgtaaacggttccggggtacgtttacccgggtacccgaacgtaccgaacgtacgtttcgacgggtcggcgtacgggtcgggttacaggcgtacgtgtaactttccgacgtacgtagtaacgtagtacgacggacggtaggggcgggtacggtacgtaggtacggttagttcggttagttaccgttttagtaccgtacgtcgtacgtacgtaaggttacgttacgttacgtaccggttagggtaccgttcggggttacggttaccgggaaccggtaaccgggtaaccggtaaggttaaaccggg

SEQ ID NO: 211533 - DNA, 750 bp, Homo sapiens
  misc_feature: GYAE6OF02GD3MH.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtgggatgttgtgatgactcagtctccgctctccctgcccgtcacccttggacaggccggcctcatcctcctgcaggtctagtcaggcgcctcgtacacagtgagtggaacaccgccttagaacgtggattcgagcagacggccgacggaccaaccgtccggaggccgaccttaatttactaagtactttactaagtcgggtacgtttcccgggggtcccaggtacagtaattcgaggtcggacgtacggtgggtacagggctactgtactttccgacgtcgtagaagtactaccgaggacgtaaggggttgggaacgggtcgttaagggacgggttaagttcggtttagggttaccggtttttaagtttaaccgtcggtttaccgtaggccgtaaggttaacgtttaacgtttaccgtacgggttcccgggttcccgggttacgggttaacccgggtttaccggggaacccggtaacggggttaaacccggtaaacgggggttaaccgggaaaaacgtttaaacccgggtaaaaaccggtacggtttaacggttacgggttaccgttcccggaacccgtaaccttaccggtttacgtttaacccgg

SEQ ID NO: 211534 - DNA, 588 bp, Homo sapiens
  misc_feature: GYAE6OF02F4XUD.26.26.C04.1.454.CMB.1.raw
  modified_base (400)..(400): a, c, t, g, unknown or other
  misc_feature (400)..(400): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgccccgtcacccttggacaggccgcctccatctcctgcaggtctagtcagagcctcgtacacaatgatgggaacaccgccttgaactgattcagcagacggccaggccaacctccgaggcacctatttataagatttactaagtcggtattccggggtaccagacagtacttcagcggcaggtcggtacacggcactgtactttcacgctagaagtntcgagcgagggtggaggctggaggagttgttgtacggtttacttgtcgtcctagcgagtagttagttctacgtcggtacgtgggttaccggttccggacggaacgggaaccgtaaggggtaacggtaaacgtaaccgtaaacgtaacgttcgggtacggtaccgtacggaccgtacctacgtttaccg

SEQ ID NO: 211535 - DNA, 672 bp, Homo sapiens
  misc_feature: GYAE6OF02GQYPF.26.26.C04.1.454.CMB.1.raw
  modified_base (168)..(168): a, c, t, g, unknown or other
  misc_feature (168)..(168): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtacaggtggggatgttgtgatgactnagtctccgctctccctgcccgtcacccttggacaggcggcctcatctcctgcaggtctagtcagagcctcgtacacagtgagtacgggaaccaccgccttagaacgtggattcagcaggacggccacggacccaaccgtccgaggccgtaccttaaattttaagaaagttattttacgtaaagtccgggtacgttcccggggtaccaaggtacagtacttcagcggtcaaggtcgggtacaggctactgtactttcgacgtactagaagatacgacgacgagggtaggaggtcgtaggaggtagttcggttaggttacggttttaactacgttcggaccttggtaaccgtagttaacgtttaacgttccgtaacgttcgggtaccggttagggtaccggttacccggaccggtaacgggaaaccggtaaggggtaaacgaaaactaaccggtaaaacggtaacgttacgggacggtccgtaaccggaccgtaaccgacgttacg

SEQ ID NO: 211536 - DNA, 612 bp, Homo sapiens
  misc_feature: GYAE6OF02G977J.26.26.C04.1.454.CMB.1.raw
  modified_base (213)..(213): a, c, t, g, unknown or other
  misc_feature (213)..(213): n is a, c, g, or t
  modified_base (249)..(249): a, c, t, g, unknown or other
  misc_feature (249)..(249): n is a, c, g, or t
tcagagactatactcacgaccggtgctcgatttagtctagcgactttgggtttggggtgatcaggactcctcagttcaccttctcacaatgaggctccctgctcagctcctgggctgctaatgctctgggtcccagggtccaggtgggatgttgtgatgactcagtctccgctctccctgcccgtcaccttggacaggcgcctcatctctgcnggtctagtcagacgcctcgacacagtgatcggaacnccgccttgaacgtggattcgagcaggcgccaggcccaacctccgagcgacctaatttaataagtatttacgtaacgtcgggtacgttcccggggtaccagacaggtacttacgagccggactaggtcgggtacacgggtactacgtgtattttccgacgtccgtagaagactacgaggaccggaggggtggacgggtcgtaggaggtgttggttcggttacggtttagttactggtcctgtacgagtacgttacttccgtacgttcggtacggttcggacggttacggaccgtaacgggacgtaagggtaacgaaacttaacgaaacgtaagtcggtacggtccgtagaccacgtatcgttcg

SEQ ID NO: 211537 - DNA, 746 bp, Homo sapiens
  misc_feature: GYAE6OF02F2TSG.26.26.C04.1.454.CMB.1.raw
  modified_base (156)..(156): a, c, t, g, unknown or other
  misc_feature (156)..(156): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgngatgactcagtctccgctctccctgcccgtcacccttggacaggcgcctccatcctcctgctggtctagtcagacgcctcgtacacgagtgagtacgggaaccacccggtccgttagaacgtggtacttcgagcaggacggcccgacggcccaaccgtccggacggtccgtaccttaaagtttactaaggttactttacgtaagtcgggtacgttccccgggggtaccaaggactacgtacttacgacggccggtacgtaagggtcgggtacgacggtaccgacgtttggtaacgtttccgaacgtcgtaaggaaagtacgtacgacggtacggtaggggtcggacgggtcgtagggaggttagttcgggtttggttacggttttagtttacgtcgtccgtggaccgtaaggtacgtttacgttaccggtacggttcgggttccggttacgggtaaccggtttacccgggaccggtaacggggtaacccgtaaaggggttaaccggtaaaaccttaaccggaaaaaccggtacggtttacgggaccggtaccgttacggtaacccgtaccgttacgttccgtttaaccgg

SEQ ID NO: 211538 - DNA, 655 bp, Homo sapiens
  misc_feature: GYAE6OF02JB4G9.26.26.C04.1.454.CMB.1.raw
tcagagactatactcacgaccggtgctcgatttagtctagcgactttgggtttgggggtgatcaggactcctcagttcaccttctcacaatgaggctccctgctcagctcctggggctgctaatgctctgggtcccagggtccagtggggatgttgtgatgactcagtctccgctctccctgccctcacccttggacaggcgcctccatctcctgcaggtcctagtcagacgtcctcgtacacagtgagtggaacaccgcttagaactggattcagcagacgccacggccaaccgtccgaggcgtacctaatttataagtacttactaagtcgggtattcccggggtccagacagtacttcgagcggacagggtcggtacgacggctactagtactttcacgtctagaaagtactacgtacggacgtagggtacgggacgggacgtacgggaaggttacgtggtttacggttacggttttaacttacgtcgtaccgttgactaaggtacgttaagttaccgtaacgtgggtacccgggtaggtccgggtttacgacccggaacgggtaaccggtaacggggtaaacggtaaacgaacgtaaaaccgggtaaccgttagggtacggacctagacccggtaactacgtcgttaaccg

SEQ ID NO: 211539 - DNA, 663 bp, Homo sapiens
  misc_feature: GYAE6OF02GFG26.26.26.C04.1.454.CMB.1.raw
  modified_base (167)..(167): a, c, t, g, unknown or other
  misc_feature (167)..(167): n is a, c, g, or t
  modified_base (256)..(256): a, c, t, g, unknown or other
  misc_feature (256)..(256): n is a, c, g, or t
  modified_base (313)..(313): a, c, t, g, unknown or other
  misc_feature (313)..(313): n is a, c, g, or t
  modified_base (353)..(353): a, c, t, g, unknown or other
  misc_feature (353)..(353): n is a, c, g, or t
  modified_base (392)..(392): a, c, t, g, unknown or other
  misc_feature (392)..(392): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactnagtctccgctctccctgcccgtcacccttggacaggccgcctccatctctgcaggtctagtcagagcctcgtacacagtgatgggaacnccgccttagaactggattcagcagaggccaggccaaccgtccgagcgacctaattanaatatttactaagtcggtagttccggggtaccagacagtnttcaggcgcgaggtggtacaggcactgtactttcacgtntagaacgtatacaggacgtagggggtacggagggtaccgtagggacggtaagtttcggtttaggttaccggttttaacgttaccgttggtccgttaggaccgtaaggtagtttaacgttaccgtacggttaccgggtacccggttagggttacccggtttccgggaccggtaacggggtaacccggtaaaggggttaacgtaaaccggtaacgtaaacggttaacggtcgggtaacggtaccgttcggaaccctaccgttacgttacccgg

SEQ ID NO: 211540 - DNA, 784 bp, Homo sapiens
  misc_feature: GYAE6OF02IMSTU.26.26.C04.1.454.CMB.1.raw
  modified_base (210)..(210): a, c, t, g, unknown or other
  misc_feature (210)..(210): n is a, c, g, or t
  modified_base (258)..(258): a, c, t, g, unknown or other
  misc_feature (258)..(258): n is a, c, g, or t
tcagagactatactcacgaccggtgctcgatttagtctagcgactttgggtttgggggactgatcaggactcctcagttcaccttctcacaatgaggctccctgctcagctccgtggggctgctaatgctcgtcgggtcccagggtccaggtggggatggttgtgatgactcagtcctccgctcctccctcgcccgtactccgttggacngggccgcctccgatcctccgtgctaggtcttagcgagcgcctacgacncgagtcgagtacggaactaccgtctagaacgtggtattcgagacgaggacggtaccgacggaccctaaccgtccggaaggccgtacttaaacgtttagtaaacggttatttacgaaaggttccggggtaacggttcccggggtaacctagaaccgtagacgtttacgacggacggtacgtagggtcgggtacacgggtcgtaacgtggttaccgttcgaccgacgttagaaacgtacgtacgaggtacgggagggttacgggacggtggtacgaagggttacgtttaggttacgggttaacgttttaacggttcaccgggtccttagggacctaaggttaccggttaacgttaccgtacgggtacccgggttacggtacggggtttaaccggtacccggtaaccgggtaaacgggggtaaccggtaaacggggttaacgtaaaaaggtacccgttaaaaaccggttacggttacccgggttaaggcccggttaacccggtaaccgtacccttagggtttaacccgg

SEQ ID NO: 211541 - DNA, 747 bp, Homo sapiens
  misc_feature: GYAE6OF02JZNIT.26.26.C04.1.454.CMB.1.raw
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
tcagagactatactcacgaccggtgctcgatttagtctagcgactttgggtttgggggtacgtgatcaggactcctcagttcaccttctcacaatgaggctccctgctcagctcctgggctgctaatgctctgggtcccagggtacaggtgggatgttgtgatgactcagtctccgctcctccctgcccgtcnccttggacnggcgcctccatctcctgccaggtctagtcaagcgtcctacgtacacgtagttgagtcgggaaacacccggtccttaggaaccttagggtcttacgacgacaaggttacgggacctaacgggaccctaaaccctccgaacgggaccaccgttaaagttttataaaggtactttttacggaaaagttcggggaacgtttaccccggggaccaacgtaacgagtacgttacgaggaaccggcggaaggttcggggtcaccggggacctaatcgggtaaaccttttcgaaacggtccttagaaaggtaattccgaaacggacggttaaagggccgggtaaggccgttggaaacggttaggttggttacgggttacgggttttagtaaacccgtttgggtaccttcggtaaacgtaccggggtttaataacgttaaccggtcggttaaccggtcggtacgtaccgggttaccgacggtacggaaccggaagggttaacgaaagtaaccgaaagttaccgagttacgggtctaacgggcaactattaccgg

SEQ ID NO: 211542 - DNA, 679 bp, Homo sapiens
  misc_feature: GYAE6OF02GCAQ3.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgtgtgatgactcagtcctccgctctccctgcccgtcacccttggacaggcgcctcatcctctgcagtctagtcagacgcctacgtacacagtagagtggaaccaccgccttagaacgtggtattcagcagacggcacggaccaaccgtccgacggaccgtacctaatttaagtaaagtactttacgtaaacgtccgggtacgttacccgggggtacccaggtaaccgtaggtactttacgaggtaccggaccgtaggtcggggtacacgggtactacgttacggtatttaccgacggtcttaagaacgtagttccgaaggtacgtaacggggtgggaacgggtaccgttagggaaggtaggttcggtttaggttccggtttaaattaccgttacgtaccgtgtacgtaggtaacgttaacgttccgtacgtacggtccggttacggttaccggttacgggtacccggtaacgggtaacccggtaaggtaaacggg

SEQ ID NO: 211543 - DNA, 750 bp, Homo sapiens
  misc_feature: GYAE6OF02H9XA4.26.26.C04.1.454.CMB.1.raw
  modified_base (89)..(89): a, c, t, g, unknown or other
  misc_feature (89)..(89): n is a, c, g, or t
  modified_base (249)..(249): a, c, t, g, unknown or other
  misc_feature (249)..(249): n is a, c, g, or t
  modified_base (305)..(305): a, c, t, g, unknown or other
  misc_feature (305)..(305): n is a, c, g, or t
tcagagactatactcacgaccggtgctcgatttagtctagcgacttttgggtttgggggactgatcaggactcctcagtttcacctttntcacaatgaggctccctgctcagctcctggggctgctaatgctctgggtcccagggtccaggtgggatgttgtgatgactcagtctccgctctccctggccccgtctacccgttggacacgggccggtccctccattcctccgtgcgtaggttctaggtnagacgtcctcgtacacgagtgagtcgggaaccaccgtccgttagacgtggtacttnacgcaggacggcacggaccaacccgtccgacggccgtactttaagtttataagttactttacgaagttaccgggtacgttcccggggtccaacggacgtagtattcgagtccggagaggtcggtacgacggtactacgtgttaacttttaccgacgtacgtacgaaacgtacgtacgacgggtacggtagggggtagggtaacggtcggtaacgggtaagggttgttttacgggttttcggtaaccggtttttaagttcccggtaacggtcccgtttaggaacggtagtaacgtttacgttacccgttaggttacggggtcccggttacgggttacccggttaccgggaaccggtaaagggtaacccgtaaggggtacgtaaacgtaaccgtaaaaccggttacgtacggtacgggtacgttaccggacctacccgtagttaccg

SEQ ID NO: 211544 - DNA, 675 bp, Homo sapiens
  misc_feature: GYAE6OF02IAP8O.26.26.C04.1.454.CMB.1.raw
  modified_base (246)..(246): a, c, t, g, unknown or other
  misc_feature (246)..(246): n is a, c, g, or t
  modified_base (434)..(434): a, c, t, g, unknown or other
  misc_feature (434)..(434): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctctccctgcccgtcaccttggacagggcgcctcatcctctgcaggtctagtcaagacgcctcgtacacnggttgagtcgggaaccaccgtccgttgaaccgtggtattacgagcgaggacggaccacggaccccaacccgtccggacggacgtacttaatttataagtactttactaacgtcgggtacgttccggggccaggacagtattcgacgacggtgtaggtgggtcgagtcacgtcgtaatttccgacggtntacggtaagactcgaaggacggtaggggtggggaacggtcgtagggaaggtacggtttggtttacgggttacgggttttaattacggtcgtacgttagacgtagtagttacgtcgtaacggttcggccggttacgggtaccggttcgggaccggtaacgggaccggtaaagggttaacggaaacgtaaccgaaaccggtaacggtcgtacgggtacgttaccggacctaccgtgttacccg

SEQ ID NO: 211545 - DNA, 750 bp, Homo sapiens
  misc_feature: GYAE6OF02GLCHF.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctctccctgcccgtcacccttggacaggcgcctccatctctgcaggtctagtcagacgcctcgtacacagtgagtcggaaccaccgtcttagaacgtggattcgagcgaggacggaccacggacccctaacccgtccggaacgggtcccgtaacctttaaatttaacgtaaacgttacttttacgtaacgttaccggggtacgtttcccggggtacccaagacgagtacttcgacggtacggtacgtagggttcgggtacaaggtcctacgttgtacgtttaccgacgtcgtaacgaagtacgtacgaggcggtaggggtcgggacgggtcgtagggtaggttacgtttgggtttacggttacggttttaacgttacgtcggtaccgttggtacgttaaggtacgtttacgttaccgtacggttaccgggtaccggttacgggttacccggttaccgggtaaccggtaacggggtaaccggtaaacggggtaaacggtaaaaccggtaaccggtaaaaccggttaccggttagggtccggtaccgttaccgaacccgttaccgtaccgttcccg

SEQ ID NO: 211546 - DNA, 574 bp, Homo sapiens
  misc_feature: GYAE6OF02FP7NF.26.26.C04.1.454.CMB.1.raw
  modified_base (190)..(190): a, c, t, g, unknown or other
  misc_feature (190)..(190): n is a, c, g, or t
tcagagactatactcacgaccggtgctcgatttagtctagcgactttgggtttgggggactgatcaggactcctcagttcaccttctcacaatgaggctccctgctcagctcctgggctgctaatgctctgggtcccagggtccagtggggatgttgtgatgactcagtctccgctctccctgccccgtnacccttggacaggcgcctccatctcctgcaggtctagtccagagcctcgtacacagtgatgggaacaccgccttgaactggattcagcagaggccaggccaacctccgaggcgcctaatttataagatttctaatcgggatttccggggtccccagacagattcagcggcaggtgggtcaggcactgatttcacgctagaagatcagcagggtggaggcgtgaggatgttgcgggtttattactagccttagctagagttagttcacgtggccggtggtacccggttcgggccaaaggggacccgaaagggttacgggaaaacgttccgaaaaccgtaacggtacggttacgggtaccgttacggccgtacccgtattacccgg

SEQ ID NO: 211547 - DNA, 737 bp, Homo sapiens
  misc_feature: GYAE6OF02HERTS.26.26.C04.1.454.CMB.1.raw
  modified_base (199)..(199): a, c, t, g, unknown or other
  misc_feature (199)..(199): n is a, c, g, or t
  modified_base (288)..(288): a, c, t, g, unknown or other
  misc_feature (288)..(288): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctactcagctcctggggctgctaatgctcgtgggtcccagggtccaggtggggatgttgtgatgactnagtctccgctcctccctgcccgtcaccccttggacgacggccggcctccatcctcctgcaggtctagtcagacgtcctacgtacaacgngtgagtacgggaaccaccgtccgttagaacgttggattcgagcgagacggccacggacccaaccgtccggaacggtccgtaactttaaacgtttaagtaaacgttactttaacgttaaggtccgggtaaccgtttccccgggggtaccctaaggtaacctagggttacgttccgaacggtccgggtaacgtacggggttcggggtaccgaagggccttaacgtaggtactttcgaccgtacgtaacgtaaggactcgaaggcgtaggggacgggtacggtcggtaggacgggtagtttcggttgggttaacgttttacgtacgttcggcgtacgacgtaaggtttacgttacgtttacgtaccggttcgggtacccgggtttacggttaccggggttcccggaaacccgggtaaccgggtaaccgggttaagggtaacggtaaaaccgg

SEQ ID NO: 211548 - DNA, 647 bp, Homo sapiens
  misc_feature: GYAE6OF02HD2DX.26.26.C04.1.454.CMB.1.raw
  modified_base (139)..(139): a, c, t, g, unknown or other
  misc_feature (139)..(139): n is a, c, g, or t
  modified_base (293)..(293): a, c, t, g, unknown or other
  misc_feature (293)..(293): n is a, c, g, or t
  modified_base (434)..(434): a, c, t, g, unknown or other
  misc_feature (434)..(434): n is a, c, g, or t
  modified_base (521)..(521): a, c, t, g, unknown or other
  misc_feature (521)..(521): n is a, c, g, or t
  modified_base (529)..(529): a, c, t, g, unknown or other
  misc_feature (529)..(529): n is a, c, g, or t
tcagagactatactcacgaccggtgctcgatttagtctagcgactttgggtttgggggagataaaaggctcagctctacccgttgccttgactgatcaggactcctcagttcacccttctcacaatgagctccctgctnagctccgtgggctgctaatgctcgtacggtcccaggtccaggtggggtatggttgtagatgactcgagtctccgctcctcctcggccctcacccgttgacgacggccgacctcatcctctgtaccgaggtatagtcgacgacgcctacgtaccncgtagtgagtacggaacctaccgtcgttaagacgtggactcgagtcgaggtcgaccgagacccgtaacgccgagccgtaacttaattacgtaagtactttacggacgttcgggtacttacccgggacagacgatcgtacgnggcggacgtacgggtcgtcgaacggtacgtacgtgttacgttacacgtagtaagtaacgtcgtacgagacggaagggtgacggtagnggtaaggngttgttaggtacgtttacgtacgtgtcgtacgacgttaggtactaccgtacgtacggtacggtccggtaacggttcccggttaccggaccggtaaacgggtaccgtaaggttaaccgg

SEQ ID NO: 211549 - DNA, 814 bp, Homo sapiens
  misc_feature: GYAE6OF02JUOZR.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctgggctgctaatgctctggtcccaggtccagtgggatgttgtgatgactcagtctccgctcctccctgcccgtcacccgttgacgacggccggcctccatcctcctgcgaggtctagtcgagacgccttccgtacacgtagtgtagtcggaacctaccgtccgttacgaacgtcggtaacttccgacgtcgaacggtacggacccgaacggaccctaacccggtaccggacggtacccgtaccgtttaaagtttacgtaaacggttacgttttaaccgtaacggttaccggggtaacgtttaccccggggtacccgtaacggtaaccgtaacggtaactttaccggacggtcccgggtaccgtagggttcccgggtaccgtaaacggtcccgtaacgttacgggttaacttaccggacggtaccgttaagggaaactacgttaccggaacgggtaccgggtaaaggggggttcgtaacgggtaccgttaggggtaacgggtttactttacgggggttttacggttaaccgggttttttaacaccgggtttcggtacccgtttaggtaacgtacgggttaacgtttaccgtaccggtacggttacggggtacccgttacgggttacccggtacccggtaacggtaacgggtacccgttaagggtaaaccggg

SEQ ID NO: 211550 - DNA, 612 bp, Homo sapiens
  misc_feature: GYAE6OF02IJHYT.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaaccaccgccttgactggattcagcagaggccaggcccaacctccggaggcgacccttaatttaataagtatttactaaagtcggggtactttcccgggggtcccaagacagtattcaaggcggcaggtgggcaggcactgtatttcacgctagaagatcaagcgtaggggtggaggctggaggtacgttggtttaggtcggtttttaatacgtgcctgccgtaagagttacttcgacgttcgggtcccggtagggtacccggttccgggaccgaacggggaacctaaggggtacggtaaaacgtaccgaaaaccgttaacgtggtcggtacgttcggacccgaaccttactacgttaccgg

SEQ ID NO: 211551 - DNA, 614 bp, Homo sapiens
  misc_feature: GYAE6OF02IJHSK.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggccgcctccatctcctgcaggtctagtcagacgcctcgtacacgagtagagtcgggaaccacccgtccttagaacgtggattcagcagacgccacggaccaaccgtcgaggccgaccttaattataaagtactttacgtaaacgtcgggtacgttccggggtacccaagacagtattcgagcggcaggtgggtacaggcgtactgtactttccgacgtctagaagactacgaagcggaggggtaggacggtacgtaggtaggtagttggttcgttacggtttaatccgtgtcctagacgtaggtaacgttacgtcgtaacggtcggtaccggtacgggttaccggttccggaaccggtaaacgggaccgtaagggtaaacgg

SEQ ID NO: 211552 - DNA, 720 bp, Homo sapiens
  misc_feature: GYAE6OF02I9XWA.26.26.C04.1.454.CMB.1.raw
  modified_base (165)..(165): a, c, t, g, unknown or other
  misc_feature (165)..(165): n is a, c, g, or t
  modified_base (207)..(207): a, c, t, g, unknown or other
  misc_feature (207)..(207): n is a, c, g, or t
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
tcagagactatactcacgaccggtgctcgatttagtctagcgactttgggtttggggggactgatcaggactcctcagttcaccttctcacaactgagctccctgctcagctcctggggctgctaatcgctcgtgggtcccagggtccaggtggggtattgttgngtatgactcagtctccgctctccctgcccgtcacccttgacncggcgcctcatctctgcagtctagcagcgcctacgtacanagtgagtcgggaaccnccgtctacgaacgtggtattccgaagtcgaggaccggccaacgggtaccccaaccgtccggacggtaccgtacctaatttaactagtactttacgtaacgtcgggtacgttccgggtccaggtactagtagttacgacggtccggtactaggttcggtacacggtacaccgttagtacctttcgacggtgtaacgaacgtactacggaacgcgggtaagggtacggtagtacgtggtaaggttagtttcggttacggttacggttttaacttaccggccggttccgtcggtaccgttaacgggtacgtttactttaccgggaactttcggggtacccgttagggttaacccgttcgggacggtaaaccgggtaaccgtaacggggttagaaaacccgttacgaaaaccggttaggttaccggtcggtcccgtaccgtaccacccttgggtttaaccc

SEQ ID NO: 211553 - DNA, 729 bp, Homo sapiens
  misc_feature: GYAE6OF02HFJYM.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagagcctcgtacacagtgatcgggaacaccgcttagaactggacttcacgcaggacggccacgggcccaaccgtccggaggccgtaccttaaagttttaactaaggttacttttacgtaaaggttccggggtaacgtttcccgggggttacccaaggtaacctaggtacttacgacggtcgggaccgtaagggttcggggtacaacggggtcctaacgttggtaactttttcccgaacggtacgttagaaacgtagtccgaggtaccggtagggggtaggacgggtcgtagggtaggtaagtttgggtttcggttacgggttttaacttacggttacggccgttggacgtaggtacgtttacgttaccgtaacgttcggggtaccgttacgggtaccggttccggacggtaacggggtaacccgtaagggtaaccggtaaaacgtaaccggtaaaaccggtaacgtacggttacggcgttacgacctaccgtattaccgg

SEQ ID NO: 211554 - DNA, 670 bp, Homo sapiens
  misc_feature: GYAE6OF02F8HG7.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcgcctccatctcctgcaggtctagtcagacgcctcgtacacagtgatgggaacaccgcttgaactggattcagcagaggccaggacccaaccgtccgaggcgcctaatttataagtatttctaagtcgggtagttccgggtaccagacagtattcgagcggcaggtcgggtcaggcactagtatttcgacgtactagaagtatacgacgacggaggggttgggaagggtccgtaggtagggtaagttggtttacgggtaccgggtttttaacgttaccggttcggtaccgttcggacgtaggtaacgttttacgttaacccgtacggttaccgggtcccggttacggggtaaccggtttccgggacccggtaaagggaacccgggtaaagggtaacgggtaaacgtaaacccgaaaaccggtaacgttgggtaccggtaccttacggaccctacccggatttaccgg

SEQ ID NO: 211555 - DNA, 680 bp, Homo sapiens
  misc_feature: GYAE6OF02GJY2U.26.26.C04.1.454.CMB.1.raw
tcagagactatactcacgaccggtgctcgatttagtctagcgactttgggtttggggtgatcaggactcctcagttcaccttctcacaatgaggctccctgctcagctcctgggctgctaatgctctgggtccagggtccagtggggatgttgtgatgactcagtctcgctctccctgcccgtcacccgttggacaggcgcctcatctcctgcaggtctagtcagacgcctcgtacacgagtggagtacgggaacacccggtcttgaactggtattcgagacagacggccacggacccaacctccggaggccgtaccttaatttaactaagtatttactaagtcgggtacgttccggggtaccagaacagtacttcgagcggacgaggtgggtcgacggactacgttagtactttaccgaacgtccgtaagaaacggtactacgaacggccgggtaaggggttgggaacgggtcgtaagggaagggtagtttggtttacgggttacggtttttaattacgttcggaccgttcgacgtaagttaagtacgtttacgaccggttacgggtacggttcgggtaaccgttccgggaacccggtaacggggtaccgtaaaggggtaacgaaacgtacggaaaacgtacgttaggtcggtacgtcgaaccgtacctagtccttacg

SEQ ID NO: 211556 - DNA, 835 bp, Homo sapiens
  misc_feature: GYAE6OF02IC9U3.26.26.C04.1.454.CMB.1.raw
  modified_base (259)..(259): a, c, t, g, unknown or other
  misc_feature (259)..(259): n is a, c, g, or t
tcagagactatactcacgaccggtgctcgatttagtctagcgactttgggtttgggggagataaaagctcagctctacccttgccttgactgatcaggactcctcagttcacctttctcacaatgagctccctgctcagctccgtggggctgactaatgctcgtcgggtccagggtccaggtgggtatgttgtgatgactcagtctccgctcctcctcgcccgtctaccgttggacgaggccgccctcactctcctcgngtaggtctcgtacgacgtcgtcctacgtacacgtaggtacgaacggtaccgggaactccccgtacgtttacgaacggttggtacttacggacggtcgaacggacggacccggaaccggtaccctaaccggtccgggacggaccgttaaacctttaattaagttaacgttacttttacggtaacggttaccgggtaccgggtttcccgggaacctaaggtaccgtaaagttactttaccggacggtacgggacggttcgggtacgggttacgaccggtaacctaggtttcgtaacctttacgaccggttacggttaacgtaaggtactaccgggtaggtaaccggggtagggggtacggtacggttaaccggagggtttaacggggttacgtttggggtttttaaccggtttaacggttttacgtaccgggtacgttaccgtacggtaaaccgggttagtaccggttttaaccggttaaccgtcggggttacccgggtaccgggtttaacgggccgggtttaaaccccgggaacggtttaaaccgggggtaacccgggttaaaggttaaaacccggg

SEQ ID NO: 211557 - DNA, 884 bp, Homo sapiens
  misc_feature: GYAE6OF02JHNJW.26.26.C04.1.454.CMB.1.raw
tcagagactatactcacgaccggtgctcgatttagtctagcgactttgggtttggggtgatcaggactcctcagttcaccttctcacaatgaggctccctgctcagctccgtggggctgctaatcgctctcggtcccagggtccaggtggggatgttggtgatgactcagtcctccggctcctccctgccccgtacaccccgttggactaggccggcctccacgttcctccgtgacaggttctacgtcgaagtcgtcccgttccgtaacgacagtggagtacgggaacctaccggtcccgttagaaccgttaggtaactttcgaacgcgtaacggacgggacccaacggggtacccctaaacccgttccggaacgggtaccggtaaccctttaaacgtttttaacggttaaaaacggttactttttaaccgtaaaacggtttccgggggtaaccgttttaccccgggggggttaccccaaacgggttaaccgtaaacggttacccgttttaaccggaacggtccgggttaaccggtaacggggtttacggggttacccgtaaacggggaaccggtttaaccgttacgggtaaaccgtttttaccggaacccgttcgttaacggtaacggtaacgttaccggtaacgggtaccggtaaccgggggttaacgggtacgggtaaccggtgggtaaacggttaacggttacggttttaccgggttacgggttttaccgtttaaacggtcgttcccggttagtacgtaacgttacgtaacgtttccggaacgttcgggtaccggttacgtacggtacgacggtaacggacgagggtaacgaacgtacgtaacgacgttgcggtccgtagtaccctacgtgtaccttacg

SEQ ID NO: 211558 - DNA, 697 bp, Homo sapiens
  misc_feature: GYAE6OF02JLHBP.26.26.C04.1.454.CMB.1.raw
  modified_base (198)..(198): a, c, t, g, unknown or other
  misc_feature (198)..(198): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctccgtgggctgctaatgctcgtggtcccagggtccaggtggggatgttgtgatgactngtctccgctcctcccgtcgcccgtccacccgttggacacggccgcctaccatcctcctgcgtacggttctagtccagacgtcctacggtaaccacgtaggtagaacggtaccgggaacctacccggtaccgttagaaaccgtcggtacttacgagaccgaagggaacgcccgtaacggacccctaaccgtacccggaagggtccctaaccttaaaatttacgtaaagttacgtttaacgtaacggttaccggggtacgttccccggggtaccctagaccgtagtacttaccgaggaccggacgtaaggtccggtacgacgtcgtacgtacgtacgttaccgacggtacgtacgaagtactacgagtacggtagggtcggaacggtccgtaggtaagtgtttacggttcggttaccggtttaaatcgtacgtcgtagtacggtatacgttatacgtgtcggtcggtacggtcgtacgaaccggaacggacgtaggtaacg

SEQ ID NO: 211559 - DNA, 799 bp, Homo sapiens
  misc_feature: GYAE6OF02IKX2O.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctcctccctcgcccgtcacccgttggacaggcggcctccatcctcctgctaggtctagtcagacgcccgtcgtacacacgtgagtcgggaaccaccgtccttagaacctaggtacttacacgacaggacggaccgacggacccaacccgtaccgggaccgggaccggtaccgttaaagttttaactaaaggttactttaccttaaaggtaccggggttacggttaccccgggggtaccctaacggtaacgtacggtaatttaccgacggaccgggtacacggggttcggggtacggtacggaccgtacgtacgtaacgtttccgacgtcgtaaggtaacgacgtcggaacggacggtaagggggtcgggagggtcgtaagggacgggtaacggtttcgggtttacgggttaccggttttaacgttttccgtacggttccgttaagacggtacggtaacgtttacgttacgtacggtttaccgggtccggttaggggttacccgggtttacccgggaccggaaccgggggtaaccggtaaaggggtaaacggtaaactaaacccggtaaacggtaacggttacgggttacggcggttaccggaacccgttaacctaggttacccg

SEQ ID NO: 211560 - DNA, 1133 bp, Homo sapiens
  misc_feature: GYAE6OF02H3J4R.26.26.C04.1.454.CMB.1.raw
  modified_base (160)..(160): a, c, t, g, unknown or other
  misc_feature (160)..(160): n is a, c, g, or t
tcagagactatactcacgaccggtgctcgatttagtctagcgactttgggtttgggggactgatcaggactcctcagttcaccttctcacaatgagctccctgctcagctcctgggctgctaatgctcgtgggtcccagggtccaggtggggatgttgtnatgactcagtctccgctcctcccctgccccgtcacccgttggacaggccggcctaccatcctccgtgactaggttactaggtcaacggccgtccgtacgtaacacgtaaggtcgtagttacgggaacctacccggtccgttacgtaaccgtggtacttaccgaggtccgaagggacggtcccgaccgggtaccccgtaaacccggttccggacggacccgttaaccttaaagttttaaactaaacgttaacttttaaccgtaacggttaccggggtaaccgtttccccgggggaaccctaacgggtaacctacggttaacgtacggtaaccggaccgggtaccggtaacgggttcgggtaccggtaaccgggtacccgtaaccgtttacgttacgttttttacccggaacccgttaacggtaaaccggttaaacgggtaaacccgttcgggtaaaacccgggtaaggggttaccgggggggttaaacgggtaaccgggggttaacccgggtttaaacggggttaacgggtttaaagggggttttacccgggttttttaacggggggtttttaaaccgtttttttaaacccggttttaaacgggttttcccgggttaccccgggtttttaacggttaaccggggttaaacggttaaacgggtttttaaaccgtacccgggtttaaaccccggggttttcgggggttaaccccggggttttaaacgggggttaacccccggggttacccccgggggttaaaaacccccggggttaaaaaccgggggggttaaaaccccgggggtttaaaaaaccgggggtttaaaacgggggtaaaaacccccggttaaaaaaaccccgggtttaaaaaccgggttaaaccccgggggttttaacggggtttaaccccgggttaaaccccggtaccccggggtttaaaacccctaaccccccgtttagggttttaaccccccggg

SEQ ID NO: 211561 - DNA, 739 bp, Homo sapiens
  misc_feature: GYAE6OF02G1HLK.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctcctccctcgcccgtcacccttggacacgggccggcctccatcctcctgcaggtctagtcaggacgccctcgtacactaggtgagtacggaaccaccgtccttagaaccgtggacttcagcaacgcggacccacgggacccaaccgtccggacggtccgaccttaaatttaactaagttatttaccgtaaggttaccgggtacgtttcccgggggtacccaggtactaacggtacttcgacggtccggacgacggtgggtcgacggactacgttgtctttacgaccgtactaggaacgtactacgagggtacggtaggggtacggaggccggtaggtacggttaggttggtttacggttagttttacgttaacgttcgtcccgttagtacggtaaggtactttacgttacgtaccggttcgggtacccggttacgggttaccgggttacccgggacggtaaaccggggtaccgggtaaagggtaaccggtaaaacggtaacccggttaaaacggtaccgggttcggtacgggaccgttacggacccgttacgtacgtttccgg

SEQ ID NO: 211562 - DNA, 603 bp, Homo sapiens
  misc_feature: GYAE6OF02G46GO.26.26.C04.1.454.CMB.1.raw
  modified_base (460)..(460): a, c, t, g, unknown or other
  misc_feature (460)..(460): n is a, c, g, or t
  modified_base (476)..(476): a, c, t, g, unknown or other
  misc_feature (476)..(476): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccaggtggggatgttgtgatgactcagtctccgctctccctgcccgtcacccttggacacgggccgcctccatcctcctgcaggtctagtcagacgcctcgtacacagtgagtggaacaccgcttagaactggattcagcagacgccaggccaaccgtccggaggccgtaccttaaatttaataaagtactttacgtaaagtcggggtacgttcccgggggtacccaggaaccagtacttcgagcggctaggtgggtcaggctacgtgtacttcacgtactaggaanactacgagcgaggggngaggcgtaggagtgttgttcgtcggtttattacgtcgtaccgtgacgtaaggtacttacgttcgacgttcgggtaccggttacgggtaccggttaccgggacggtaacgggaccgtaagggtaacgg

SEQ ID NO: 211563 - DNA, 793 bp, Homo sapiens
  misc_feature: GYAE6OF02GNTIU.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccaggtggggatgttgtgatgactcagtctccgctctccctgcccgtcacccttggacaggcgcctccatctcctgctaggtctagtcagacgcctacgtacacgagtgagtagggaacacccggccttggaactggattcgagcagacggccaacggcccaaacccgtccggacggaccgtaccttaaatttaataaacgtatttacgtaaagtcgggtacgttaccccgggggtacccaaggtactaaggtacttacggacgtccgggactagggttacggggtacgaacgggtccaacgttggtaactttttccgaacgtaccgttaggaaaacgtagtaccgaaggtacgggtaacgggggtagggaacgggtacgtagggaacgggtagtttcgggtttacgggtttacggggtttttaatttaacccggttcggtacccgttacggcgtaaagggtacgtttaacgtttccgtacggttccggggtcccggtttacggggtaaccgggtttacccgggacccggtaaaccggggtaacccggtaaaggggttaacgggtaaaaccgtaacccggtaaaaaccgggttaacgttacgggttacggtaccgttaacggaacccgtaaccgttacggtacgtttacccgg

SEQ ID NO: 211564 - DNA, 906 bp, Homo sapiens
  misc_feature: GYAE6OF02F99TB.26.26.C04.1.454.CMB.1.raw
  modified_base (168)..(168): a, c, t, g, unknown or other
  misc_feature (168)..(168): n is a, c, g, or t
tcagagactatactcacgaccggtgctcgatttagtctagcgactttgggtttgggggacgtgtatcgaggactcctcagttcaccttctcacaatgaggctcctgctcagctcctgggctgctaatgctctgggtcccagggtccagtggggatgttgtgatgactnagtctccgctctccctgcccgtcaccgttggacacggtccgcctccatcctcctgcaggtctacgtacagtacgtccttacgtaccacgtagtcgaagttgggaaaccaccggtccgtttagaaaccgttgggtaacttcgaaggcgtaaggacgggccgacgggtaccccgaaacccgtccggaacgggtacccgtacccgtttaaagtttaactaaacggttactttttaccgtaaagttccgggggttaaccgtttccccgggggttacccaagggtaacctaagggttaactttccgacgggtaccggtacgttaagggttcggggtacgaacggacctaacgttaggttaaccttttccgaccggtcgttaaggaacgttacgtaccgaacgggaccggtaggggtacgggtacggggtacgtaggggtaacggttacgtttagggttttacgggtttcgggtttttaaaccgttaccggtttaccgggtaccctttagggaaccgtttacgggttaagggttttaacccttaccgttaaccgggtttccgggtacccgggttacggggtttaaccccgggttccggggaacccgttaaaacggggggtaaccccggttaaagggggttaaccggtaaaaccgttaacccgggttaaaaaccgggtaccggttttacggggacccgggttacggtaacccggtacccggttaacccgtacggttttaccccgg

SEQ ID NO: 211565 - DNA, 698 bp, Homo sapiens
  misc_feature: GYAE6OF02GYJZL.26.26.C04.1.454.CMB.1.raw
  modified_base (160)..(160): a, c, t, g, unknown or other
  misc_feature (160)..(160): n is a, c, g, or t
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (467)..(467): a, c, t, g, unknown or other
  misc_feature (467)..(467): n is a, c, g, or t
  modified_base (480)..(480): a, c, t, g, unknown or other
  misc_feature (480)..(480): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctcgtgggtcccagggtccagtggggatgttgngatgactcagttctccgctctccctcgcccgtctacccgttggacaggccggtcctcattctcctgcgagtctagtcagcgcctacgtacanagtgtagtcggaacncctcctaggaatcggtatcgagacgtaggacgccgacgaccctaacccgtccggacggcgtaccttaaagtttactaaagttaacgtttactaaacggttaccgggttaccgttacccgggggtacccctaggaaccgtaggtacgttacgacggtcggacgtagggtcggtacgacgggactacgtcgttacgtttacnccggtacaggtanatacgagacggaggggtagggagtccgtgggtaacgggttgttcggttaggttacgttttacgtacgtcgccgttagaccgtaggtaaccttggtaccacgggttcggtccggttaacggccgggtaccggtaccggaaagggtacccggtaaagggttaaccgaacgtaaccgtaaacgaacgttcggaggtacgacggaccttacgtcgttaccgg

SEQ ID NO: 211566 - DNA, 670 bp, Homo sapiens
  misc_feature: GYAE6OF02GD703.26.26.C04.1.454.CMB.1.raw
tcagagactatactcacgaccggtgctcgatttagtctagcgactttgggtttggggtgatcaggactcctcagttcaccttctcacaatgaggctccctgctcagctcctggggctgctaatgctctgggtcccagggtccaggtggggatgttgtgatgactcagtcctccgctctccctcgcccgtcacccttggacaggcgcctccatcctcctgcaggtctagtcagacgcctcgacacgagtgagtacgggaaccacccgtcttagaactggtactcgagcaggacgaccgacgaacccgaaccgtccggaggcctaccttaaattataagtactttactaaggtcggtacgttcccgggaccagactagattcgaggtccgacgtaggtggacgagtactacgtgtacgtttccgacgtcgtaggaatactcgaggtcggagggtcggacgggtcaggtaggtaggttggttaggttacggttttacgtcgtcggtaccgtagtcgtaaggtacgtttacgttaccggtacgttcggggtaccggttaccgggtaccgggttacccggaaccgggtacggtaaccggtaagggtaaacggtaaactaaccggaaacggttaagtcggtaggtaccgtacgtaaccaccgttacgtcgttaccg

SEQ ID NO: 211567 - DNA, 765 bp, Homo sapiens
  misc_feature: GYAE6OF02IR3J2.26.26.C04.1.454.CMB.1.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (266)..(266): a, c, t, g, unknown or other
  misc_feature (266)..(266): n is a, c, g, or t
  modified_base (331)..(331): a, c, t, g, unknown or other
  misc_feature (331)..(331): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctcgtcgggtcccagggtccaggtggggatgttgtgatgactcagtctccgctcctccctcgcccgtcacccgttggacaggcgcctccatctcngacagtctagtacagacncctacgacacgagtgagtcgggaacnccgtccttagaactggatcagcaaggcgccgacgacccaaccgtcggaggcctaccttaatttanagtactttctaagtccgggtacgttccgggtacccagtactagtacgttaccgaggaccggtacggtacgggttacggggtacctaacgggacctaccggtttacggtttacttttcccgggaacggttaaccgtaagggtaaaacgtaacgttaccggaacgggtccggggtaagggggtaggggtaacggtaccgggttaaggaacgggttgtttagggtttacgggtttacgggttttttaaactacggtccgttaccgtaggtacgtaaacggtttacgttacgtaccgttacgggtacggggttacccgtacggggtaccgttaccgggacgaacgggggttaaaccgaggggtaaacgtaaaccgaaccgttaaaaccggtaggttccgggttacggtccggtacgtaacccgtacgtacgttacccg

SEQ ID NO: 211568 - DNA, 647 bp, Homo sapiens
  misc_feature: GYAE6OF02GQ031.26.26.C04.1.454.CMB.1.raw
  modified_base (370)..(370): a, c, t, g, unknown or other
  misc_feature (370)..(370): n is a, c, g, or t
tcagagactatactcacgaccggtgctcgatttagtctagcgactttgggtttgggggactgatcaggactcctcagttcaccttctcacaatgaggctccctgctcagctccgtggggctgctaatgctcgtgggtcccagggtacaggtggggatgttgtgatgactcagtctccgctcctccctcgcccgtcacccgttggaccaggccgtcctccatcctccgtgctaggtctagtcaaggctccctagtacacgtagtgacgtacggaacctacccggtcttaaggaaccgttggtaacttcgacgtacgaggaacggccccgagggtaccccaacccgtcgggacgtccgtaacctttaattanaacgttattacgtaagtcggtacgttcccggacagacagtctgagcggatagtggacagctacgtgtacttcgcgtgtagaatctacgaggtacggtagggtagacggtcgtaggaagtagttcggtttacggttacgtttaacgtacgtcgtacgtgaccgtagtacgttactcgtacgtcggtcggtacggtaccggtccggacggaacgggtaaccgaaggtagaaaccgtacggtaaacgtaggtacgtcggacgtacgacgtacctagtccg

SEQ ID NO: 211569 - DNA, 772 bp, Homo sapiens
  misc_feature: GYAE6OF02GPJK4.26.26.C04.1.454.CMB.1.raw
tcagagactatactcacgaccggtgctcgatttagtctagcgactttggggtttgggggagataaaagctcagctctacccttgccttgactgatcaggactcctcacgttcaccttctcacaatgacggcctccctgctcagctccgtggggctgctaatcgctcgtcggggtacccagggtccgaggtggggattggttgtacgtagtcgactcgtacgtcctccgctcctcctcggcccgtccaccgttggacgacgggccgcctccagtccgtctgacgtacgtacgtacgtacgacgacgtccgtacgtacacagtacgaggtacggaaccaccgtaccgtacgtacgtacgtacgtacgacgacgacggacggaccgaccggtaccgtaacccgtaccggtacggaccgttttttttttttaaccgaaacgtttaaacgttaacgttaacgtttaacgttaacggttaccgggtaaccgggttaccgggtaaccgtaacgtaacgtaacgtacgtacgacggacggtacggtacgggtacggtacggacggtacgtacgtacgttacgttacgtaccgtacgtaacgtaacgtacgtacgacgtacggtagggtacggacggtacggtaggtacggttagttcggttacggttacggttacgttacgtcgtaccgtacgtacgtacggtaacgttacgtacgtacggtacggtaccggtacggttaccggtaccgggtaaccggaacgggtacggtaaggtaacgg

SEQ ID NO: 211570 - DNA, 730 bp, Homo sapiens
  misc_feature: GYAE6OF02GU3YN.26.26.C04.1.454.CMB.1.raw
  modified_base (269)..(269): a, c, t, g, unknown or other
  misc_feature (269)..(269): n is a, c, g, or t
tcagagactatactcacgaccggtgctcgatttagtctagcgactttgggtttgggggactgatcaggactcctcagttcaccttctcacaatgaggctccctgctcagctcctgggctgctaatgctctgggtcccagggtccagtggggatgttgtgatgactcagtcctccgctcctcccgtgcccgtctacccgtggacgaggccgcctccatcctcctgcaggtctagtcagcgcctacgtacacgtagtgacgtacggaaccnccgtccttagaactggacttcagcgagacgccacggacccaaccgtccggacggccgtaaccttaatttaagtaagttatttaccgtaaggttccgggtacgtttccccgggaccaacggtacgtacgtacgttacacgggcggtacggaggttcgggtacacggctacgtgtactttacgacgtcgtaacggaatacgtacgaggaccggtagggtagggaggtctagggtaggttagtttgggttacgttacggtttattaccgggtcgtccggtagtaccggttaaggtacgtttacgttaccggtaccggttcgggtccgggttacgggtaccgggttacccggaccgggtaaacgggtacccggtaaaggggtaaacggttaaaccgtaaccggaaaaccggttacgttacgggtacgggtaccgttacggaacccgtaccccgttagttaccccg

SEQ ID NO: 211571 - DNA, 907 bp, Homo sapiens
  misc_feature: GYAE6OF02IY1I3.26.26.C04.1.454.CMB.1.raw
  modified_base (711)..(711): a, c, t, g, unknown or other
  misc_feature (711)..(711): n is a, c, g, or t
  modified_base (881)..(881): a, c, t, g, unknown or other
  misc_feature (881)..(881): n is a, c, g, or t
tcagagactatactcacgaccggtgctcgatttagtctagcgactttgggtttgggggactgatcaggactcctcagttcaccttctcacaatgagctccctgctcagctcctggggctgctaatgctcgtcgggtcccgagggttccgaggtggggtattggttggtgactggacttacacgttcctccgctcctaccctcgcccgtaccacccgttagacgacggccggtcctcctactccgtctgacgtaggttactagtacgagtaccgtccttacgacacgagtgaacggtcggaaccctaccggtccgttaggaacgttcggtaacttacgacggacgtaaccgggtaccggacccggaaccggtacccccgtaacccggtacccggggaccggtaaccgttaaccttttaaaacgttttaaacgtaacgtttaaccttttaacgggtttaaaccggttacccgggggtttaccggttaaccccgggggtaccctaaagggtaaccgtacggtaaacgtttaccggacggtccgggtacggttaggggttaccggtaacgacggttaccgtaacgtttccgtttacgtttaccgaccgttacggaacgtaacgtacgtacggacgggtaacgggtaggggtaaggtaccggtaggtacggtagggttagtttacgggtttacggttaaccgttttacggttaccncgggttacgttacggaaggttacgttaacgtttacgtacgtaccgggttaggttaccggggtaaaccggttcgggttaacccgggtaaccggaacggggttaacccggtaaagggttaaacccggtaaaacgtaccggttaaaacgggttcgacgggttccgggtaaccnccgggaaactaccgttaccgttcccg

SEQ ID NO: 211572 - DNA, 1062 bp, Homo sapiens
  misc_feature: GYAE6OF02JI43I.26.26.C04.1.454.CMB.1.raw
tcagagactatactcacgaccggtgctcgatttagtctagcgactttgggtttgggggaggaactgctcagttaggacccagagggaaccatggaagccccagctcagcttctcttcctcctgctactctggctcccagtattccaccggagacatttgttttgaacacagtctccagcctaccctgtctttgcctaccgaggggaaagcgcccacctcctcctgcgacgggccagtcgagtggttcgttggacagtccttaacgttacggtcccgttaggtaacccaactaacggaaacccgttcgggacccgacgggtcctacccggtacggacccttccgtaccacgttacgttaactacggtataccggtactaccgtaacccgtaaccggacgggtaccctaaccggttccgggaacctactaccccgaacggtaccggttaacggttacgtacggtaccggggactaacgggttacggtaagggttaccggtacgggtactaaccggtacctttaccggtaccctttaccgtaacccgtaaacccgtaccgtaccggtaacgtacccgtaaccggtaccggttaaacgggtacccggtaacccgttaacggttaaacggttttaaccggttttacccgtaaacccgtttttaaccggttttttaaacccgttaaccgggtttacccgggtttaaacccggtaaccggttacccgttaaacgggttaaccccgggtttaaaccggttaaccccggggttaaaccgtttacccgggttaacccccgttttcccgtttttaaaccccgggttaccgggggtttttaacccgggggggacccccggggtttaaaacccgggggttaacccggggtttaaccgggggggttaacccggggtaaaccggtttaccgggtaaacccgggttttaacccggggtaaaacccggggttaaaccggtttcgggggggtttaaacccgacccgggttttacccgggaccccggtttaaaacccggtttaccgggttttaaccccgggttccgggtttttaaccccgg

SEQ ID NO: 211573 - DNA, 718 bp, Homo sapiens
  misc_feature: GYAE6OF02IZVV1.26.26.C04.1.454.CMB.1.raw
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
  modified_base (535)..(535): a, c, t, g, unknown or other
  misc_feature (535)..(535): n is a, c, g, or t
tcagagactatactcacgaccggtgctcgatttagtctagcgactttgggtttgggggactgatcaggactcctcagttcaccttctcacaatgaggctccctgctcagctccgtgggctgctatgctctgggtcccagggtccaggtggggatggttgtgatcgactcagtcctccgctcctcccgtcgcccgtctacccgttggacncggccgcctaccnctcctcctggctacggtctacggtctacggacgtccctacgtaccgacgtaggtacggtaacggtcggaaacctcccgtccgttaaggaaccgtggtaacttcgacgacgtaaggacggccgaaccgaccgaaccgtccggaggaccctacgttaaacgtttaactaacggtaactttaccgtaacggtcgggtaccggtttcccggggtaccaacgtacgaacgttacttacgacgggtacggtcgggtaaggttccgggtacaacgggtactacgtacggtttctaacccgcggttacgaacggtaaacgngtaccgaggcggtaggggcggtaagcgtaggaggtcggtttagtggttaccgtttgtacgtggcctagtacgtagtagttaccgtcgtacgtcgggtacctgggtcgtacccggacgtaagggccgtaaagggagtaacgtaaacgaacggtagtcgtaacggtctaccggaactcctagtcg

SEQ ID NO: 211574 - DNA, 810 bp, Homo sapiens
  misc_feature: GYAE6OF02FIINY.26.26.C04.1.454.CMB.1.raw
  modified_base (239)..(239): a, c, t, g, unknown or other
  misc_feature (239)..(239): n is a, c, g, or t
  modified_base (242)..(242): a, c, t, g, unknown or other
  misc_feature (242)..(242): n is a, c, g, or t
  modified_base (299)..(299): a, c, t, g, unknown or other
  misc_feature (299)..(299): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtgggatgttgtgatgactcagtctccgctctccctgcccgtcaccttggacaggcgcctcatctcctgcaggtctagcagagcctgacacngtnatggaacaccgccttagaactggacttcgagcgaggacggaccacggccctaaaccnccggacggaccgtaccttaaagtttaacgtaaagtacttttacgtaaaaggttccgggtaacgtttacccggggtacctacggaacgtaagtactttaccgaggtaccgggtaccgtaaggttcggggtacgacggactaacgttacggtaactttccgaaccgtcgttaacggaaacttaacgtactaaacggcggtaacgggggtagggtaacggtaccgtagggaacgggttagtttagggttttacgggttaaccgggttttttaagtttaaccgtttccgggtaccgtttacggacgttaaacggtacgtttaaacgtttaccgttaaaccggttccgggtacccggtttacggggtacccggttttacccgggaaccggttaaaccggggtaaaccgggtaaacggggttaaacgggtaaaacgttaacccggtaaaaaccgggtaaccgttaggggtttaaccgggtaccgtaaccggtaacccgtaacccgttacgttacccg

SEQ ID NO: 211575 - DNA, 830 bp, Homo sapiens
  misc_feature: GYAE6OF02HDWBU.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccgttggacaggcggcctccatctcctgcaggtctagtcagacgccctcgtacacagtgagtcggaacaccgcttagaactggacttcgagcagacggccgaaggaccgaacctccggacggcgaccgttaaatttaagtaaagtacttttacgtaagtcgggtacgtttcccgggggtaccctaaggaaccgtagtaacgtttaccgaacgggccgggtacgtaacggggtttacggggtaccaaggggtacctaaccgttacgtaacgtttttccgaaccggtcttaaggaaacggtacgttacgaaacggtaccggtaagggggtacgggaacggttaccgtaagggtaacggttaacgggtttcgggttttagggtttaacccggttttaagtttaccgttacggttacccgttcggtaacgtacgggttaaacgtttaacgtttaccggaacgggtttccggggtacccgggtttaaccggggtaacccggtttccggggtaacccggtaaaacggggtaacccggttaaaggggtaaacgggtaaaaccgttaacccggtaaaaaccggtacggtttaaccgggttacgggtaccgttaccgggaacccttaacccggttacgttacccggg

SEQ ID NO: 211576 - DNA, 632 bp, Homo sapiens
  misc_feature: GYAE6OF02HOLOJ.26.26.C04.1.454.CMB.1.raw
  modified_base (197)..(197): a, c, t, g, unknown or other
  misc_feature (197)..(197): n is a, c, g, or t
  modified_base (348)..(348): a, c, t, g, unknown or other
  misc_feature (348)..(348): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctgggctgctaatgctctgggtcccagggtccagtggggatgttgtgatgacctnagtctccgcttctccctgcccgtcacccttggacaggcggcctcatctcctgcaggtctagtcagagcctcgtacacagtgatgggaacaccgccgttgaacctggattcagcgagacggccaggacccaactccggagcgacctaattanaagtactttactaagtcggacttccggggtccaggacagtattcaggtcggacgtaggtgggtacacgggcagtcgtatttacgaacgtccgtaggaaacgattacgaggccgtaaggggtcggaacggtacgtggaagggtacttgggtttacgtacgggtttttaactacgttacgccgttgaaccgtaggtaacggttacgtttaccgaacgttcgggtaccggttacgggtacccggttaaccgggacccgtaaacgggggacccgtaagggtaaacggg

SEQ ID NO: 211577 - DNA, 723 bp, Homo sapiens
  misc_feature: GYAE6OF02F1CZ5.26.26.C04.1.454.CMB.1.raw
tcagagactatactccacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccaggtggggatgttgtgatgactcagtctccgctctcctcgcccgtcacccttggacaggcgcctccatcctcctgctaggtctagtcagacgcctcgtacacagtgagtacgggaaccacccgtcttagaacgtggacttcgacgtcaggacggccgacggcccaaccgtccggacgggtccgtaccttaaattttaacgtaagtacttttactaacgtcggggtacgttcccgggggtacccaaggacctaagtacgttcgacggcggtacgtagggtcgggtcgaggacctacgttcgtacgtttaccgaccgtcgttaacggaagtacgtacgacggtccggtagggggtacgggagggtaccgtagggtaggttaggtttacgggtttcggttacggtttttaacgttaccgttccggtaccgttcggtacgtaacggttaacggttaaccgtttaccgtaccggttcgggtacccgggttacgggttaccgggttacccgggttaacccggaaacggggtaaccggtaagggttaaaccggg

SEQ ID NO: 211578 - DNA, 874 bp, Homo sapiens
  misc_feature: GYAE6OF02H3IS6.26.26.C04.1.454.CMB.1.raw
  modified_base (151)..(151): a, c, t, g, unknown or other
  misc_feature (151)..(151): n is a, c, g, or t
  modified_base (211)..(211): a, c, t, g, unknown or other
  misc_feature (211)..(211): n is a, c, g, or t
  modified_base (434)..(434): a, c, t, g, unknown or other
  misc_feature (434)..(434): n is a, c, g, or t
tcagagactatactcacgaccggtgctcgatttagtctagcgactttgggtttgggggaggaactgctcagttaggacccagagggaaccatggaagccccagctcagcttctcttcctcctgctactctggctcccagattccaccgganacatttgttttgacactagtcctccagcccaccctgttctttgtcctaccgaaggggaanacgccctaccctctccgtgaccgagggccagtcaggtagtggttggcagtctacttagccttaggtaaccaaacgaacgtaaaccgtcggcccgaacggtcctaccccgaacggtcccttacctactaaccttcgttaacgtagacgtcgacctaacctacccgaaaggaccggggaccctaacgtcggaccacctaccccgacggtaccgtacggttaccgnggtacgcgtacggttggtacggttaccggcggggtaacaacggttaaccttcctaaccgtttaccctaaccgtaaaccctacgtttaaccgaccggtacctaaccggtaccctaaacgggtacccgtacccggtttaaacggttaaggttttaaacgtttaccgttaaccgtttttaaaccgtttttaagtttaacccggtttacttaaaccggtaccggtaaacgttaacgggaacccgtttaacggaacccgttaaccggttaccggttaacccggtttccttaacccgggtttaaccgggttccggggtaaacccggggttaacggggaaccgggttacggggtcgggtaaacgtcggttaaccgaccgggttaagttaaccgtacgggtacggttccgtaccgtaccggtaacctacgttccggttagttaacccg

SEQ ID NO: 211579 - DNA, 726 bp, Homo sapiens
  misc_feature: GYAE6OF02F59Z3.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctctccctgcccgtctacccgttggacaggccggcctccattcctcctgcgaggttctagtcaggacgcccttacgtaacaacgtagtggagtacggggaaaccacccgtccttagaacctgggtaacttcgaagcgaaggacggccgaacggccccaaccgtccggaacgggcctacccgttaaatttagaaacgttacgttttaactaaacgttcggggtacgttcccggggtaaccaacgtaactaagtattacgacggcggtacgaagggttcggtacgacggactacgtagtactttacgacgtctaagaagtactagacgacggtagggaggacggtacgtaggaggttagttgggttacgtcggttttaagttacgtcgtacgtgacgttagtaagttacgttacgtacgttcggtaccggtaggttaaccgggttccggaccggtaacgggaaccggtaaaggggttaacgggtaaaaacgtaccggtaaaacgtacggttaacggtcggtaccgtaccgggtaccctacggtacgttccgg

SEQ ID NO: 211580 - DNA, 759 bp, Homo sapiens
  misc_feature: GYAE6OF02JM8KE.26.26.C04.1.454.CMB.1.raw
  modified_base (217)..(217): a, c, t, g, unknown or other
  misc_feature (217)..(217): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctgggctgctaatgctcgtggtcccagggtccagtggggatgtgtgatgactcagtctcgctctccctgaccctnacccttggacagggccgcctccatcctccacgtcaggtctagtcgacgtacgccttacggtacacgtagtaggacttacgggaaccaccggtccttacgaacttggacttacgacgtacgaacgtacgggaccgacgggacccaaccgtccggaccggtccgtaaccgttaaagtttacgtaagtaacgttttactaacggttccgggtaacgtttacccgggggtcctaacggaacgtaacgtactttacggacggtaccggtacgacggttaccgggtacggtacggtacgtacgtaggttaaccgtttccgaacgttcgtaacggtaataacgtaccgtaacgggtccgtaagggggtacggaccggttaggacggttaacgtacggtttacggttacgggttaccgtttaaacggttccgttacggaccgttacgtacgtacggttaaacggtttacgtacgttaccggtaaccgggttcggtaacggttacccgggtaaccggtaccgaacggggttaccgtagggttaaaacccgg

SEQ ID NO: 211581 - DNA, 647 bp, Homo sapiens
  misc_feature: GYAE6OF02JA3A3.26.26.C04.1.454.CMB.1.raw
  modified_base (494)..(494): a, c, t, g, unknown or other
  misc_feature (494)..(494): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccaggtggggatgttgtgatgactcagttctccgctctccctgcccgtcaccttggacaggccggcctccatcctcctgcgaggtctagtcagacgcctacgtacacgacgtagagtacgggaacacccgtccttaggaaccgtggacttcgagcgaacggacggcccgaggacccaacccgtccgaacggccgtaccttaaatttacgtaaacgtatttacgtaagttcgggtacgttccggggtaccacgtacacgtattacgaggcgacgtaggtcgggtacgacggactacgtagtacttaccgacgtctaggtaanactcgaagcggaggggtcgggacggtcgtaggaggtagttagtttggttacgtttacgttacgtcgtccgtacgacgtaggtagttacttacggtaccgtcggttccggtacggttccggtacggacggtaacgggtaccggtaaggtaacgg

SEQ ID NO: 211582 - DNA, 839 bp, Homo sapiens
  misc_feature: GYAE6OF02IZBZ6.26.26.C04.1.454.CMB.1.raw
  modified_base (473)..(473): a, c, t, g, unknown or other
  misc_feature (473)..(473): n is a, c, g, or t
  modified_base (762)..(762): a, c, t, g, unknown or other
  misc_feature (762)..(762): n is a, c, g, or t
tcagagactatactcacgaccggtgctcgatttagtctagcgactttgggtttggggggagataaaagctcagctctacccttgccttgactgatcaggactcctcagttcaccttctcacaatgaggctccctgctcagctccgtggggctgctaatgctcgtgggtcccgagggtccaggtggggattgttgtgatgctctagtcctccgctctcccgtcgtacccgtcctaccgttacgaccgacgggccggtccctcctactcctccgtgccgtacgggtcttaaggtaccgacggtacgccccgttaggtaaccaacgtaggtggaacggtacggaaccacccggtcgttagggaacgttacgggtactttacgaacggacgtacggaaccgggcccgtaaccggacccctaacccggtacccggtacgggaccccgttaacgttttaaaattaacgttaaaacgttnttttaaacccttaaaggtacgggggtttacccgtttaccccgggggtacccaaacggtacgaacgttaacgtttacgaacgggtaccgggtaccggttagggtaccgggggtaccgtaacggcgttaccgttaacgggttactttaccgaaccggtaccggtaagtaaacgtacgtagtaccgggacggtaacgggggttacgggtgggtaagttcgggaaaggttcggtttacgggttcgggtttaaccggtttagttacggttacgacggttcggtactaacgggtntttaaccggttcgacggttcggtacgggttaccggtacggtccggaaccgggtaacgggtaacggacgggttaaccg

SEQ ID NO: 211583 - DNA, 678 bp, Homo sapiens
  misc_feature: GYAE6OF02GWW7F.26.26.C04.1.454.CMB.1.raw
  modified_base (201)..(201): a, c, t, g, unknown or other
  misc_feature (201)..(201): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccagtggggatgttgtgatgactcagtctccgctctccctgcccgtcacccttggacnggcggcctccatctcctgcaggtctagtcagcgccttcgtacacgtagtgagtacgggaaccacccggtccttagaacgtgggaacttcgagtacaggaggacccaagacccaacccgtccggaggccgtaccttaaatttataagtacttttactaagtccgggtacgtttcccggggtcccaggacctaagtactttacgacggtaccggtacgtaaggttcggggtacaacggggtcacgttagtacgtttcacgtctagaagctcgagtcgagggtggagcgtaggaggtattggttagtcgtttaattacgtcgtcgttaggacgtaacggtattacgttcgaaccggttcgggtaccggtgggttaacccggtccggtaccggaacgggtaaccggaagggttaacggtaaacgtaaccgaaaccggtaagtacggtcggtaccgtaggacccgtacgttacgttacccgg

SEQ ID NO: 211584 - DNA, 804 bp, Homo sapiens
  misc_feature: GYAE6OF02HN2QJ.26.26.C04.1.454.CMB.1.raw
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
tcagagactatactcacgaccggtgctcgatttagtctagcgactttgggtttggggtgatcaggactcctcagttcaccttctcacaatgaggctccctgctcagctcctggggctgctaatgctcgtgggtcccagggtccaggtggggatgttgtgatgactcagtctccgctcctcccgtcgcccgtcaccgttggacaggccgtcctccacttcctaccgngcaggttcctagtcagacgtcctacgtacactagtcgagtacggaacctaccgtaccttagacgtgacttacacganacggacgaccgaccgtacccaaccgtcgacggccgtaacttaacgtttaataacggttacttttacgtaacggttaccgggtaccggttcccggggtaccagacgtaacgtacttcgacggtcggacgtgggtcggaccgtacgcttacgtagttaccttacgaaccggtcgaggtaagtctaacggagtacggaggggtcgggacggtcgtagggacgggttagttgggtttaacggtttcggtttttagtaaccgtttcgtaccggtacgtaacggttaaggtttaaccgttaccgtttaccggtaaccgggttcgggtaacccgggttacgggttacccggttaacccggggtaacccggtaaacgggggttacccgttaaagggggtaaaccggttaaaccgttaaaacgggtaaacccggttaacggggtcggttaacccggttaccggttaaccgaccccggtaaacgtttacccggtttacccggttttaccgg

SEQ ID NO: 211585 - DNA, 661 bp, Homo sapiens
  misc_feature: GYAE6OF02JYHA7.26.26.C04.1.454.CMB.1.raw
  modified_base (202)..(202): a, c, t, g, unknown or other
  misc_feature (202)..(202): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctctccctgcccgtcacccttggacnggcgcctccatcctctgctaggtctacgtcacgacgtcctacgtacactagtcgagtacggaaccaccgtccttagaacgtggtacttacacgacgaggacggaccgacgggacccaaccgtccggacgtccgtaccttaatttactaagtactttacgtaagttccgggacgttaccgggtaccaacggactaggtacgttcgacggcggtacgtacgggtggtacgtaacgcgtactggtacttcgacgtacgtaagacgtactacgaggcggtagggtaggacggtgtaggtagtacgttcgttaggtaccgtttagtctcggtacgtgtacgagttacgttcgtcgttacggtcggtacggtcgggtaccgtacggaccgtaacgggtaccgtaagggtaagtaaccggtacgaaccgttaaggtacgtacggtcgtacacgtaccgtgttaccg

SEQ ID NO: 211586 - DNA, 693 bp, Homo sapiens
  misc_feature: GYAE6OF02JZWG1.26.26.C04.1.454.CMB.1.raw
  modified_base (108)..(108): a, c, t, g, unknown or other
  misc_feature (108)..(108): n is a, c, g, or t
  modified_base (290)..(290): a, c, t, g, unknown or other
  misc_feature (290)..(290): n is a, c, g, or t
  modified_base (437)..(437): a, c, t, g, unknown or other
  misc_feature (437)..(437): n is a, c, g, or t
  modified_base (649)..(649): a, c, t, g, unknown or other
  misc_feature (649)..(649): n is a, c, g, or t
  modified_base (672)..(672): a, c, t, g, unknown or other
  misc_feature (672)..(672): n is a, c, g, or t
tcagagactatactcacgaccggtgctcgatttagtctagcgactttgggtttgggggactgatcaggactcctcagttcaccttctcacaatgaggctccctgctcngctcgtgggctgctaatgctctacgggtcccagggtacaggtgggatgttagtgatgactcgagtctccgctactccctgacccgtctaccgttggacacgggcgtaccctccacgttcctcctggcctaggttcctagtcaggacgtccttacggtacacgaggttagacgtacggaaccnccgtcgttagactcggtattcgagcgaggacgtccacggtccaaccgttcggacgtccgtacgttaactttaagtaacgttctttacgacggtaccggtacggttccgggaccagtacaactcgttagcgacggagtagtcgggtancgtacacgttaggtaactttccgacgtacgtaacgtaacgtacgttaccggacggacgggtacggggtaggtacggtacggagggtaagttacggttcgttacgttacggttttaacgtcggtacggtccgtaggtactacgtttaaggtactcgttacggtcggtacggttcggtacgttacggacgtaacgggtacgaaggttaccgaanaaccggtaacgcgttaggtacgnttaccggcttacgtacgtacg

SEQ ID NO: 211587 - DNA, 818 bp, Homo sapiens
  misc_feature: GYAE6OF02HTJPR.26.26.C04.1.454.CMB.1.raw
tcagagactatactcacgaccggtgctcgatttagtctagcgactttgggtttggggtgatcaggactcctcagttcaccttctcacaatgaggctccctgctcagctcctgggctgctaatgctctgggtcccaggtccagtggggatgttgtgatgactcagttctccgctcctccctcgtcccgtctaccgttggaccgaggccgccctccacttcttccgtgcaggttcctagtccgaagacgccgtacgtacacgtaggtgagtagggaaaccaccgtccgttagtacgtaggtacttcgagtacaggacggtccgacggacccctaaccgtaccggacgggccgttaacccgtttaaattttaacgttaaacgtttacgttttaccgtaacggttaccgggttaccggtttaccccgggggttacccaaacggtaaccgtaaaggtacctttacgacgggaaccgggtcgtagggtacgggtaccgtaacgggtccctacgttacgttactttaccgacgttacgtagaagtacgtacgaggacggtaggggtaggacggtacgtagggtagtaggttaggtttacgtttacgggttttacttaccgtgttaccggttcgtacgtaacgttagttacgttacgtacggttcgggttaaccggttccgggtaccgggtttaaccgggaccgggtaacggggtaaaccggtagggtttaaccggtaaaaaccggttacggtaaaaccggtaaccgttacggggttacggaccggtttacggaacccgtaccgttaacggttccgtttaaccggg

SEQ ID NO: 211588 - DNA, 1037 bp, Homo sapiens
  misc_feature: GYAE6OF02I6DX1.26.26.C04.1.454.CMB.1.raw
tcagagactatactcacgaccggtgctcgatttagtctagcgacttttgggtttggggtgatcaggactcctcagttcaccttctcacaatgaggctccctgctcagctccgtgggctgctaatgctcgtcggtcccaggtccaggtgggatgttgtgatgactcagtctccgctcctcccgtcgcccgtcctaccgttggacgagggcccggtcccttacctattcccgtcgtcggtcgtaggttacttacggtcaacggacgtcccgtacgtaacacgtaggtacggacggtacgggaacccgtacccgtaccgttacgaacgttaggtcttaccgagacgtaaggaccggccgtaaccgggaacccaaacccggtccggaacgggtacccgtaacccgttaaagttttttaaacgtaacgttaacgtttttaccgtaaaacgggttccgggggtttaaccggtttacccccgggggtaaccctaaacgtaaccgttaaaggtaaacccgtttcgaaaccgggggttcgggaaccgttaacggggttacggggtaccggtaaacgggtacccttttaaacggttacgttttaaccgttttccgggaaaccgtttaccggtttaacggtaaaaccggttacggtaacccgttaaacgggggcccgggttaaaaggggggttaagggggtaaaccgggtccgtttaaacgggggggtaacggtttaagggttttaccgggtttaacggggtttttttaaacccgggtttttaaaacccgtttaacgggttcccgggtttaccgttacgggtaccgggttaaacgtttaacgggttttaaccttccggttaaccggggttacccggggttaccggtttaccgggtaccggttttaacccgggaacgggtttaaaccgggtaacccgggttaaagggttaaaacccggggtaaacgtaaacccggtaaacggttaacgggttaacggtccgggttaacgttaaccggaccgtttaacccggtacgtgttttaaacccgg

SEQ ID NO: 211589 - DNA, 689 bp, Homo sapiens
  misc_feature: GYAE6OF02FNEZ5.26.26.C04.1.454.CMB.1.raw
  modified_base (471)..(471): a, c, t, g, unknown or other
  misc_feature (471)..(471): n is a, c, g, or t
  modified_base (485)..(485): a, c, t, g, unknown or other
  misc_feature (485)..(485): n is a, c, g, or t
tcagagactatactcacgaccggtgctcgatttagtctagcgacttttggggtttgggggactgatcaggactcctcagttcaccttctcacaatgaggcctccctgctcagctcctggggctgctaatgctctgggtcccagggtccaggtggggattgttgtgatgactcagtctcccgctcctccccgtcgccccgtctacccgttggacacgggccggcctccatcctcctgcacggttctagtcagcgtccctcgtaccacaggtgagtacgggaacccaccgtccttaggaacgtggtacttcgagaccgaggacggcccgacggcccaaccgtccggacggcctaccttaatttaataagtatttactaacgtcgggtaccggtttcccgggtaccagactatagttacgagcggcgtaggtgggtcgaggcacgttgtactttccagcgtagagagtcgaggngaggggtgggcggngtaggaggtagtttcggttgggttacgtttagttccgtcgtccgttgacgttaagtagttaccttcgtaccgtcgggtcggtacgggtccgggttaccggaccgggtacgggaaaccgggtaaacggggtaacggtaaaccggtaaaccgtaaaaccgggtacgttacgggttcggacggttccggaccgtaccgtagttaccg

SEQ ID NO: 211590 - DNA, 805 bp, Homo sapiens
  misc_feature: GYAE6OF02IK6BS.26.26.C04.1.454.CMB.1.raw
tcagagactatactcacgaccggtgctcgatttagtctagcgactttgggtttgggggtgatcaggactcctcagttcaccttctcacaatgaggctccctgctcagctcctggggctgctaatgctctgggtcccagggtccaggtggggatgttgtgatgactcagtctccgctctccctgcccgtcacccttggacaggccggtcctccacttcctcctgcgtaggtctagtcaagacgtccctacgtaaccacgaggtcggaagttcgggggaaaacctaacccgtccgtttaaggaaacgttacgggtactttacgaacgcgaacgggtacggaccccgaacgggacccctaaaacccccggttccgggaacgggggacccgtaaccccggttttaaaattttaaacgtttaaaaggttaaacgttttttacctaaaaacggtttaccggggtaacggtttccccggggggttaccccaaggtaacgaagtacgttacaacgggtccggacgtaggttcggggtacaggtaccgaaccgttagtacctttacgacggtactaacggtaagtaactacgacggtacggtacggggtagggaacggtcgtaacgggagggtaagttggttttacggttacgttttaacgtttaccgtacgtccgtgacggtaagacgttattcgtacgtacgtcgggtacggtaccggttaccgtacgggaacggaaccggtaacgggtaaggtaaaccgtacgtaaaacgtacgaaggttcggacgtacgaccgaacctacgtgtttaccg

SEQ ID NO: 211591 - DNA, 795 bp, Homo sapiens
  misc_feature: GYAE6OF02I3FSC.26.26.C04.1.454.CMB.1.raw
tcagagactatactcacgaccggtgctcgatttagtctagcgactttgggtttgggggactgatcaggactcctcagtttcaccttctcacaatgaggctccctgctcagcctccgtggggctgctaatgctcgtgggtcccagggtccaggtggggatgttgtgatgactcgagtctcccgctcctcccctcgcccgtcacccgttggacacggccgcctcactctccgtgaccgaggtctagtcagacgtcctcgtacacgagtgagtacggaaccaccgtaccgttagaacgttggtaacttcgagacgacggacggccgacggacccctaaccggtcccggaggacccgtaacctttaagtttaacgtaaacgtttaacgttttaacggttaaacggtccggggttaccggtttacccggggtaccgaacggacgtaacgtacgttcgacggccggtacgagggttcgggaccgtacggcctacgttacgttacgtttaccgaacggtcgtaaggaacgtacgtacggtacggaccggggaggggtacggtaacggtcggtagggtaagggttaggtttcggtttacgggttacgtttacgtttacgtcgtacgttcggagttaacggtactttcgttaaccgttccggttcgggtaccggtttacgggtaaccgggttcccgggtaacggtaaaccggggtacccggtaaagggtaaaccggtaaacttaaccggtaaacgtaacgttcgggtaccggtacgaccggtaaccgtaccgttaccgttccgg

SEQ ID NO: 211592 - DNA, 619 bp, Homo sapiens
  misc_feature: GYAE6OF02G9F5Q.26.26.C04.1.454.CMB.1.raw
  modified_base (174)..(174): a, c, t, g, unknown or other
  misc_feature (174)..(174): n is a, c, g, or t
  modified_base (328)..(328): a, c, t, g, unknown or other
  misc_feature (328)..(328): n is a, c, g, or t
  modified_base (332)..(332): a, c, t, g, unknown or other
  misc_feature (332)..(332): n is a, c, g, or t
  modified_base (357)..(357): a, c, t, g, unknown or other
  misc_feature (357)..(357): n is a, c, g, or t
  modified_base (376)..(376): a, c, t, g, unknown or other
  misc_feature (376)..(376): n is a, c, g, or t
  modified_base (435)..(435): a, c, t, g, unknown or other
  misc_feature (435)..(435): n is a, c, g, or t
tcagagactatactcacgaccggtgctcgatttagtctagcgactttgggtttgggggatataaaagctcagctctacccttgccttgactgatcaggactcctcagttcaccttctcacaatgaggctccctgctcagctcctgggctggctaatgctctcggtccaggtccnggtgggattgttgtgatcgactcgtactctccgctcctccctcgtcccgtcacccgttgggactacggccggtcctcctatctcctgccgaggtctagtcagacgcctcgtacacgtagtgagtggaacctaccgtccgttagtacgtacggtntcgngcggtagacgtcacgccaccgccgngcctacttaagttacagtnttacgtagtcggtacgttcggtaccagactagtactcgacgtcgtcgtaggtgggtacncgtacgacgtacggttacttcgacgacgttagaacgtcgtacggatcgggacggtggacggtcgtgaacgtaggttcgttaacgttcgggtttactgtcgtcctagcggtaatcggttaccttacgtaccgtcgggttacgtacggtaccggtaccgaccgggtaagtacccggtaggtaacgg

SEQ ID NO: 211593 - DNA, 762 bp, Homo sapiens
  misc_feature: GYAE6OF02GAA5M.26.26.C04.1.454.CMB.1.raw
  modified_base (184)..(184): a, c, t, g, unknown or other
  misc_feature (184)..(184): n is a, c, g, or t
tcagagactatactcacgaccggtgctcgatttagtctagcgactttgggtttggggtgatcaggactcctcagttcaccttctcacaatgaggctccctgctcagctcctgggctgctaatgctctgggtcccagggtccagtgggatgttgtgatgactcagtctcgctctccctgcccgtnacccttggacacggcggcctccatctcctgcaggtcctagctagagcctcgtacacgagtgaagtagggaacaccgtcgttagaacgtggtacttgacgcaaggacggaccgacggaccaacccgtaccggacggtaccggtaccctaaatttaagtaaacgtaatttacgtaacgtagggtacgttaccgggggtacccagaaccgagtagttacgacgcggactaagggttacggtacagggacaagtcggtaattttcgaacgtcgtacggaagactacgagacgtagggaggacggtacgaggaaggtcgttaggttacggtacgggtttttaacttacggtacgtacccgtagtaaccggtaaggttacggtttaactttaacccggtacgtttacgggggaccccgtttaggggtaacccgggttcccgggtaaacccgtaacgggggaaaccggttaaacgggttaacgggtaaaaccggtaaacccggtaaaaaccgttaacccggtttaacgggttaccgggaaccgttaaccgggacctaaaccgtaaccggttacccgtttaaccgg

SEQ ID NO: 211594 - DNA, 515 bp, Homo sapiens
  misc_feature: GYAE6OF02F2VHL.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctgggctgctaatgctctgggtcccagggtacagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaactccgaggcgcctaatttataagatttctaatcgggattccggggtccagacagattcagcggcagtgggtcaggcactgatttcacgctagaagatcagcagggtggaggctgaggattgttgcggtttattactgtctgcagagttattcacgtggccgtggacgttcggacaagggaccaaggtggaaatcgaaacgtactggtcggctagcaccagttcg

SEQ ID NO: 211595 - DNA, 807 bp, Homo sapiens
  misc_feature: GYAE6OF02GPJN2.26.26.C04.1.454.CMB.1.raw
tcagagactatactcacgaccggtgctcgatttagtctagcgactttgggtttgggggactgatcaggactcctcagttcaccttctcacaatgaggctccctgctcagctccgtggggctgctaatgctcgtcgggtcccagggtccaggtggggtatgttgtgatgactcagtcctccgctccgtccctcgccccgtcacccgttggacgcgggccgcctccgctccgtcctgcgtacggtcttacgtcgaacgtccgtcccgttacgtaaccacgaggtggaagtacgggaacccaccgtccgttagaacgtggtacttcgagcgacggacggacccgaccggaccccgtaacccggtaccggacgggtacccgtaaccgtttaaagttttaaacgtaagtttacgttttaacgtaacgggttccggggttacccgggttaccccggggtacccaaggtaacgtacgtacgttcgaccgggcggtacggtagggtcgggacgtacgccgtacgttgttacctacgacgtacgtaaggacgtacgtacgtacggacgggtaggggtacgggaggtcgggtaagtagggttgtttcgggttacgtttacggtttaacgtcggtcgtccggtaggtcgttaacgttacgttaccttacggtccggttcgggtacgggttaaccggtacccgggttacgacccgggtaacgggtaccgggtaaacgggttaaactaaaccgggtaaccgttaaaaccggttaggttcgggtagttcccgttaccggaaccttaccgttccgttaccgg

SEQ ID NO: 211596 - DNA, 657 bp, Homo sapiens
  misc_feature: GYAE6OF02H4E2X.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctctccctcgcccgtcacccttggacaggcggcctccatcctcctgcaggtctagtcagacgcctcgtacacagtgagtagggacacccgtccttgaactggaacttcagcgagacggaccaacggcccaaccgtccggacggacctaaccttaaatttaataaagtacttttacgtaaacgtcgggtaacgttcccggggtaccagtacgagtacttcgaggcgtacgaggtgggtcaggctacgtagtactttcgacgtactaagaagtacgttagacggtacggaggggttgggacggtacgtaggaggtagtttggttggttacgggttttaatcgttacgcgtgacgtagtacgttcttaccgaggttcggcggttacgggaccgttccggaccgtaacgggaacgtaaggtaacggtaaagtaaccgaaacgtaacggttcggccggtacgttaccgcgtaaccgtagtttacgg

SEQ ID NO: 211597 - DNA, 755 bp, Homo sapiens
  misc_feature: GYAE6OF02JEHT9.26.26.C04.1.454.CMB.1.raw
  modified_base (203)..(203): a, c, t, g, unknown or other
  misc_feature (203)..(203): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctcctccctcgcccgtcaccttggacnggcgcctccatctctgcgagtctagtcagacgcctcgtacacgtagtgagtagggaaccaccgtccttgaacgtggtacttcgagtacgagacggccgacggaccctaaccggtccgaacgggaccgtaccgtttaaacgttttagtaaaacggttaacttttacgttaaacggttcggggtaccggtttaccccgggggtaccccgtaacggtaaccgtaacggtactttaccgaacgggtccgggaacgtaagggttcgggtaccgaacggtctacggtacgtactttaccgacgtcgtagaagtactaccgagacgggagggttagggacggtaccgtggaacggtagtttcgggttagtttaccggtttaagtttccgtcggtcccgtagtaccggtagtaacgttacgtttaccgacggttagggtcccgttacgggtaccggttacggaccgggaacgggtaacggtaacgggttaacggtaaacgtaaccggtaacgtaacggttcggtacggtccgtaaccgtacgtacccttagtttacccgg

SEQ ID NO: 211598 - DNA, 762 bp, Homo sapiens
  misc_feature: GYAE6OF02IDD4Z.26.26.C04.1.454.CMB.1.raw
  modified_base (207)..(207): a, c, t, g, unknown or other
  misc_feature (207)..(207): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatggttgtgatgactcagtctccgctcctccctgccccgtctacccgttggacncgggccgcctccatcctcctgcgtaggtctagtccagacgtccctcgtaaccacgtagtagacgttacgggaaccaccggtccgttaggaacgtggaacttcgaacgcgacggacggaccgaccggaccctacccggtccggaccggtccgtaacgtttaaatttaacgtaaacgttacttttaaccgtaacgttccggggttaccggtttaccccgggggtacccaacggtacctaaaggtactttacggacggtccgggtacgtaagggtccgggttacgaacggtcctaacgttcgtaacgtttccgacgttacgtaggaaacgtacgtacggaacgtacggggtaggggttacgggacggtagtagggtaacggttagtttcggttggttacggttttaacttacgtcgtacgtagtacgtagactttacgtcgtcggttaccggtcggttacgttaccggttccgggacggtaaccggggaacgtaaggggtaacgtaaacgtaacgtaaccggttagtcgggtcggaccggtactccgtacaccgttcg

SEQ ID NO: 211599 - DNA, 731 bp, Homo sapiens
  misc_feature: GYAE6OF02JX3AN.26.26.C04.1.454.CMB.1.raw
  modified_base (210)..(210): a, c, t, g, unknown or other
  misc_feature (210)..(210): n is a, c, g, or t
  modified_base (233)..(233): a, c, t, g, unknown or other
  misc_feature (233)..(233): n is a, c, g, or t
  modified_base (272)..(272): a, c, t, g, unknown or other
  misc_feature (272)..(272): n is a, c, g, or t
tcagagactatactcacgaccggtgctcgatttagtctagcgactttgggtttgggggactgatcaggactcctcagttcaccttctcacaatgaggcctccctgctcagctccgtggggctgctaatgctcgtgggtcccagggtccaggtggggatgttgtgatcgactcagtcctccgctcctccctgccccgtctacccgtggacnggccgcctcatctctgctaggtntagcagacgtccctgtacacgaggtgacgtacggaaccnccggtccttagtaacgtgtacgttcagacgaggacggcccgacgaccgtaaccgtccggacggtccgtacctttaaactttaagtaaagttactttacgtaacggttaccgggtaaccggttcccggggtacccaaggaccgtaagtacttacggaacgtcgggtacgtacggttcggacgtacgtacgtcgttgtacctttacgacgtacgttaagaacgtacgtcgaagggtcggtacgggtagggtcggacgtaggacggttgtttcggttcggttagtttacgttaccgaccggttcgtacgtgtaaggtaacgtttgtacccgtaacggtgggttacccggtacgggttaaccgttccggggaaccggtacgggaacggtaaccgggttaacggaactaacccggtaagtaaccggttggtaacggtctacggaccttaacccgtgttaaccgg

SEQ ID NO: 211600 - DNA, 862 bp, Homo sapiens
  misc_feature: GYAE6OF02IKCKT.26.26.C04.1.454.CMB.1.raw
  modified_base (252)..(252): a, c, t, g, unknown or other
  misc_feature (252)..(252): n is a, c, g, or t
  modified_base (841)..(841): a, c, t, g, unknown or other
  misc_feature (841)..(841): n is a, c, g, or t
  modified_base (852)..(852): a, c, t, g, unknown or other
  misc_feature (852)..(852): n is a, c, g, or t
tcagagactatactcacgaccggtgctcgatttagtctagcgactttgggtttggggtgatcaggactcctcagttcaccttctcacaatgaggctccctgctcagctctggggctgctaatgctgtgggtcccagggtccaggtggggatggttgtgagtgactctacgtcctccgctcctcccgtgcccgtcacccgttggacgacggccggcctaccattcctctgctaggttcctagtacaggtaccnccgtacgtacacgtagttaggacggtaacggaaccgtaccgtaccgttacgtaaacggttggtacttacgacggaccgaaggaccggaccggaccggtaccccgtaacccgtaccgggtacggtacccgttaaccgtttaaacgtttaagtaaacgtttaaccgttttaacgtaaacgggttccggggttaaccggtttccccgggggtaaccctaggtaaaccgtaacgtacgttacccggacgggtaccgggtacggttacgggtacggggtaccgtaacggggtaccgttaaacgttaccggttacgttttacccgaacggttacgtaaggaaacggttaccttaacgggaaccggacgggttacgggggtagggacggttacggagggtagggttaacggtttcgggtttaaccgggttaccggttttaacgttacgttcgggaccgttacgggtaactagggtttaacctcggtttacgaccggggtttccgggaccggggtttaggtacccgggttacgggaccgtaacggggtacgtaacgggtaaacgtaacgtacgtaaacgtacggtaggcggttaccncgacctaacgngttacttccg

SEQ ID NO: 211601 - DNA, 842 bp, Homo sapiens
  misc_feature: GYAE6OF02FIPRR.26.26.C04.1.454.CMB.1.raw
  modified_base (793)..(793): a, c, t, g, unknown or other
  misc_feature (793)..(793): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtgggatgttgtgatgactcagtctcgctctccctgccgtacaccttggacaggcgcctcatctctgcaggtcctagtcagagtcctgtacacgtagtgaagtacgggaacctaccgtccgttagaacgtacggtattaccgaacgtaccgtaaggaccgggtcccaacgggtaacccctaacccggttaccggaacggacccgttacctttaaaagtttaagtaaacgttactttacctaaaggtccggggttaacgtttccccgggggtaacccaaggtaacctaacggtacttttaccgacggaccggtacgtaagggttacgggtaacgtacggtacgtaacgtttacggtaacttttccggaacgttaccgtttacggaaaacgtacgttaccgtaagggtacggtaacggggttacgggtaaccgtcgttaagggtaacggtacggtttaacggttgggttttaaaccggttttacgtttaaccgtacggttacccgtacggtacggtaacggttaacggttaacgtttaccggacggtttaccggggaccgtttaaccgggttaccggtttaccggggaaccggtaacgggtaacccggtaacggggtttaaacgaaaccgttaacgtaaacccgggtttaanacgggttacgtaccgtaccggtaacctccgttaacgtttccggttaccg

SEQ ID NO: 211602 - DNA, 649 bp, Homo sapiens
  misc_feature: GYAE6OF02GG8TF.26.26.C04.1.454.CMB.1.raw
  modified_base (233)..(233): a, c, t, g, unknown or other
  misc_feature (233)..(233): n is a, c, g, or t
  modified_base (291)..(291): a, c, t, g, unknown or other
  misc_feature (291)..(291): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctcgtgggtcccagggtccaggtggggatgttgtgatgactcagtctccgctctccctgcccgtcacccttggacnggccgcctccatctcctgcaggtctatcagacgcctcgtacacagtcgagtcggaacncccgtccttagaactggaacttcgagaccgaggtacgggcccgaacggccccaaacccgtccggacggaccgtaccttaaatttaactaaagtacttttacgtaagttcgggtacgtttcccggggtacccaacgtaacgacgtaacttcgacggcggcgtacgggttcgggtacgacgggtactaacgttcgtactttacgaccgacgttaggaacgtatccgagcggtaggggtggaaggcgttagggaaggtgttggttgttcggtttaacttacgtgtccgtgacgagtaggttacgttcgacggttcggtaccgtgggtacgttaccggaccgtaacgggacgtaggtaacgg

SEQ ID NO: 211603 - DNA, 809 bp, Homo sapiens
  misc_feature: GYAE6OF02GF93F.26.26.C04.1.454.CMB.1.raw
  modified_base (171)..(171): a, c, t, g, unknown or other
  misc_feature (171)..(171): n is a, c, g, or t
tcagagactatactcacgaccggtgctcgatttagtctagcgactttgggtttgggggactgatcaggactcctcagttcaccttctcacaatgaggctccctgctcagctcctgggctgctaatgctctgggtcccagggtccagtggggatgttgtgatgactcagtcnccgctctccctgcccgtcacccttggacagcgcctccatctcctgctagtctagtcagacgtcctcgtacacgagttgagtagggaacccaccgtccttagaacgtggtattaccgagtacgaggacggccaacgggacccctaaccgtcccggacggccgtaccttaaagttttaataacggttactttaaccgtaaggttccgggtaacgtttccccgggggtaccctaaggaaccgtaagttacgttaccgacgggccgggtacgtaacggggtttcggggacacggggtacctaacgttaggtaactttccgacgtaccgttaagaaaggtcttaccggaggaccgggttaacggggtacgggaacgggtaccggtagggtaagggttaggtttacgggttttaccggtttacgggttttaacttaaccgtccgggttaccgtcggtaacggttaaggttaacgtttacgttacccgttacgggtaccgggttaccgggttaggggttacccggtttaccgggaacccgggtaacgggtaccgggtaaacgggtaacggtaaaacccgtaccggtaaaaccggttacgttagggtaccggtaccgttaccggaccctaaccgtttagttacccg

SEQ ID NO: 211604 - DNA, 706 bp, Homo sapiens
  misc_feature: GYAE6OF02H611A.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtctccgctctccctgcccgtcacccgttggacagggcgccctcatcctctgcaggtctagtcagacgtcctacgtacacgagtgagtcggaaccaccgtcttagaactggattcgagcagacggaccgacggtacccaaccgtccggacggccgtaccttaaactttaagtaaacgttaattttacgtaacgttacgggtacgtttcccgggggtaccagacgagtacttcgaggccggacgaggttgggtacgaggactacgttacggacttttaccgacgtcgtagaaaggtactacgacggtcggaaggggtgggacggtcgtaggtaaggttgttaggtttacggttacggtttttaagttcgtacgtcgttggtaccgtaggttacgttacttccgacggttccgggtaccggttcggtaccggtttaccggaccggtaaccgggtaaccggaagggttaaacggtaaactaaccggtaaaccggtacggttacggtaccggtacgtaccgggacctaccgtagttacccg

SEQ ID NO: 211605 - DNA, 766 bp, Homo sapiens
  misc_feature: GYAE6OF02HG0XF.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctccctgctcagctcctggggctgctaatgctctgggtcccagggtccaggtggggatgttgtgatgactcagtctcgctctccctcgccctcacccttggacaggccgcctcatctctgcagtctagtcagacgtcctacgtaccacgagtagagtacgggaacctacccggtcctttaggaaccgttgggtaactttccgaaggaccaacgggacgggaccccgaacgggaccccctaaaacccggtccgggaacggtccggtaaaccttttaaagtttaaacgtaaagttacgttttaaccgtaacggttaccgggtacggttttcccccgggggacctaaggaaccgtaggtaacttccgagggtaccgggacgtaggggttacgggtcgaacggtcgtaccgttagttacgtttaccgacgttacgtaaggacgttacgtacgtaggtacggaagggggttcgggaaggtcggtaggtagggtagttcgggttacgttacggttttataaccgtcgtaccgttaggtaccgtaggttaacgttaccgttacgtaccggtttacggggacccgtttacgggggtaccgtttacccggggaccgggtaaacgggtaaccgggttaaggtaaacggg

SEQ ID NO: 211606 - DNA, 745 bp, Homo sapiens
  misc_feature: GYAE6OF02G3MFI.26.26.C04.1.454.CMB.1.raw
  modified_base (147)..(147): a, c, t, g, unknown or other
  misc_feature (147)..(147): n is a, c, g, or t
  modified_base (197)..(197): a, c, t, g, unknown or other
  misc_feature (197)..(197): n is a, c, g, or t
tcagagactatactcacgaccggtgctcgatttagtctagcgactttgggtttgggggagataaaaagctcagctctacccttgccttgactgatcaggactcctcagttcaccttctcacaatgaggctccctgctcagcctccgnggggtctgactaatgcttcgtcgggtcccaggtccaggtgggattgttgngatcgactctacgtcctccgctcctccgtcgccctcctaccgtggacgacggccgtccctccatcctcgtggcgaggttcgtagcgagtcgcctacgacagagtcggagtacgggaacctaccgtcgttacgaggtggtactcgacgacgaggacggccaacggaccctaccgtcggaccgtccgttaaccttaagttactaaacgtttcttaacgtaacggtcgggttaaccggttccccgggaactaacggcgttagtacttacggacggcggtaacgtcgggtcgtacgacggtacgcgttagtacggttaccgacgttagacgtaacgtctaacgacggacgggtacggagggtacgggtacggtacgtaagggttcgttacgggttttacggtttaacgtttttaccgaacgttccgttacgttacccgtaggtttaacggttaacgtttacgttacccggtggtacccggggtttacgttaacccggggtttccggtaacccgtaccggggaaacggttaacgggtaaaggttaaacccggg

SEQ ID NO: 211607 - DNA, 748 bp, Homo sapiens
  misc_feature: GYAE6OF02F7386.26.26.C04.1.454.CMB.1.raw
  modified_base (173)..(173): a, c, t, g, unknown or other
  misc_feature (173)..(173): n is a, c, g, or t
tcagagactatactcacgaccggtgctcgatttagtctagcgactttgggtttgggggactgatcaggactcctcagttcaccttctcacaatgaggctccctgctcagctccgtgggctgctaatgctctgggtcccaggtccagtaggggattggtgtgatgactcagtcnccgctctcccgtgcccgtctacccgtggacagggcccgcctaccatcgtcctgacctaggttctagtcagtgcctgtaacacagtgagtacggaacaccgtctagaactggacttcgagcgacggacggacccacgggaccccaacccgtccggaagggtcccgtaacccgttaaagtttaacgtaaaggttactttaccgtaacggtccgggtagttaccccggggtacccagaaccgtagtacctttaacggccgcgggtcgacgggtacggtcgaacggcctaagtacgtacgtttacgacccggtgttacggaactacggtagaacggttccggaaggggtcgggtagggtaccgttagggagtaaggtttcgttaggtttaccgtttaacgttcgacgtccctaggacgtagtacgttacgtaccgtacggttacggacccgggttcggttaccggtacccggtaccgggtaacggaaccggttaaccggggtaaattaaaccggtacccggtaaaggttaacccgttgggtacggttacttaccgggaacccttacggttacttacccg

SEQ ID NO: 211608 - DNA, 804 bp, Homo sapiens
  misc_feature: GYAE6OF02FT9Q6.26.26.C04.1.454.CMB.1.raw
  modified_base (269)..(269): a, c, t, g, unknown or other
  misc_feature (269)..(269): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtgggatggttgtgatgactcagtcctccgctcctccctcgcccgtcaccccgttggaccaggccgcctccatcctccgtgcaggtctaggtcagcgcctacgtacactagtcgagtacggaaccnccggtccttgaactggtattcgagcaaggacggcccacggcccaaccgtcgacggtcgaccttaaatttaagtaacggttactttacctaaaacggttccgggtacgtttccccgggggtaccctaacggtacgaacggtacttaccgaacggccgggtactaacgggtcgggtacacgggcctaaccgttacggtacttttaccgaccgtcgtaacggtaacgaccgtacgacggaccggtaggggtacgggaaccgggtcgtagggtaaggttacgtttaggttaccgggtttaacgggttttaacttaccgtcggtaccgtacggtaccgtaacggttacggtttaacctttccgtaaccggttcggggtacccgtacgggggttaacccgttaccggggaacccggtaaacggggttaacccggtaaacggggttaacgggtaaaaccttaaacccggtaaaaccggtaaccggttacgggtaccggttaaccgacccgttaccctaaccggttaccgttcccgtttaccg

SEQ ID NO: 211609 - DNA, 820 bp, Homo sapiens
  misc_feature: GYAE6OF02HCR00.26.26.C04.1.454.CMB.1.raw
  modified_base (207)..(207): a, c, t, g, unknown or other
  misc_feature (207)..(207): n is a, c, g, or t
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctcagctcctgggggctgctaatgctcgtcgggtcccagggtccaggtggggatggttgtgatgactcagtcnccgctctccctgcccgtcaccgtgacaggccggcctcgatccnctgcagtctagacagancctacgtacacatgagaggaaccaccgtccttaggaaccgtaggtattaccgagacgaacgacggacccgacggaccccaaccgttacccggacggtaccgtaccttaaagttaagtaacgtagtttactaaacggtccgggtaacgtttccccggggtaccccgtaagaaccgtaacggtaacctttacgaacgggtaccgggacgtaggggttacggggttaccgaacgggtacccaacgtttacggttaaccgtttaacccgacccgggttaccgttaacgggtaaagtaaccgtaccgttaaacggtaccggggtaaaggggggttaccggaagggggttccgtaaggggtaacgggttaacggtttaggggtttttaccgttaaccggggtttttaaacttaaccggggttacccgttacggtacggttaaaccggagggttaacggtttactttaacccgggacgttaccggggtacccggttacggggttaaccgggttaaccggaaccccgggtaaccgggtaaaccggttaaggggtaaaccgg

SEQ ID NO: 211610 - DNA, 760 bp, Homo sapiens
  misc_feature: GYAE6OF02JG4HV.26.26.C04.1.454.CMB.1.raw
  modified_base (618)..(618): a, c, t, g, unknown or other
  misc_feature (618)..(618): n is a, c, g, or t
tcagagactatactcacgaccggtgctcgatttagtctagcgacttttgggtttgggggagataaaagctcagctctacccttgccttgactgatcaggactcctcagttcacccttctcaacaatgaggcctccctgctcagctccgtggggctgactaatgctcgtcgggtcccagggtcaggtggggacttggttgtagatcggtactacacgttcctcccgcttcccgttccctcggcccttccctaccgtaggacgacgggccgtccctaccagtcctcgtgaccgtaggtcctaagtcgaacgactccgtactaaccgagaggttacgaggtaccggaaaccgtccgtacgttaacggaacggtcgttactacgaacgacgagaccgacgaccggaacccgacccgtacggcgtaacctaaccgtttaaattaagtaacgtttacgtttacgtaacgggtaccggttaccgggtccccggtaactaaccgaagtacttacggtacgacggccggtaagtacgggtacggtacgaacggtcctagtacgttacgttacgaacgttgaaacggtacctaaacgcgacgaagggttacgggagtacggtaaaggngtaaggttcggttcgtacggtttacgttaacgtcgttacgtagtacggtacgtacggttacgtaccgttggaacccgtttgggtaccgttaccgggaacggttaaccgggaaccgtaacgggaaccgggtaagtaaaccggg

SEQ ID NO: 211611 - DNA, 747 bp, Homo sapiens
  misc_feature: GYAE6OF02JQSL4.26.26.C04.1.454.CMB.1.raw
  modified_base (87)..(87): a, c, t, g, unknown or other
  misc_feature (87)..(87): n is a, c, g, or t
tcagagactatactcacgaccggtgctcgatttagtctagcgactttgggtttggggtgatcaggactcctcagttcaccttctcanaatgaggctccctgctcagctccgtgggctgctaatgctctgggtcccgagggtccaggtgggatgttgtgatgactcagttcctccgctcctccctcgcccgtccacccgttggaccacgggccggccctaccactcctccgtgcgtaggtctacgtcgaagaccgtcccgttacgaaccgtacgtaggtacggaacgttaccggggaaaccttacccggtccgttagtaaccgttaggacttaccgacgccgacggacggaccgaaccggtacccctaaacccgtcggaacggtcccttaacgtttaattacgtaagtacgtttaccgtaacggtccgggtaccgttcccggggtccaaggtacctagttctacgacggccggtaacgtgggtaccggtacgacgggtcctaacgtagttccttacgacgtcgtagtacgagtcgacggtcggaggtgacggtgacggtagtgttacggtggtttaccgtattcggctaccgtaggcgtaacgttaagttcctggtacggtccggttaccggtacggtccgttacggaaaccgacggggtaacgttaacggtaacggtaaacttaaacccggaacggtttaccgtaggtaccgtcgtaccggtaccgtaacccgtgttacccgttacc

SEQ ID NO: 211612 - DNA, 934 bp, Homo sapiens
  misc_feature: GYAE6OF02JLX2O.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctgggctgctaatgctctgggtcccagggtccaggtgggatgtgtgagtgacctcgagtcctccgctcctcccgtcgcccgtcacccttggaccgagggtcccggccctcctacgttcctccgtgaccgtaggttcctacggtccaaggacggttccctacggttaacctacgtaaggttgaacggtacgggaacccgtacccgtccgttacgaaccgttagggtacttacgaacggccgaagggaccggacccgaaccgggacccctaacccggttacccgggaaccggtacccgtaaacccgttttaaacgttttaaacgttaaacggttaaactttttaccgaaaagggtttccgggggttaacccggtttccccgggggtacccctaaacgggaaccgtaaacggtaacgtttaaccggaagggtcccgggtcgggtaaaacggggttccggggtaccggtaacggtacgtaacccggttacgttaccgtttaccggtaaccgcggtaaacgtaacggtacgtaacgacggtcggggtacgggggtcgtaagggtaccgtaggggtaagttacgggtttgggtttacgggttacgtttttaaacgtaccgtttcggtcccgttacggtacggtaaggttcgttaacgttaccgtcggtcgggttacccggtacgggttacgggttacccgggaacggtaaacccggggtaacggttaaacgggtaacggtaaaccggttaaacccggaaaacggtttacccgggtaccgggtttaccggggtaccgtaaccggtaccccacggtttacccttaacggg

SEQ ID NO: 211613 - DNA, 733 bp, Homo sapiens
  misc_feature: GYAE6OF02FH1NG.26.26.C04.1.454.CMB.1.raw
  modified_base (553)..(553): a, c, t, g, unknown or other
  misc_feature (553)..(553): n is a, c, g, or t
tcagagactatactcacgaccggtgctcgatttagtctagcgactttgggtttgggggagataaaagctcagctctacccttgccttgactgatcaggactcctcagttcaccttctcacatgaggctccctgctcagctcctggggctgctaatgctcgtcgggtcccaggtccagtggggatgttgtgatgtacctcagtcctccgtctcctcccctcgcccgtcacccgttggactcggccgtcctacactccgtctcgacgtagtcctaagtcacgacgcccttacggtaaccacgtacggtcgaacgtacgggaaccctaccgtccgtttacggaaacgttggtaccttacacgtctaacggggacgacccgtaaccggaccccaaccccggttaccggacgggtccgtaccctttaaattttacgtaaagttctttacgtaaacggtcggggttacccggttcccggggtaacccaggtactacggtactgacgaccggtgagggtcgtacaggctacgtacggttctaccgacgtcgtacgaacgntaccggaagtcgggtagggttacggcgtacggtacggtaaggtaaccgtttggtacgggtttacctttagtccgtaccgtcggtactcgaaaggttttaccacttaacccgtacggtccgggtacgggtacgtacccgggtacgggtaacccgagggtaaacccggagggttaaacccgg

SEQ ID NO: 211614 - DNA, 874 bp, Homo sapiens
  misc_feature: GYAE6OF02JJP6S.26.26.C04.1.454.CMB.1.raw
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
tcagagactatactcacgaccggtgctcgatttagtctagcgactttgggtttgggggactgatcaggactcctcagttcaccttctcacaatgaggctccctgctcagctcctgggctgctaatgctctgggtcccagggtccaggtggggattggttgtgatgactcagtctccgctcctccctcgcccgtctacccgttggaccgnggccgtcctaccnttccgtcctgcgtaggtcctagtcagcgcctcgtacacgagttgacgtacggaaccaccgcttagtaacgtgtaacttcgacgacgacggacggtcccaccgggtaccctaacccgtccgggacggtaccgtaacctttaaagtttaacgtaacgtttaactttacggtaaacgtccggggtttaaccggttaccccggggtaccctaaggaaccgttaaggttaccgtttaaccggcgggttacccggaaggttacggggtttcgggtacccgaaacgggttaccctaaccgtttggttttaaaccgtttcccggaacggtaccgtttaaggaaacgttaccggttcggacggtacgggtacggggtaggttaccgggtaggttacgggtaagggttacgtttccgggttaaggtttcccggtttaacgtttccggtacggttacccgtagggttaaccgttaacggtttacgtttaacgttacccgggtacccgttcgggggtaacccggttacgggttaacccgggttaccggggaacccgtttaccgggaaaacggggtttaaccggttaaaggaaaccggtaaccgggtttaaacgtccgggttaacgggtacgtaccggtaaccgtaacccgtacgttacgttcgg

SEQ ID NO: 211615 - DNA, 674 bp, Homo sapiens
  misc_feature: GYAE6OF02F594O.26.26.C04.1.454.CMB.1.raw
  modified_base (240)..(240): a, c, t, g, unknown or other
  misc_feature (240)..(240): n is a, c, g, or t
  modified_base (432)..(432): a, c, t, g, unknown or other
  misc_feature (432)..(432): n is a, c, g, or t
  modified_base (500)..(500): a, c, t, g, unknown or other
  misc_feature (500)..(500): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccaggtggggatgttgtgatgactcagtctccgctcctccctcgccccgcctacccttggacaggtccggcctcatcctcctgctaggtctagtcagacncctcgtacacgagtagagtggaaccaccgtccttacgaactggtattacgagacgaggacggaccgacggacccaacccgtccggacggccggtaccttaaattttaacgtaagttacttttaacgtaacggttaccggggtacggtttccccgggggtacccacggtaccaacgtattcgacggcggacgnggttgggtacgaggtctacgtagtacttccgacgtcgtagaacgtatacgtaggacggtagggtaggnggtacgtaggaggtagttggttagttacggtttacttacgtcgtaccgtagacgtagagttacgtcgtacgttcggtaccgtcgggtacgttaccggacgtacgggaacggtaacggtaaggtaaactacggaaacgtacgtacggtggtacctggacctacgtactacgtacg

SEQ ID NO: 211616 - DNA, 647 bp, Homo sapiens
  misc_feature: GYAE6OF02HYKYR.26.26.C04.1.454.CMB.1.raw
  modified_base (220)..(220): a, c, t, g, unknown or other
  misc_feature (220)..(220): n is a, c, g, or t
  modified_base (643)..(643): a, c, t, g, unknown or other
  misc_feature (643)..(643): n is a, c, g, or t
tcagagactatactcacgaccggtgctcgatttagtctagcgactttgggtttgggggactgatcaggactcctcagttcaccttctcaacaatgacggctccctgctcagctccgtggggctgactaatgctcgtcgggtccagggtccaggtgggatgttgtgatgactcagtctccgctcctccctcgaccctctaccgttgacgtcggccgcctcntcctcgagcgtagtctagcagctctacgtacacgagtgagtacggacacgtctacgaacgtgtactgacgacgaggtaccgccacgaccctacgtaccggacggaccttaacttaacttagttaattcttaacgagttccggtacgtccggactagacgagttactcgacggcgtacgtacggtcggacgacgtcgttacgttggactttcgagtacgtaacgtacgtacgtacgacgggtcggaagggtcgggaacggtacggtaggaggttaacgtttgggttaccgtttacgttacgtaacgttcgaacgtttgaagttaacgtcgttgtaccgcggtccggtacgcgggttacgtaccggacggtacggtaacggaggttaacgacgaagtaacgtgtcgacgtactccggactccgtnttcg

SEQ ID NO: 211617 - DNA, 690 bp, Homo sapiens
  misc_feature: GYAE6OF02H2TYV.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgtgtgatgactcagtctccgctctccctgcccgtcacccgtggacaggcgcctccattcctctgcaggtctagtcagacgtcctcgtacacagtgatcgggaacaccgtccttggaacttggatacagcgaggacggaccacggaccaaccggtccggacggtccgtacctttaaagtttaacgttaagttaacttttacgtaaacggttcggggtacgtttacccgggggtaccaagtacgagtacgtttacgaggccggataggtcgggactacggactacgtgtacttttaccgacgtcgtagaagtacgtacgaggtcgaggggtacggacggtcgtaggtaggttacggttggttacggtttcgggttttaactaccgtacggtccgtggacgtaacgtagttacttccgacggttacggtaccgggttacgtacggttaccggaacggtaacgggtaaccggtaagggtaacggtaaacgtaaccgaaacggtacgttaggacggtacgtaccggacctacgtcttacg

SEQ ID NO: 211618 - DNA, 655 bp, Homo sapiens
  misc_feature: GYAE6OF02HI8HU.26.26.C04.1.454.CMB.1.raw
  modified_base (340)..(340): a, c, t, g, unknown or other
  misc_feature (340)..(340): n is a, c, g, or t
tcagagactatactcacgaccggtgctcgatttagtctagcgactttgggtttggggtgatcaggactcctcagttcaccttctcacaatgaggctccctgctcagctccgtgggctgctaatgctctgggtccagggtccaggtgggatggttgtgatgactcagtcctccgctcctccctcgcccgtctacccttggaccaggccgtcctcactcctcctgccgtaggttctagtcgagtaccgccttacgtacacagtgagtcggaacctccgccttagaacgttgatcaggcaggacgccagacccctaacgtcgacggcctactaattacgaatntttacaagtccggtacgttcccggccagacgtagtattccgaggcgtagtaggttcggacgacggtccagttcgtacgtttacccgaacgtcgttaggaaagtctaaccggtagaccgggtagggtggaccggtgtaggacgttaggtttgttaacggtttccgtttatccgtctccgtagacgtatacggttactcgacggttccggtacggacggttccggtaccggaaccggtaagggaaccgttagggtaaagtaaaccctaagaaacgtcgttagtaccggacgtaccgaaccttacgtcgttcgttacg

SEQ ID NO: 211619 - DNA, 933 bp, Homo sapiens
  misc_feature: GYAE6OF02HG168.26.26.C04.1.454.CMB.1.raw
  modified_base (551)..(551): a, c, t, g, unknown or other
  misc_feature (551)..(551): n is a, c, g, or t
tcagagactatactcacgaccggtgctcgatttagtctagcgactttgggtttgggggagataaaagctcagctctacccttgccttgactgatcaggactcctcagttcaccttctcacaatgagctccctgctcgagtctccgtggggctgacttaatcgcgtcgtcgggtccgagggtccgaggtggggatgttgacgatcgactcgagttcctccgtacttccctcccgtccgtaccccgtacctacccgtagggaccgacgggcccggtaccctaccctagtccctaccgtcggtcgtaacggttcgttacgacgacgaccgtccgtacgtaaccacgtaggtacgacggtaccgggtaacctacccgtccggttaaagtacggttacggactttaccgaggtaaccgacgggaccggaccgaaccgggacccctaaccggggtacccgggaacgtcccgtttaaactttaagttttaaagtaaacgtttacgttttaaaccggaacgggtttacccggggttaccggtttaacccccggggtaanaccggtacggtaaaccttaccggttacgtaccggggtacgtaccgggttaacgggtacgggttaaccggaaccggtaccgtttacgggtttaccgttaaccgtttacccggggaaccgtaacggtttaaacggtaacgggtaaccctaggggtaacggttaccgggaagggggttacccggggtaggtttaccggggtaggtaacgggtttggtttcgggttttaacgggtttaccgggttttaaacgtccgttacgggttcgtacccgggaatacgggtttaacttaccggttccgacgggttacccgggtttccggttaaccggggttcccggtaaccggggtaaccggtaacccgggttaaggtaaccggttaaacggg

SEQ ID NO: 211620 - DNA, 666 bp, Homo sapiens
  misc_feature: GYAE6OF02FMCJD.26.26.C04.1.454.CMB.1.raw
  modified_base (660)..(660): a, c, t, g, unknown or other
  misc_feature (660)..(660): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctcatcctcctgcaggtctagtcgagacgtcctcgtacacagtgagtacgggaaccacccgtcttacgaactgggtattaccgagacgaggaacggcccgaaggacccctaaacccgtcccggaacggccgaccgttaaattttaactaaagtactttacgtaagtccgggtagtttccccggggtacccaaggacctagacgttcgaggtcggtcgagggtcggtacgaggtccacgttgtactttaccgtacgcgtagaagtacgtacacggacgtaggggtgggaggcgtagggaggtagtttggttggttacggtttaattaccgtcgtcgttcggactagtagttacttcgtacgttcgggcgtaggtaccgtcggaaccgtacggaacggaagggtacgaaagtaacgtaaacggtaggtacggttcggacgtaccgacctaccttagtnttaccg

SEQ ID NO: 211621 - DNA, 867 bp, Homo sapiens
  misc_feature: GYAE6OF02GELGJ.26.26.C04.1.454.CMB.1.raw
  modified_base (199)..(199): a, c, t, g, unknown or other
  misc_feature (199)..(199): n is a, c, g, or t
tcagagactatactcacgaccggtgctcgatttagtctagcgactttgggtttggggtgatcaggactcctcagttcaccttctcacaatgaggctccctgctcagctccgtgggctgctaatgctctcgggtcccagggtccaggtggggatgttgtgatgactcagtctcgctcctcctcgccctctaccgtggacnggccgcctccatcctcgtcgacggtctagtcagacgtcctacgtacactagtagagtacggaactaccggtcctagtaactggtaacttcgacgtacggaggacggtacccgaacggtacccaacccggtaccgggacggtacgtaacccttaaagttttaacgaaagttacttttacgtaacggttccggggtaacgtttccccgggtaccgtaagacgtaagtacttaccggacggccggtacgtagggtcggtacgacggactaacgtagttactttacgaccgtactaacggaacgtaacgtacgaacgtaacgggtagggggtaacgggtacgggtacgttaacggggtaacggttacggtttgggtttaacgggtttcccgggttttttaacgttaacccggttacggtccggtttaacggtaaccggttaacggttaaacgtttaccgtttaacggttaacccgggtttccggggtaacccgggtttaccggggttaaacccgggttaccggaaacccgggggttaaccggggtaaaccggttaaacgggggtaaaaccgttaaccgggtaaaccgtaaaaacccgggttacggttaacgggttaccggtaccggtaacgtaaccccgggtactaccgggttttaccctaccggtttaccc

SEQ ID NO: 211622 - DNA, 794 bp, Homo sapiens
  misc_feature: GYAE6OF02F788V.26.26.C04.1.454.CMB.1.raw
  modified_base (271)..(271): a, c, t, g, unknown or other
  misc_feature (271)..(271): n is a, c, g, or t
tcagagactatactcacgaccggtgctcgatttagtctagcgactttggggtttgggggagataaaagctcagctctacccttgccttgactgatcaggactcctcagttcacctttctcaacaatgaggctccctgctcagcctccgtggggctgactaatcgctcgtcgggtcccgagggtcgagggtgggtagttgttgtgatgactcgacgtcctccgctcctcccgtccgtcccgtcctaccgtaggaccgacgggccgcctaccnctcctcgtcgtacgtacgtatacgtcgaagtccgtcctacgtaacacgtagtacgtaacggtacggaacctacccgtacgtagtaacgtcggtactacgagacgacggcgaccgacggacccgtaccgcggacggtaccttaactttaaattaagtaattacgttacgtaacgggtacgggttaccggtcccggggtaaccaagacgtaagtacgtacgacggggtccggagtacggggtacgggtacggtacggtacgtaacggtttacggtacctttaaccggacgtacggtaaaggtaacggtacgtacgggaacgggtaccgggggtaacggggtcggggtaacggtcgggttaagggtaccggttaggttcggggttttacgttaccgttttaaccggttaccgtcgggtaccgtagtaacggttagggtaactttcggtaccgtcggggttccggtaccgggttacgggttacccgggtaccggaaccggtaacgggtaacggtaacgggtaaacgg

SEQ ID NO: 211623 - DNA, 892 bp, Homo sapiens
  misc_feature: GYAE6OF02ISLT0.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggcctccctgctcagctccgtgggctgactatcgctcgtcggtcccgagggtccaggtggggtatggttgtgatgactcgtacgtcctccgccttccctcccgtccgtcccgttaccgtacccggttacggaccgtacggggtcccgtcccctacctcgttccctcccgttacggcgtaccggttactacgtaccgtaacgacggtaccctaccggtaaccacgtaacggtacggtacggtaaccgggaaacccgcccggttacgttacggaacgtgttaactcgacgacgaacggaccgaccgtaccgtaacccgtaaccgtaccggacgggtaccttaaccgtttaaagttaacggtaacgttaacgtttacgttaaacggtacggggttaccggttaccccggggtaacctaacggtaaccgttaggttaacgttcggacggaccggtacggtacggtacgggtaccgtacggtacgtagttacccccccccccgttagttaccgtacgtacgtacgtaacgtacgtacgtacgtacgggtacgggtacgggtacgggtacggtacggtaacggttacggttacgggtttacgggtttaccggttttaacggttaacggttccggttaccggttacggttacggtaacggttaacggttaccggttaccggtaccggttaccgggttaccgggttaccgggttaccgggttaaccgggttaacccgggtaaaccggggttaacccgggttaacgggtaaacggg

SEQ ID NO: 211624 - DNA, 775 bp, Homo sapiens
  misc_feature: GYAE6OF02GWW60.26.26.C04.1.454.CMB.1.raw
tcagagactatactcacgaccggtgctcgatttagtctagcgactttgggtttgggggagataaaagctcagctctacccttgccttgactgatcaggactcctcagttcaccttctcacaatgaggctcctgctcagctccgtggggctgctaatgctcgtcgggtccagggtccaggtggggtattggttgtagactcgactctacgtcctcgtcctcctccctacgcccgtcctacccgttaggacgacgggtccgcctaccatcctcgtcgacgtaggttaccgacgtcaagaccgaccgtaccggtaaccacgtaggtagacggtaacggggaaccctacccggtaccgttacgtaacgtcggtacttacgacgcgaacgggaccgacccggaccggtaccctaaccggtaccggtacggtacgtaaccctttaaagtttaaactaaacggttatttaaccgttaaacggtacgggtaccggttaccccggggacctaacggcgtaacgtacgtttcgacgtcgggcgtagggtacggtacgtagtcgtagttacgttacgttacgcgtagtagtagtacgtacggtacgacgggtaacggggtggaacggtcgttacgggtaacggttggtttacggggttacgtttacggttaacttcccggttagcccgttagggtacgtacggtaacggttcttaccggtacggttcggtaccggtaccgggtacggttaccggaaccgggttacggtaaccggtaggtaaaccgg

SEQ ID NO: 211625 - DNA, 843 bp, Homo sapiens
  misc_feature: GYAE6OF02HS1QE.26.26.C04.1.454.CMB.1.raw
  modified_base (283)..(283): a, c, t, g, unknown or other
  misc_feature (283)..(283): n is a, c, g, or t
tcagagactatactcacgaccggtgctcgatttagtctagcgactttgggtttgggggactgatcaggactcctcagttcaccttctcacaatgaggcctccctgctcgagctccgtggggctgctaatgctcgtcgggtcccagggtccaggtgggatgttgagatgactcagtcctccgcctccgtccgtcgtacccgtccgtaccgttgggactacgggccgtccctactacgttcctcctaggccgtaggtcctagtacgacgacgtcccttacggacncaaggttcgaggttacggaaacctccgtacgttacggtaacgttcggtaacttaccgagtaccgtaaggaccggtaacccgacccggtaaccccgaaaccccggttacccgggacggtaaccggttacccttttaaaagtttaacgaaaccggtttagttttaacgtaacgggttaccgggtaccggttacccggggaccaaagtaccgtacggtactacggacggtccgtaacgtgggaaccggttacgacgtacgtaacgtttagtaccttacgacgtagaacgtaacgtacgtacggaacggtcggtagggtacgggtaggtaccggtaggtaaaggtttggttacggtttacgtttaccggtttaagttccggttaacgccgttacgtacggtaagttacgtacgttacgtacggtttccggtaacggtacggttacccgggttaccggtaaccgggaaccgggtacggtaaacgggtaacgtaaaaccgtaacggtttaaaaccgtccgggttaacgtacgggtaccgtacgtaccctacgttaaccgtttccgg

SEQ ID NO: 211626 - DNA, 752 bp, Homo sapiens
  misc_feature: GYAE6OF02I94PX.26.26.C04.1.454.CMB.1.raw
  modified_base (158)..(158): a, c, t, g, unknown or other
  misc_feature (158)..(158): n is a, c, g, or t
  modified_base (266)..(266): a, c, t, g, unknown or other
  misc_feature (266)..(266): n is a, c, g, or t
tcagagactatactcacgaccggtgctcgatttagtctagcgactttgggtttggggactgatcaggactcctcagttcaccttctcacaatgaggctccctgctcagctcctgggctgctaatgctctgggtcccagggtccaggtgggtatgttgngatgacctcagtctccgctctcccgtgccctcacccttggacacggccggcctccattccgtcctgcgtaggtctacggtcaagcgtcccttcgaccaataggtcganagggaaccaccggtcccttaggaacctttggaatttccgaggaccaggaccggacccacgggaccccttaacccgtccggagggtccgtacctttaaagttttaataaacgtacttttacgttaaacggtccggggtaacgtttcccgggggtacccaaggaccaggttacttaccgaggaccggtcgtaaggttcgggggtacaacggggtccctaacgggttattaacgttttcgacctacgttacgaaaggccttacgagaccggtaaggggtcgggaaaggtccgttgggaaagttgtttccggttaggtttacgggttttaattaccgtcgtaccgttggaccgtaaggtacgtttacttacggtcgtaacgggtcccggttagttaccggttaccggaccgttaacgggaacccgtaagggtaaccgtaaataaccgaacgtttaaccgcggtggtaccgcgtaccgaccctagttccgg

SEQ ID NO: 211627 - DNA, 895 bp, Homo sapiens
  misc_feature: GYAE6OF02I7EGY.26.26.C04.1.454.CMB.1.raw
tcagagactatactcacgaccggtgctcgatttagtctagcgactttgggtttgggggactgatcaggacttcctcagttcaccttctcacaatgaggctccctgctcagctcctggggctgctaatgctcgtgggtcccgaggtccgaggtgggatgttgtgatgactcacgtcctccgccttcctcccctcgtccccgtcctacccgttcgggacgtacgggcccggtccctaccgtactttcctcctacgtacgtacggttacctagtacaacggacgtaccccgttcggttaaccgaaccgttaggtcggtaacggttacgggggaaaccaaccccggttaccctttaacggtaaaaccgttcggttacgttaccggaacggacggacggtaaccgggtacccggaacccgggaaccccgaaacccgtaccccgggacgggtacccgtaaccgtttaaacgtttttaaacgtaacgttaacttttaccgttaaacggttaccggggtaccggtttcccggggtacccgaaaggtaccgtaacgtaccgttaacgtacgggtaccggtcggtaacgggtcgggttacgaacgggtaccgtaactttagtacgtttaccgaccggttaccggtaagtaaactacgtacggtagggaacgggtaggggtggagggtacgaagggtaggttggtttaggtttaggtttaccggtttatacccggtcgtacggtctaacggtaaggtacctttaccgtacgtcggtttcgggtaacggtttaccgggtacccggttaaccggtaaccgggtaacgggtaaacggtaacgggtaaacgtaaacgaaacccggttaagtaacccggtggaacgttccgtacacccgtaactgtttacg

SEQ ID NO: 211628 - DNA, 672 bp, Homo sapiens
  misc_feature: GYAE6OF02I9A81.26.26.C04.1.454.CMB.1.raw
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
  modified_base (402)..(402): a, c, t, g, unknown or other
  misc_feature (402)..(402): n is a, c, g, or t
  modified_base (434)..(434): a, c, t, g, unknown or other
  misc_feature (434)..(434): n is a, c, g, or t
  modified_base (518)..(518): a, c, t, g, unknown or other
  misc_feature (518)..(518): n is a, c, g, or t
  modified_base (530)..(530): a, c, t, g, unknown or other
  misc_feature (530)..(530): n is a, c, g, or t
  modified_base (544)..(544): a, c, t, g, unknown or other
  misc_feature (544)..(544): n is a, c, g, or t
tcagagactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgccctcaccttggacngggcgcctcatcgtccctgcacggtctagtaccngacgccttcgtacactaggctagcgggacctaccgtcttcgtaactgggactttcgacgacaggtacggacctaggacccctaaccgtccggacggcgtacccttaatttaactagtactttacgtaacgtcggggtacgtttcccggggacctaggactacgtaggttacnggtacgtccgtaaggtcgtacgacgggtaccntacggtacttacgaccgtactagggaactaggccgtaacggcgtaggggtcgggacgtctagggacgtgttgtttgtacggttntacgtcgtaccnggtaccagtacttnttacgtacgtcggcgtcgggtaaccgtcgggtaacccggacggtaaccgtaaggggttaaccggaatttaaccgaaacggttaacgtggttacggcgttacggacctaacgttccggcttttaaccgg

SEQ ID NO: 211629 - DNA, 759 bp, Homo sapiens
  misc_feature: GYAE6OF02F1Q9L.26.26.C04.1.454.CMB.1.raw
  modified_base (247)..(247): a, c, t, g, unknown or other
  misc_feature (247)..(247): n is a, c, g, or t
  modified_base (439)..(439): a, c, t, g, unknown or other
  misc_feature (439)..(439): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctcgtgggtcccagggtccaggtggggatgttgtgatgactcagtctccgctctccctgcccgtcaccgttgacaggccgcctccatctcctgcgaggtctagtcagacgcctcgtaccncgaggtgagtacggaaccaccgtccgttgaaacgtggacttacgagcgaggacggccaacgggcccaaacccgtccggacggaccgtaccttaaattttagtaagttaacttttacgttaacgtcggggttaccggtttcccggggtaccaaggacctagtacttacgcgggcggtcgagggttcggtacgnggtcctaacgtgttactttaccgagtcgtaggaacgatcggaggtacggaggggtgggacggtacggtaggaagggttgttacggggtttaggttcgggtttttaaacgttccggtacgggtccgttaggtacggtaacggtttacgttatttacccgttagggttcccgggaccgggtttagggtaccccggttaccgggaacgggtaaccgggtaaccgggttaaacggggtaacggtaaaacggttaacccggaaaacggttaccggttaggggttaccggaaccgtccgggtaaccgtaccgttactttacccggg

SEQ ID NO: 211630 - DNA, 731 bp, Homo sapiens
  misc_feature: GYAE6OF02JMTSZ.26.26.C04.1.454.CMB.1.raw
  modified_base (127)..(127): a, c, t, g, unknown or other
  misc_feature (127)..(127): n is a, c, g, or t
  modified_base (259)..(259): a, c, t, g, unknown or other
  misc_feature (259)..(259): n is a, c, g, or t
  modified_base (316)..(316): a, c, t, g, unknown or other
  misc_feature (316)..(316): n is a, c, g, or t
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (363)..(363): a, c, t, g, unknown or other
  misc_feature (363)..(363): n is a, c, g, or t
tcagagactatactcacgaccggtgctcgatttagtctagcgactttgggttttggggggagggaactgctcagttaggacccagagggaaccatggaagccccacgctcagcttctcttcctcctnctactctgctcccagacttccaccggagacattgttttgacacacgtcctccacgcccacccttcgttcttttgtccttccggaacgggggtaaagacggccaaccctccttcctcgcgaggccagtcacgngtgttggcgagactacttgccgtcgaccaacacgtaaccgtcggaccgagcctaccncgcctccncatcatnatncnctaccaacgacgggccactcgacctcnccgacgtacctacggtcctaggtcggactacggtagtacgacggttcggtaacgtaccgtacttccgtaccttacccgttacaccctcggtaactacgaccgtaccgtacgtaaccgtaccggtaaaccggtacgtaaacgttagtttacctaccgtttaacttttaaccgtttattaaccggttcgacgccgtaggtaaccgtacgtaccgtacgttacccgtcctttccgtaccgtttaaccgtttccggggaccgggtacgggtaacggggagggttacggtaacggtccgtacggaaaccgtaccggttaacggtaccggttgtacccggtacggcccgtaagttcccgtacgtttcttacccg

SEQ ID NO: 211631 - DNA, 663 bp, Homo sapiens
  misc_feature: GYAE6OF02FNU8P.26.26.C04.1.454.CMB.1.raw
  modified_base (137)..(137): a, c, t, g, unknown or other
  misc_feature (137)..(137): n is a, c, g, or t
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (270)..(270): a, c, t, g, unknown or other
  misc_feature (270)..(270): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
  modified_base (547)..(547): a, c, t, g, unknown or other
  misc_feature (547)..(547): n is a, c, g, or t
tcagagactatactcacgaccggtgctcgatttagtctagcgactttgggtttgggggagataaaagctcagctctacccttgccttgactgatcaggactcctcagttcaccttctcacaatgaggctccctgctnagctcctgggctgctaatgctcgtcggtccagggtccaggtggggatgttgtgatgactcgagtcnccgtctcctaccncgtcccgtctcccgttggacacggccgtcctccgatcctctgctacggtctagnacgacgccttacgtacacgagtggacgtcgggaacctacgaccgtttagaacgtcggttaatcgacgagacggtacggcccgacgggaaccctaaccccggtcgacgggtccctaccttaagtttaacaagttaccttttacgaagttacggggtcgtacccgggggtacctaagaccgaggtactacggacgcgggtacagggttcggagacgtcgacgtagtccttacgacgtacgtgaacgtctanacggnggtcgggaggcgtagaggtggtnttaggttacgttacgttttagtcttccgacgttagacgaggtttaacgacgttacgcccggttagggaccgttacgggacgtaccgggtaaccgaagggaaccggtaaggtaacgg

SEQ ID NO: 211632 - DNA, 801 bp, Homo sapiens
  misc_feature: GYAE6OF02FOR9Z.26.26.C04.1.454.CMB.1.raw
tcagagactatactcacgaccggtgctcgatttagtctagcgactttgggtttgggggagataaaagctcagctctacccttgccttgactgatccaggacctcctcagttcaccttctcacaatgaggctccctgctcagctcctggggctgctaatgctcgtcgggtcccagggtccaggtggggattggtgtgatgactcagtctccgctcctccctgtccccgtccacccttgggactacggccggcctccgatcctccgtgacgtacggtctacggtacaaggtacgtacccgttactaacgcgtacggtagaggttaccggggaacccacccggtaccgttacggaaacgtggtaacttaccgaacggttaccgacgggtacggtacccgtaacgggtacccctaaaccccggtccggtaacgggtcccctaaccgtttaaatttaacggtaaacggttactttttaccggaaacggtttaccggggtaaccggtttacccggggggaacccctaagggaaaccccgtaggttaacctttcccgggtaaacggccgggtaaccgtagggtacgggtaccgtacgggtactaccggttagtaccgtttaccgaaccggttcgtaggaaacgttcgtacggagtaccgggagggtaggaacggtcggacggagggttacgttcggtttcgggttacgtttacgttacgttccgtacgtgtacgtacgtaaggttactcggacgttacgggccgttacgggtcttaccggggacgaacgggttaccggaaggtaacgg

SEQ ID NO: 211633 - DNA, 632 bp, Homo sapiens
  misc_feature: GYAE6OF02JCB1H.26.26.C04.1.454.CMB.1.raw
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (505)..(505): a, c, t, g, unknown or other
  misc_feature (505)..(505): n is a, c, g, or t
tcagagactatactcacgaccggtgctcgatttagtctagcgactttgggtttgggggtacgtggatcaggactcctcagttcaccttctcacaatgaggctccctgctcagctcctggggctggctaatgctctgggtcccagggtccaggtggggatggttgtgatgactcagtctccgctctccctgccctcacccttggacctaggcggcctccatctcctgactacggtacagtcacgncccgtcacacngtganggacaccgctgacngtattcgagcagacgaccgacgccaaccgtccgacggccgtactaacttaataagtacttactaacgtcggtacgtccgggtccacgtacagactgcgacgcgaggtcggtacgacgcactgtatttccgacgtacaggaacgtactcgtacgacggtagggtcggacgggacgtaggtcgggttagtggttcgggttacgtttacgttacgcgtactgggtacaacggtnttaacgtacgtccgtcgggtacgttgggtaccggtacgggaccggtacggaacggtaaccgggaagtaaaccgtacgaaaccggtacgttacggacgggttacgtacgcccgtaacgtaccgttacg

SEQ ID NO: 211634 - DNA, 861 bp, Homo sapiens
  misc_feature: GYAE6OF02HKCON.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctctcgggtcccagggtccaggtggggactggttgtgatgactcagtctccgctcctccctgcccgtctaccgttggaccgaggccggtcctacctatccgtccgtgaccgtaggtcctagtccgaagtcgcctcgtacacgagtgacgtacggaacgaccgtcttggaactcggtagttaccagccgaggacggaccgaccggcctaaaccgccgacggcgtacccttaatttaagaacggttacttactacgttacgggtacgttacccgggtaccgacgacgtaacgtacttacgacggtaccgggtactagggttacgggtcacggtaccgtaacgttcggtacttttaccggaccgtacgtaacggtaacgacgtaccgtagggacgtacggggacggtacggtaccggtagtaagggttcgtacggttttgggttaaccgggttttaacgttacgtcggttaccgttacggtacgttaaacgggtacgttacggttaacccgttaccggtaccgggttccgggttaaccgggtttacccggggtttacccggggaacccggggttaaacgggggttaaacccccggggtaaaggggtttaaacccgggtttaaaaccggaacccgggtttaaaaacccggtaaaccggtttaacccgggggttaacggggtaacccgggtttaaccccgggtaacccgttaaccgggtaacccgttttaaccccgggg

SEQ ID NO: 211635 - DNA, 705 bp, Homo sapiens
  misc_feature: GYAE6OF02I9EDS.26.26.C04.1.454.CMB.1.raw
  modified_base (283)..(283): a, c, t, g, unknown or other
  misc_feature (283)..(283): n is a, c, g, or t
tcagagactatactcacgaccggtgctcgatttagtctagcgactttgggtttgggggactgatcaggactcctcagttcaccttctcacaatgaggctccctgctcagctcctggggctgctaatgctctgggtcccagggtccaggtggggatgttgtgatgactcagtcctccgctcctccctcggccctctacccgttggacgaggccggccctccatcctccgtgtcgacggtactacgtcaggacgtccctacgtacacgagtgagtacgggaaccnccgtccttagaactggtactcgagcgaggacggaccacggcccaaccgtccggacggtccgtaaccttaatttaacgtaagtacgtttactaacgggtcgggtaccggttacccggggtaccaggaaccgtacggtacttaccggacggtccgggtacgtcggggttacgggtaccgaaggtcctaacgttacgttacgttccgacggtcgttacgaagtactacgacggtacgggagggtacggtaggcgtaggtaaggttgttaggttcggttaagttcttacgtgtaccgtggactaggtacttacgtcccgaccgttcggtacggtacggtacggtaccggaacggacggtaacggtaaggtaaccgtaacggtaaacgtacgtacggtcggtcgtacgaccgtactacgtcgtaccg

SEQ ID NO: 211636 - DNA, 857 bp, Homo sapiens
  misc_feature: GYAE6OF02F8ZRP.26.26.C04.1.454.CMB.1.raw
tcagagactatactcacgaccggtgctcgatttagtctagcgactttgggtttgggggactgatcaggactcctcagttcaccttctcacaatgaggctccctgctcagctcctggggctgctaatgctcgtgggtcccagggtccagtggggattgttgtgatgactcgagtcctccgctcctccctcgcccgtccacccttaggacacggccggccctaccacttcctcctgctagggtcctagtccagacgtcctacgtacactaggtgtaagtacgggaacccgacccgtaccgttagaaacgttggtactttacgacgacgagggaccggcccgaacggacccctaaaccggtccccgggaacgggtacccgtaaccctttaaaagttttaagtaaaacgtttacgttttaacgtaaggtaccggggttacggtttaccccgggggtaccccgaaggtaaccgtaaggttactttacggacggcccgggtacgtagggttacggggtaccgagggtcccaagtttacggtaacctttccgaaccggtacgtacggaaagtccgtaccgaggtacgggtaacggggtgggacggtaccgggtaggtaaggtaggttttccgggttagttacgggtttttaacgtacccgttgggtcccgttaggaccgttaaggttcgtttaaccttacggttaaccggttcccgggtaccggttacggggtttacccggtaacccggggtacccgggtaacgggttaaaccgggtaaacggggttaacggtaaaaccgtaaccggtaaaccggttacggttacggtacgggttaccttaccggtaccaccggttacttccgg

SEQ ID NO: 211637 - DNA, 752 bp, Homo sapiens
  misc_feature: GYAE6OF01D0Q27.1.81.H04.1.454.CMB.1.raw
tcagacgagtgcgtcacgaccggtgctcgatttagtagtgtagattcgcgggggggacaatcttcatcatgacctgctcccctctcctcctcacccttctcattcactgcacaggtcctgggcccagtctgtgttgacgcagcccgccctcagtgtctgcggccccagacagaaagtcacatctcctgctcgtggaagcagcctaccaactagttagggaaataattatgtatcggtcgtaccagctacgttcccgaaggaacccgccccgagtacctcctctattcagtacgaacaaataaccgaaggacgacgtacccaaggtacgtacttaccgtacgtaccgtatttccgtcgtcggtaccctaccgtaacggttccgtacggaccctacccgtccgaaccgcccccgtaaccccgttcggaccctaacgtacccgaaccccggtactacccgaggtaccgggtggggaacccggacgggtacccgtaagtttaacgttacggtacggaaccggtaaacgtaggttaacgggtaccttacccgacggtccgtaggtacggtttgggtcggttaccgggtggggttccgggttcgggaacggggtaacgggtaccgaacggtccggtacgaccccggttcgtacggtccgaccggtacccgtacgggccgtcccgggtccccgttcggtaccctccgtcccgttcccgttacccccgtcccttcccttccttcccttcgtcccgttccg

SEQ ID NO: 211638 - DNA, 773 bp, Homo sapiens
  misc_feature: GYAE6OF02JUP93.1.81.H04.1.454.CMB.1.raw
  modified_base (95)..(95): a, c, t, g, unknown or other
  misc_feature (95)..(95): n is a, c, g, or t
  modified_base (125)..(125): a, c, t, g, unknown or other
  misc_feature (125)..(125): n is a, c, g, or t
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
tcagacgagtgcgtcacgaccggtgctcgatttagtagtgtagattcgcggggagtcccaaccaggacacagcatggacatgagggtccctgctnagctcctggggctcctgctgctctggcctntcaggtgccagatgtgacatccagtatcgacccagtctccatcccgtccctgtctgcatctaggtaggagagagntacaaccngtactacttcgaccgagggtcgagtacacggactagttacgtacttaaacgtttttaaactggtaacttacacgaacaacgtaaaaccgaagggaaacctacccggtaaggtccttagtactacgtaacgtagttacgactactaccgtaatttacgggaaaccgtacggggttaccctaagtaccgtaaaggtttccgtaagggtacggtaaggtggtacgttagggtaccggggtaaacttaaacggttacctttttaaccgttaacctaccgtaacgttaccgttagtaccgtacgtacccgtacggtacgtaaccggtacccgttaggtaacggtttattaaccggtttataaacgtttaagtttaactttcggtaacttaaccgtaaactacgttaacttacggtaacttaaccttacctttaccggttaactttcccgttaaaccgtttaacccgtccggttaacgaaccgtaagttcggtaaaccttacgaacggtaacggttacctaggttacgtacgacgtaccgtattacccgtacgtttccgtactttacccgg

SEQ ID NO: 211639 - DNA, 507 bp, Homo sapiens
  misc_feature: GYAE6OF01DO6E3.15.37.D04.1.454.CMB.1.raw
  modified_base (322)..(322): a, c, t, g, unknown or other
  misc_feature (322)..(322): n is a, c, g, or t
  modified_base (479)..(479): a, c, t, g, unknown or other
  misc_feature (479)..(479): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatattactaggtggttgcctggtatcagcagaaaccagggaagcccctaagtccctcatcaagaaggcgtctacttagagctggggtccctnaagattcagtgccggtgatctgggacagaattcactctcacatcaacagcctggaacctgatgtatttgctaacttattactgaccaacactatgatactcacccgtactacttttacggccaggggaccaagctggagatacaaaggactggtggntggcaccatctgtcttcatcctcccgac

SEQ ID NO: 211640 - DNA, 509 bp, Homo sapiens
  misc_feature: GYAE6OF01EL6ON.15.37.D04.1.454.CMB.1.raw
  modified_base (233)..(233): a, c, t, g, unknown or other
  misc_feature (233)..(233): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatnttactaggtgttggcctggtatcagcagaaaccagggaaggcccctaagtccctcatcaagaaggtgtctactttagaagctggggtccctcaagattcagcgccggtggatctgggacagaattcactctcaccatcaacagcctggaacctgatgtattttgactaacttattactgaccaacactatgatactcaccgtactactttggccaggggaccaagctaggagatacaaaggactgtggctggcacatctgtcttcatcctccgtcc

SEQ ID NO: 211641 - DNA, 545 bp, Homo sapiens
  misc_feature: GYAE6OF01CCIEM.15.37.D04.1.454.CMB.1.raw
  modified_base (233)..(233): a, c, t, g, unknown or other
  misc_feature (233)..(233): n is a, c, g, or t
  modified_base (289)..(289): a, c, t, g, unknown or other
  misc_feature (289)..(289): n is a, c, g, or t
  modified_base (322)..(322): a, c, t, g, unknown or other
  misc_feature (322)..(322): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatnttactaggtggttggcctggtatcagcagaaaccaggggaagcccctaagtccctnatcaagaggcgtctacttagagctgggtccctnaagattcagcgcggtgatcgtgggacagaattcactctcaccatcaacagcctaggaacctgatgtattttgactaacttattactgacctaacactatgatactacctaccgttactacttttcggccgtacggggaccaaggcgtagggaacgtagtacgaaagtaacgtggtcggctaggccaccattcgttacgttcttacacttccgttccccgtacc

SEQ ID NO: 211642 - DNA, 520 bp, Homo sapiens
  misc_feature: GYAE6OF01DNTNA.15.37.D04.1.454.CMB.1.raw
  modified_base (234)..(234): a, c, t, g, unknown or other
  misc_feature (234)..(234): n is a, c, g, or t
  modified_base (292)..(292): a, c, t, g, unknown or other
  misc_feature (292)..(292): n is a, c, g, or t
  modified_base (331)..(331): a, c, t, g, unknown or other
  misc_feature (331)..(331): n is a, c, g, or t
  modified_base (508)..(508): a, c, t, g, unknown or other
  misc_feature (508)..(508): n is a, c, g, or t
tcagtctacgtagccacgaccggtgctcgatttagtagcatactgttgggtttgggggagtcagacccagtcaggacacagtcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatnttactaggtggttggcctggtatcagcagaaaccagggaacggcccctaagtcccctnatcaagaaggcgtctactttagaagtcgtggggtccctnaagattcagcgccggtggatcgtgggacagaattcactctcaccatcaacagcctggaacctgatgtattttgactaacttattactgaccaacactatgatactcacctactactttggccaagggaccaagctaggagagtacaaaggaactgtcggctgcacctatctgttctntactcctccgcc

SEQ ID NO: 211643 - DNA, 573 bp, Homo sapiens
  misc_feature: GYAE6OF01C2Z29.15.37.D04.1.454.CMB.1.raw
  modified_base (335)..(335): a, c, t, g, unknown or other
  misc_feature (335)..(335): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtacaaaatattactaggtggttggcctggtatcagcaagaaaccaggggaacgcccctaagtcccctcatcaagaacggcgtactactttagaagtcgtggggtccctanaagattcgagcgccggtgatcgtagggacagaattcactctcaccatcaacagcctaggaacctgatagtatttgactaacttattactcgaccaactactatagtactactaccacccgtactacgtttacggaccgtagggaccaagcgtaggaagtacgtaacgaaacggtaacgtaggtcggtacgtacggtccacctagttcgtcgttacttactacttccgttcccgtaccc

SEQ ID NO: 211644 - DNA, 572 bp, Homo sapiens
  misc_feature: GYAE6OF01CQBP2.15.37.D04.1.454.CMB.1.raw
  modified_base (233)..(233): a, c, t, g, unknown or other
  misc_feature (233)..(233): n is a, c, g, or t
  modified_base (287)..(287): a, c, t, g, unknown or other
  misc_feature (287)..(287): n is a, c, g, or t
  modified_base (318)..(318): a, c, t, g, unknown or other
  misc_feature (318)..(318): n is a, c, g, or t
  modified_base (322)..(322): a, c, t, g, unknown or other
  misc_feature (322)..(322): n is a, c, g, or t
  modified_base (367)..(367): a, c, t, g, unknown or other
  misc_feature (367)..(367): n is a, c, g, or t
tcagtctacgtagccacgaccggtgctcgatttagtagcatactgttgggtttgggggagtcagacccagtcaggacacagcatggacatgggggtccccgctcagctcctggggctcctgctgctctggctcccaggtgtcatgtgtgacatccagatgacccagtctccttccaccctgtctgcatctgtaggagacagagtcaccttcacttgccgggccagtcaaaatnttactaggtggttggcctggtatcagcagaaaccagggaagccctaagtccctnatcaagagctctacttagagctgggtccctnaagnttcagcgcgtgatcgtgggacagaattcactctacaccatcaacngcctaggaacctgatgtatttagactaacttattaactgacctaacactaatgtactactcaacccgttactaccgttttacggaccgtacggggtaccaaggtacttagggacgtacgtacgaaaaggtaaccgtaggtacgggtctaggacctaccctattaccttcgttacctttctacttacccgttccccgtaccgtacg

SEQ ID NO: 211645 - DNA, 503 bp, Homo sapiens
  misc_feature: GYAE6OF01E232N.15.37.D04.1.454.CMB.1.raw
  modified_base (233)..(233): a, c, t, g, unknown or other
  misc_feature (233)..(233): n is a, c, g, or t
  modified_base (461)..(461): a, c, t, g, unknown or other
  misc_feature (461)..(461): n is a, c, g, or t
  modified_base (493)..(493): a, c, t, g, unknown or other
  misc_feature (493)..(493): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatnttactaggtggttggcctggtatcagcagaaaccagggaaggcccctaagtccctcatcaagaaggcgtctactttagaagctgggtcccgtcaagattcagcgccggtggatctgggacagaattcactctcaccatcaacagcctggaacctgatgattttgctaacttattactgccaacactatgatactcacccgtacactttggccagggaccaagctgganatcaaaggaactgtgctgcaccatctgtcttncttctcccgc

SEQ ID NO: 211646 - DNA, 547 bp, Homo sapiens
  misc_feature: GYAE6OF01DXF5V.15.37.D04.1.454.CMB.1.raw
  modified_base (233)..(233): a, c, t, g, unknown or other
  misc_feature (233)..(233): n is a, c, g, or t
  modified_base (288)..(288): a, c, t, g, unknown or other
  misc_feature (288)..(288): n is a, c, g, or t
  modified_base (325)..(325): a, c, t, g, unknown or other
  misc_feature (325)..(325): n is a, c, g, or t
  modified_base (383)..(383): a, c, t, g, unknown or other
  misc_feature (383)..(383): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatnttactaggtggttggctggtatcagcagaaaccagggaacggcccctaagccctnatcaagaaggctctactttagaagcgtcggggtcccnaagtattcgagcggccggtggatcgtagggacagaattcgactctacaccatacaacngccgtagaacctgactgtatttgactaacttagtactgaccaatactatgactactccaccgttactactttggaccgtaacgggaccaagccgtaggaacgtataacgaaaggtactggtgacttgccacctatcttcgtacttacaacttcccgtcccgtac

SEQ ID NO: 211647 - DNA, 523 bp, Homo sapiens
  misc_feature: GYAE6OF01EZQO0.15.37.D04.1.454.CMB.1.raw
  modified_base (233)..(233): a, c, t, g, unknown or other
  misc_feature (233)..(233): n is a, c, g, or t
  modified_base (324)..(324): a, c, t, g, unknown or other
  misc_feature (324)..(324): n is a, c, g, or t
  modified_base (466)..(466): a, c, t, g, unknown or other
  misc_feature (466)..(466): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatnttactaggtggttggcctggtatcagcagaaaccagggaagcccctaagtccctcatcaagaaggcgtctactttagaagctgggtccctnaagattcagcgccgtgatctgggacagaatcactctcaccatcaacagccctggaaccctgactgtattttgactaacttattactgaccaacactatgatactcacccgtactactttggccgtagggacccaagctgganagtacgaaaaggtactgtcggctgccaccgatctgtacttcacttccttcccgtacc

SEQ ID NO: 211648 - DNA, 609 bp, Homo sapiens
  misc_feature: GYAE6OF01C8151.15.37.D04.1.454.CMB.1.raw
  modified_base (417)..(417): a, c, t, g, unknown or other
  misc_feature (417)..(417): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccggccagtacaaaatatacgtaggtggttggcctggtatcagcaagaaccgaggggaacggcccctaacgtcctacactaccgaagaacggtccgttaccttaacgtttaagaacggtccgtcgggggtacccctacaagtacttacgacggcggccgggtggagtcgtagggacagtaacttcactctcacatacaacncgcctacgaactgatgtatttgactaacttacttactacgtaccaactactatatactactcctacccgtactacgtttcggaccgtacgggaaccgaagtacgtacggagtaactaacgaaacggtaacgtacggtcggacgtacggccacgtacttacgttcgttacttactaccttcccgtcccgtacc

SEQ ID NO: 211649 - DNA, 517 bp, Homo sapiens
  misc_feature: GYAE6OF01CI0YZ.15.37.D04.1.454.CMB.1.raw
  modified_base (324)..(324): a, c, t, g, unknown or other
  misc_feature (324)..(324): n is a, c, g, or t
  modified_base (507)..(507): a, c, t, g, unknown or other
  misc_feature (507)..(507): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatattactaggtggttggcctggtatcagcagaaaccagggaagcccctaagtccctcatcaagaaggctctactttagaagctggggtccctnaagattcagcgccggtggatctgggacagaacttcactctcaccatcaacagcctggaacctgatgtattttgctaacttattactcgacctaaacactatgaatactaccaccgtactactttggccgtagggaccaagctaggagatacgaaaggaactgtggctcgcacatctgtcttanctctcccgcc

SEQ ID NO: 211650 - DNA, 576 bp, Homo sapiens
  misc_feature: GYAE6OF01CCYBR.15.37.D04.1.454.CMB.1.raw
  modified_base (291)..(291): a, c, t, g, unknown or other
  misc_feature (291)..(291): n is a, c, g, or t
  modified_base (330)..(330): a, c, t, g, unknown or other
  misc_feature (330)..(330): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtacaaaatattactaggtggttggctggtatcagcaagaaaccagggaacgcccctaagtcccctnatacaagaaggcgtctactttagaagctggggtccctanaagattcgagcgccggtgatcgtgggacagaattcactctcacatcaacagcctgaacctgatgtatttgactaactttattactacgacctaactactatagtaactactacctaacccgttaactaccgttttcggacccgtaacggggaaccaagcgtaggaagtacgtaacgaaaacggtaacgtagtaggtactacggaccaccgtatcttacgttacttactacttcccgttcccgtacc

SEQ ID NO: 211651 - DNA, 550 bp, Homo sapiens
  misc_feature: GYAE6OF01BSRLN.15.37.D04.1.454.CMB.1.raw
  modified_base (329)..(329): a, c, t, g, unknown or other
  misc_feature (329)..(329): n is a, c, g, or t
  modified_base (381)..(381): a, c, t, g, unknown or other
  misc_feature (381)..(381): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatattactaggtggttggcctggtatcagcagaaaccagggaacggcccctaagtccctcatcaagaaggcgtctactttagaagtcgtggggtccctnaagattcgagcgccggtggatcgtgggacagaattcactctcaccatcaacngcctagacctgatgtatttgactaacttattactgacctaacactatagactactcctaccgttattacgtttcggaccgtacgggtaccaagcgtaggacgtatacgaaaggtacgtggtcggctacgcacctattccttcgttacttactacttccgttcccgtacc

SEQ ID NO: 211652 - DNA, 997 bp, Homo sapiens
  misc_feature: GYAE6OF01DX5N6.15.37.D04.1.454.CMB.1.raw
tcagtctacgtagccacgaccggtgctcgatttagtagcatactgttgggtttgggggagtcagacccagtcaggacacgagcagtggactagtggacgggtccccgctcagctcgtgggcctccgtgctgctcgtggcctccgaggtcgacctagtggtgtacgactactaccgaagtacgtaccgacccgtacgttcccttcccgttaccctacccgttcggttcctacgtacctacttcgtaggtaacggaacgtacgaaggtaccgtaccgtaccgtttaccgtacggttccgggacccggtaccgtaaacgttaaactaaaaagttacgtttaacggttagggggttcgggtttaccggtacccgtttaagggttaacctaccggaaacggtaaccgtaaaaaccgggtaaaaacccggggaacgggggtaaacccccggttaaacccccccgtttaaaaccggttcccccctaaggtttaaacccgtaaacccggaaaaagggggtaacccgggtttacccgttttaaaccgttttaaaacggtttttaaaaccgggaaaccgggtttcccgggggtttaaccccgggggtttacccccgtaaaagtaaaacgtttacggtttaccggaccgggtcccgggtacccggggttaaggtaccgttacggggtaaacggggaaacctaaaggtttacccgtttaccgtaaccgttacccgttacccgaaaaacccttacgttaaacccgaaaccgtcccgggtaccgtaaccggtaaccgttagtaacgttacgttagtttacgtaaccttaacgtttacttaccgtacgaacctaacgtatacgtacgtactacctaccgtaacgttaccgttacgtttccgaccggtaacggaacgtacgacggtagacgtaacgaacgtaaaggtactcgggtacgtacgacgtacctactacgttcgttacgttactaccgtccttcccgtcccgtaccg

SEQ ID NO: 211653 - DNA, 550 bp, Homo sapiens
  misc_feature: GYAE6OF01BDQYZ.15.37.D04.1.454.CMB.1.raw
  modified_base (233)..(233): a, c, t, g, unknown or other
  misc_feature (233)..(233): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatnttactaggtggtggcctggtatcagcagaaaccagggaagcccctaagtccctcatcaagaaggcgtctactttagaagctggggtccctnaagnttcagcgcggtgatcgtgggacagatcactctacacatacaacacgcctagaacctgatgtatttgactaacttattactgacctaacactatagactacctacctacccgtactacgttttacggaccgtacggggaaccaaggcgtaggaagacgtacgaaaacggtacgtaggtacggtactggaccacctatctacgtcttacacttcctcccgtacc

SEQ ID NO: 211654 - DNA, 660 bp, Homo sapiens
  misc_feature: GYAE6OF01BNWS0.15.37.D04.1.454.CMB.1.raw
  modified_base (286)..(286): a, c, t, g, unknown or other
  misc_feature (286)..(286): n is a, c, g, or t
  modified_base (325)..(325): a, c, t, g, unknown or other
  misc_feature (325)..(325): n is a, c, g, or t
  modified_base (350)..(350): a, c, t, g, unknown or other
  misc_feature (350)..(350): n is a, c, g, or t
  modified_base (381)..(381): a, c, t, g, unknown or other
  misc_feature (381)..(381): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttcgccggcagtcaaaatattactaggtggttgcctggtatcagcagaaaccagggaagcccctaagtccctnatcaagaggcgtactactttagaagcgtgggtcccgtanaagacttcgagcgccggtggatcgngggacaggaacttcactctcaccatcaaacngcctgaacctgatgtatttgactaacttacttactcgacctaaactactagtacgtaatacctacctaacccgttaacttaccgtttttacgggaccccggtaacggggtaacccgtaaacggtccgtagggtaacccggtaagtaaccgtaaaaacggggtaaccttacggggttaaccgggaccgttacgggaaccccgttaacccgtaacgtttacccggttacggttttaccctttaccgtaacccttttccccggttcccccccgttaaacccg

SEQ ID NO: 211655 - DNA, 607 bp, Homo sapiens
  misc_feature: GYAE6OF01COKAF.15.37.D04.1.454.CMB.1.raw
  modified_base (347)..(347): a, c, t, g, unknown or other
  misc_feature (347)..(347): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacgttgccgggccagtacaaaattattacgtaggtggttgcctggtatcagcaagaaaccgaggggaacgcccctaagtccctacatacgaagaaggcgtactaacgtttagaacgtcgtcggggtccctagaagnttcgaggcgccggtggatcgtagggacagtattcactcacacatcaacagtcctacgaacctgatgtatttacgactaactttatactcgaacctaacactatacgtactacctacctacccgttactaccgtttacggaccggtaacgggaccaacggtacgtacggtaagacgtacgaaaaggtacgttaggtcggtacgtacggaccaccgtagttaccgttacgttaccttacttaccttcccgttccccgtaccg

SEQ ID NO: 211656 - DNA, 591 bp, Homo sapiens
  misc_feature: GYAE6OF01BQJQN.15.37.D04.1.454.CMB.1.raw
  modified_base (232)..(232): a, c, t, g, unknown or other
  misc_feature (232)..(232): n is a, c, g, or t
  modified_base (336)..(336): a, c, t, g, unknown or other
  misc_feature (336)..(336): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccggccagtacaaatnttactaggtggttgcctggtatcagcaagaaaccgagggaacggcccctaagtcccctcatcaaggaaggcgtactacgtttagaacgtcgtcggggtccctanaaggtattcaggccgccggtgatcgtagggacagattcactctacaacctataccaacacgcctacggaactgatagtatttcgactaacttattactacgtaccaactactatagtactacctacctacccgtactacgtttacggaccgtacgggaccaagtacgtaggacgtacgtaacgtaaacggtaacgtcggtacggtacgtcgacctacctattccgtacttaccttactacttcccttcccgtacc

SEQ ID NO: 211657 - DNA, 583 bp, Homo sapiens
  misc_feature: GYAE6OF01BI5ZZ.15.37.D04.1.454.CMB.1.raw
  modified_base (292)..(292): a, c, t, g, unknown or other
  misc_feature (292)..(292): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (397)..(397): a, c, t, g, unknown or other
  misc_feature (397)..(397): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggcagtacaaaatattactaggtggttggcctggtatcagcaagaaaccagggaacgcccctaagtcccctanatacgaagaggtcgtctacgtttagaagtcgtcggggtccctanaagnttcgagccggaccggtgactcgtaggggacagtaacttcactctacacatacaacgngtccgtagacctgatgtatttgactaacttacttactcgacctaactactatagactactacctaccgtactacgtttacggaccgtacggggaacctaagtcgtaggaacgtagtaacgtaaacggtaacgtggtacggtctacgaccacctagtcttcgttacttactacttccgtcccgtacc

SEQ ID NO: 211658 - DNA, 650 bp, Homo sapiens
  misc_feature: GYAE6OF01DZHN5.15.37.D04.1.454.CMB.1.raw
  modified_base (324)..(324): a, c, t, g, unknown or other
  misc_feature (324)..(324): n is a, c, g, or t
  modified_base (369)..(369): a, c, t, g, unknown or other
  misc_feature (369)..(369): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatcgacccagtctcctccaccctgtctgcatctgtaggagacagacgtctaccttcacgttcggccgggacctaacgtactaaaattattacgtagggttgggttcggccttagggtaactcgaacgacgaacgaaaccggaggggaacgtcccctaagtcccctanatacgaaggacggtcttactacgttagacgtcgtcgggtacctanaagtctacgacgcgccggtgatcgtagggactagactcactctacactatccaaacgtcgtccgtacggacctagtagtagttatttacgactaacttattactcgtactaactactactactactactaccgtacctacgttacgtttcggaccggtaacgggtaccaacggtacgtacggaacgtacgtaacgtaaacggtaacgtcgggtacggtacgtacgtaccgtaccgtacttccgttacgttaccgttaccttaccttcccgtcccgtacccg

SEQ ID NO: 211659 - DNA, 627 bp, Homo sapiens
  misc_feature: GYAE6OF01A094W.15.37.D04.1.454.CMB.1.raw
  modified_base (287)..(287): a, c, t, g, unknown or other
  misc_feature (287)..(287): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtctaccttcacttgccggccagtacaaaatattactaggtggttgccttggatcagcaagaaacaggacgaccctaagtccctnaatacgaagacggtctaccttagtttagaagtcgttcggggtcccctagaagtacttacgaacggcccggtacgggtacggagtacgtacggggaactaagtaacttcgaacctctaccaacctactaaccgaaacgtacgtaccgtacgtaacctacgtattagttaatttcgtacttaacttacttactacgtacctaactaacttatagtactactacctaccgtactacgtttcgacgtacggaccaagtcgtacgagacgtaacgaaggaacgttaggtcgacgtacgaccgtacctattacttcgttaccttacactttcccgtcccgtaaccg

SEQ ID NO: 211660 - DNA, 647 bp, Homo sapiens
  misc_feature: GYAE6OF01CPU18.15.37.D04.1.454.CMB.1.raw
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtcctccttccaccctgtctgcatctgtaggagacagagtcaccttcacttcgccgggccaagtacaaaattattacgtaggttggttggccttggtatcagcaagaaaccagggaacgacccctaagtcccctnactacaagaagcgtactacgttagagcgtggggtccctanaagtattacgacgccggtccgggtggactcggtacggggactaagtaacgttcacttctaccacatacaaacacgtaccctaggtaaccctgtaattcgttattttacgacttaactttaacttacctacgaaccctaaacgtactaacttacgtaacttacctacctaaccccgttaacttaccgttttacgggacccgtaaggggaacccaagtcggtaggaacgtagtaacgaaacggtactagggtcggtcgtacgaccaccgtacttacgttcgttacttccgtacttccccttcccgtacc

SEQ ID NO: 211661 - DNA, 747 bp, Homo sapiens
  misc_feature: GYAE6OF01B5KL0.15.37.D04.1.454.CMB.1.raw
tcagtctacgtagccacgaccggtgctcgatttagtagcatactgttgggtttgggggagtcagacccagtcaggacacagcatggacatgagggtccccgctcagctccgtggggctcctgctgctctggctaccaggtgccatgtgtgacatccagatgacccagtcctcccttccaccctgtctgcatctgtaggagacagagtcaccttcacgttcggccggaccagtaactaaaattacgttaacgtagggttggttcggccgttaggtatcgaacgacaaacggaaaccgacggggaaccgtacccctaacgtcccctacactacgaaggaacggtctacgttaacgttagaacggtcggtaccggggtacccgtagaacgtcgttaccgacggccggtcgggtaggtacgtcggtaggggaacctaaggtacttaccacttacacctaaccataccgaacacgtaccgtacggaacctgtagttacgttagtttacgtacttaacttacgttacgtaccgtaacctaactacttacgtacgttaactaaccttacccgtaacccgttaacgttaccgtttaccggaaccggtaccgggtaacctaacggtacgttaggaacgtaacgttaaaccggtaaaaccggtaacgtacggttacgggtaccgtaccgtaaccgtaacccgtacgtttaccgttaccgtttccgttaaccttcccgttccccgtaccccgttaccg

SEQ ID NO: 211662 - DNA, 589 bp, Homo sapiens
  misc_feature: GYAE6OF01BI9WL.15.37.D04.1.454.CMB.1.raw
  modified_base (233)..(233): a, c, t, g, unknown or other
  misc_feature (233)..(233): n is a, c, g, or t
  modified_base (335)..(335): a, c, t, g, unknown or other
  misc_feature (335)..(335): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatnttactaggtggttggcctggtatcagcagaaaccaggggaacgcccctaaggtcccctcatacaagaggcgttctactttagaagtcgtcggggtcccctanaagtattcagcgccggtgatctgggacagattcactctcacctataccaacacgcctaggaaccctgtattcgtattttacgactaactttattacctacgacctaacgactatagtaacttactacctaacccgtactaccgttttcggaccgtacgggtaaccaaggtctagggaatacgtaacgaaacgtacgtggtcggacctaggccactagttcctacgttccttactacttcccgttcccgtacccg

SEQ ID NO: 211663 - DNA, 590 bp, Homo sapiens
  misc_feature: GYAE6OF01EX0ZZ.15.37.D04.1.454.CMB.1.raw
  modified_base (235)..(235): a, c, t, g, unknown or other
  misc_feature (235)..(235): n is a, c, g, or t
  modified_base (331)..(331): a, c, t, g, unknown or other
  misc_feature (331)..(331): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgcccgggccagtacaaaatnttacgtaggtggttggcctggtatcagcagaaaccagggaacgcccctaagtcccctcatcaagaggtcgtctactttagagtcgtcgggtccganaagattcagcgccggtggatcgtagggacagtaacttcactctacaccatcaacacgcctaggaacctgattgtattttgactaacttattactacgacctaactacttatagtaacttacctaccacccgttacttaccgttttcggacccgtacgggaaccaagcgtaggaagtaagtaacgtaaaggtaacgtcggtcggtctaggaccctaccgtattccgttacgttccttactacttcccgttcccgtacccg

SEQ ID NO: 211664 - DNA, 663 bp, Homo sapiens
  misc_feature: GYAE6OF01A8UHE.15.37.D04.1.454.CMB.1.raw
  modified_base (240)..(240): a, c, t, g, unknown or other
  misc_feature (240)..(240): n is a, c, g, or t
  modified_base (348)..(348): a, c, t, g, unknown or other
  misc_feature (348)..(348): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatcgacccagtcctcccttccaccctgtctgctatctgtaggagacagagtcaccttcacgttcggccggcaagtacaaaatnttacgtaggtggttcgcctggtatcgagacaagaaccgagggaacgacccctaacgtcctacactacgaaggacgtcgtactaacgttagaacgtcgtcgggtcctanaagtctacgaggccggtcggtagacgtcgtagggaacagtaacttcgacttccaccactataccaacgacgtaccgtacgtactacgtattagttagtttacgtaacttaacttacttactacgtacctaactactactacgtaactacctacctacgttaaccccccccccccgttagttaccggtaccggtaacgggtaccgtaacgtacgtaggtacgtaacgtaacgtaaacggtaacgtacggtcggtacgtacgaccgtacctacgttacgttcgttaccttaccttaccgttcccgttcccgtacccg

SEQ ID NO: 211665 - DNA, 681 bp, Homo sapiens
  misc_feature: GYAE6OF01D9WXW.15.37.D04.1.454.CMB.1.raw
  modified_base (238)..(238): a, c, t, g, unknown or other
  misc_feature (238)..(238): n is a, c, g, or t
  modified_base (350)..(350): a, c, t, g, unknown or other
  misc_feature (350)..(350): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatcgacccagtcctccttccaccctgtctgcatctgtaggagacagagtcaccttcacttcggccgggccagtacaaaatnttacgtaggtggttgcctggtatcagacaagaaaccgaggggaacgcccctaagtcccctacatacgaaggaacggtcgtactactttaagaacgtcgtcggggtaccctanaagtattcgagcggtccggagagtcgtagggactaagtaacttccacttcaccaacctataccaaacgcgtaccgtagaacctgtacgttagtatttagacttaactttacttactacgaacctaactaacttagtacgtactacgtaccctaacccgttacgttaccgtttccgggaccgtaacggggtaacctaacggtaccgttaacgggaagtaaccggttaaaccgaaaacggtaaaccggttacgggtacggtacgttacgacccgtaaccctacgttccgttacgttaccgttacccttccgttacccgttccccggtaacccc

SEQ ID NO: 211666 - DNA, 720 bp, Homo sapiens
  misc_feature: GYAE6OF01CRHJV.15.37.D04.1.454.CMB.1.raw
  modified_base (319)..(319): a, c, t, g, unknown or other
  misc_feature (319)..(319): n is a, c, g, or t
  modified_base (516)..(516): a, c, t, g, unknown or other
  misc_feature (516)..(516): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatcgaccagtctccttccaccctgtctgctattcgtaggtaggagacagacgtctaccttcacgttggccgggaccagtactaaaattacgttacgtagggttggttcggccttggtactcgagacgaacgaaaccgagggaaccgcccctaacgtccctanaacgtacgaaagtacggtctactttaacgttacgaacgtccgttcgggggtacctacgaaagtcttacggacgtccgggtccgggttagacttccgggtagggaacctaaggtaacctcgtaactcgtacctaacctagtaacaacgtacgaccgtacggaactgtagtagttattacgtacttaacttacttaacncgtaaccctaactaacgttactactaacctactaccgtaacccgttactaacggtttcggaaccggtaacgggtaacccgaaggttccgaaggactaacggttaacgaaaacggtagtttacggcggtaaccgttcgaccgttaacccgacgtttaccggttaccttacgttaccgttaccctttcccgtaccccgttaacccg

SEQ ID NO: 211667 - DNA, 583 bp, Homo sapiens
  misc_feature: GYAE6OF01CVYGA.15.37.D04.1.454.CMB.1.raw
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccggccagtacaaatattacgtaggtggtggcctggtatcagacaacgaaaccgagggaacgcccctaagtcccctcatacaagaggcgtactacgttagagtcgtcggggtccctagaagattcgagcgcggtgatcgtaggacagtatcactcncacatacacncgctagacctgatgtatttacgtaacttatactgacctaactactatagtactactacctacccgtacttacgtttcggaccgtacggggaccaaggtcgtaggacgtaagtaaccggtaaaggtacgttggtacggtccgtagacctacccgtacttacgttacgttacctttcgacctttccccgttcccgccttaacg

SEQ ID NO: 211668 - DNA, 698 bp, Homo sapiens
  misc_feature: GYAE6OF01AXW6A.15.37.D04.1.454.CMB.1.raw
  modified_base (304)..(304): a, c, t, g, unknown or other
  misc_feature (304)..(304): n is a, c, g, or t
  modified_base (413)..(413): a, c, t, g, unknown or other
  misc_feature (413)..(413): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacgttcgcccgggaccagtacaaaatattaacgtagggtgttggcctaggtatcgagcgaagaaacgagggaccgacccctaacgtcccctanacgtacgaaaggacggtctacttaacgtttaggaacgtcggtcggggtccctagaacgtacttcgaggtccggccggtagacgttcgtagggaactaggtaaccccttnaaccttctacctaacctataccaacgtacgaccgtacggtaacctagtagttagtattttacgaaccttaacgtttaacttacctacgtaacctaaactacgttaatacgtaacttacctacctaacccgttacttaccggtttcggaacccgggtacgggtaacccgtaacggtaccgtagggaacgtaacgtaacgaaacggtaacgtacggttacggtcgtaacgtccctaaccgttacttacggttacttacgttacctaccgttcccgttacccgtaccc

SEQ ID NO: 211669 - DNA, 723 bp, Homo sapiens
  misc_feature: GYAE6OF01BV0NG.15.37.D04.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtagganacagagtcaccttcacttgcccgggcagtacaaatattacgtaggtggttggcctggtatcagcaagaaaccgagggaacgcccctaagtccctanatacgaagacggcgttactacgtttaggaagtccgtacggggtccctacgaaagtactttcgaggtccggtaccggggtggaattcggtaggggaacaggtaaacttccgaacctccgtaccaccaattaccaaacgacgtcccgtacggtaaccctaggtagttagttaacgtttttcgaacttaaccgtttaactttaaccgttacgtaaccctaaactacttaagttacgtaacttaacctaccctaaccccgttaacgttaacccgttttacggacccggtaaccggggtaaccgaaacggtacggtacgggtaacgtacgttaaacggaaacggtaaaccgttcgggtaccggtacgttaccgaccgtaacccgtacgttaccgttcgttaccctttactaccgtttccccgttccccggtaccc

SEQ ID NO: 211670 - DNA, 822 bp, Homo sapiens
  misc_feature: GYAE6OF01APISH.15.37.D04.1.454.CMB.1.raw
tcagtctacgtagccacgaccggtgctcgatttagtagcatactgttgggtttgggggagtcagacccagtcagtacacagcatggacatgagggtccccgctcagctcctggggctcctgctgctctggctcccaggtgccatgtgtgacatccagatgacccagtctccttccaccctgtctgcatctggtaggagacagagtccaccttcacgttcggccgggccagtacaaaattagttacgttagggtggttcggccttaggtatcgaagacaaggaaaccgaaggggaaccggaccccctaaaggtccccctactacgtaccgaaaggtaacggtccgttaccgtttaacgtttaaggaaacggtccggttaccggggggttacccccgttacgtaaaaacgggttacgtttacccggaacggaccgggttcccgggggtagggtaaacgttcggttaccgggggaaactaacggggtaaactttaccgaccgtttaccctaccgaaaccctaaagtacccgaaacgacgtacccggtacggtaaaccgttcggtaagttcggttaacttttaccggtaacttaaacctttaacgtttaacctacgtaaccctaaacctacgtaagtaactaacgtaacctacccgttaacccgttaaccgttaccggttttaccgggacccgggtaaacggggtaacccgtaacggaccgtaggaaagtacgtaacggtaaacggtaacggtcggtcggtacgtacggtacctacccgtagttccgtacgttaccgttaccttaccttcccgtttccccgtaccg

SEQ ID NO: 211671 - DNA, 699 bp, Homo sapiens
  misc_feature: GYAE6OF01CEUF1.15.37.D04.1.454.CMB.1.raw
tcagtctacgtagccacgaccggtgctcgatttagtagcatactgttgggtttgggggagtcagacccagtcaggacacagcatggacatgagggtccccgctcagctcctggggctcctgctgctctggcctcccgaggtgccatgtgtgacatccagatcgaccagtcctcccttccaccctgtctgctatcgtggtaggagacgagtatccaccttcacgttcggccggaccagtaactaaaagttacttacggtaggggttcgggttcggtcccgttagggttactacgaacgacgaaacggaaaccggaacggggtaaccgaccccgtaaccgtccccgtactaacgtacgaaacggtaacggtcgttaaccgttaacgtttaacggaacgtccggtaccggggtacccgtacgaacgtacgttacgacggtccgccgggtgtacgtcggaggaacgagtaactcgactctacgaccataccacgtacgtcctacggactgactagttattacgtaacttaacttacgtactacacctaatacctatagtacctactacccgtaacgttaaccgttaccgtttacggaccggtaacgggaaccacggtacggaggactaggtaacgaaacggtagtgtacggtacgtcgtacccacgtaccttacgtcgttactacttaccttccgtcctaccg

SEQ ID NO: 211672 - DNA, 687 bp, Homo sapiens
  misc_feature: GYAE6OF01BO3FV.15.37.D04.1.454.CMB.1.raw
  modified_base (235)..(235): a, c, t, g, unknown or other
  misc_feature (235)..(235): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgcccgggccagtacaaaatnttacgtaggtggttgcctggtatcagcaagaaaccaggggaacggcccctaagtccctcatcaaggaaggtcgtactactttagaacgtcgttcggggtccctacaagtatttccaggccgtccggggtggacgttccgtaggggaacaggtaacttcaacgtcctaccgaacctagttacccaaactacggacccgtacggtaacccgttacggtagttaggttagttttacgacttaactttaactttaacctacgtaacctaaactaacttacttacgacttaccttacctaacccggttaactaaccgtttttcggaccggtaacggggtaccgtaagtccggtacggtaacgtacgtaacgtaaaacggtaacgttcggtacggtcgtacggcgtaacccgtacgttacgtccgttacttacccgtacttccccgttcccgtacccc

SEQ ID NO: 211673 - DNA, 811 bp, Homo sapiens
  misc_feature: GYAE6OF01BLBQT.15.37.D04.1.454.CMB.1.raw
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatcgacccagtcctcccttcccaccctgtctgcatctgtaggagacagagtcctaccttcacgttcggccgggaccaagtacaaaattattacgtagggtggttcggccttggtatcgagacgaacgaaaccgaggggaaccgtaccccgtaacgtcccctacactacgaaaggacggtcgttacgttacgtttaaggaacgtcggtcggggtacccctacgaagtacttacgacggcccggtcggggtaggtacgttacggtacgggaaacgtaacgtaacttacccgtaccgttacctaccgaaccctaactaacccgaaaccgtaccggtacccgtaacggtaaaccgttaggtaacgtttacggttacttttacggtaacctttaaaccgtttaacgttacctaccgtaaccctaaacctaacgttaacgtacgtaacccttacccgttacccgtaacccgttaccgttaccggtttaccgggaacccggtaaccggggaacctaacggtcccggtaacgggtaacgtaaccggtaaacggtaaaaccggtacggttaaccgggtcggtacccttaccggtccctaaccgttaacgttcccgttaactttacccgttaccttaacccgtttcccccgtaaccccgtaccg

SEQ ID NO: 211674 - DNA, 588 bp, Homo sapiens
  misc_feature: GYAE6OF01A5421.15.37.D04.1.454.CMB.1.raw
  modified_base (202)..(202): a, c, t, g, unknown or other
  misc_feature (202)..(202): n is a, c, g, or t
  modified_base (304)..(304): a, c, t, g, unknown or other
  misc_feature (304)..(304): n is a, c, g, or t
  modified_base (347)..(347): a, c, t, g, unknown or other
  misc_feature (347)..(347): n is a, c, g, or t
  modified_base (408)..(408): a, c, t, g, unknown or other
  misc_feature (408)..(408): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatcgacccagtcctcccttccaccctgtctgcatctaggtagganacagagtacctaccttcacgttcggcccgggccagtacaaattattacgtaggtggttcgcctggtatcagcaagaaccaggggaacgcccctaagtccccnatacgaagacgctactacgtttagaagtcgtcggggtccctanaaggcttacgaggccgtcgggtgatcgtgggaacagtaactcactctcaactactacaacncgtcgtacgaacctgtatgtattcgacttaacttatactcacctaatactatacgacttacctacctaccgttactacgtttacggaccgtacgggaccacggcgtacgagactaacgaaaggtactggtcgacgccgcacctacgtcttacgtaccttacgtaccttccgtcccgtacc

SEQ ID NO: 211675 - DNA, 613 bp, Homo sapiens
  misc_feature: GYAE6OF01B7LN6.15.37.D04.1.454.CMB.1.raw
  modified_base (300)..(300): a, c, t, g, unknown or other
  misc_feature (300)..(300): n is a, c, g, or t
  modified_base (405)..(405): a, c, t, g, unknown or other
  misc_feature (405)..(405): n is a, c, g, or t
  modified_base (429)..(429): a, c, t, g, unknown or other
  misc_feature (429)..(429): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtcctccttccaccctgtctgcatctgtaggagacagagtcaccttcacttgcccgggccagtacaaaatattacgtaggtggttggcctggtatcagacaagaaaccgaggggaacgacccctaagtcccctanactacaaggacggcgtactaacgtttagaacgcgtcggggtccctagaagtattcgagcgccggtgactgtacgggacagtattcactctaccacataccaaacncgcctaggaacctgatgtactttnacttaacttattactcgacctaactactagtatactacctacctacccgtacttaccgtttacgggacccgtagggtaaccctaggcgtaggaacgtaacgtaacgaaacggtaacgtcggtggtacctcggaccaccgtacttccgttacgttaccttacccttacccttccccgacttaccg

SEQ ID NO: 211676 - DNA, 741 bp, Homo sapiens
  misc_feature: GYAE6OF01D9SV0.15.37.D04.1.454.CMB.1.raw
  modified_base (237)..(237): a, c, t, g, unknown or other
  misc_feature (237)..(237): n is a, c, g, or t
  modified_base (305)..(305): a, c, t, g, unknown or other
  misc_feature (305)..(305): n is a, c, g, or t
  modified_base (361)..(361): a, c, t, g, unknown or other
  misc_feature (361)..(361): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtcctccttccaccctgtctgcatctgtaggagacgagagtccaccttcacttcgcccgggcagtacaaatnttacgtaggtggttggcctggtatcagacaacgaaaccgagggaaccggaccccctaaggtcccctanatacgaaaggaacggcgttacttaacgttaagaacgtcggttacggggtcccctanaaggtacttcgacggcggtccgggtagattcggtacgggaacgaagtaacgttccacgtccaccgacctaaatacgaaacctacggtaccgtacgggaaccctaggtactaggttaagtttttaccgtacgttaaactttacgtttaacctacgtaaccctaaactaacctaagtacgtaaccttaccgttacccgtaaccccgttaacttaaccggttttaccggaccggtaacggggtaacctaacgggtacgtacggtaacggtaacttaaccggaaaacggtaacggttacggtacgggtaccgtaccggtacctaacccgttacgttaccgttaccgttacgtttaccttaaccttccccgttcccccgtaaccg

SEQ ID NO: 211677 - DNA, 812 bp, Homo sapiens
  misc_feature: GYAE6OF01C6P96.15.37.D04.1.454.CMB.1.raw
  modified_base (372)..(372): a, c, t, g, unknown or other
  misc_feature (372)..(372): n is a, c, g, or t
  modified_base (600)..(600): a, c, t, g, unknown or other
  misc_feature (600)..(600): n is a, c, g, or t
tcagtctacgtagccacgaccggtgctcgatttagtagcatactggttgggtttgggggagtcagacccagtcaggacacagcagtggacatggacgggtccccgctcacgcctccgtggggcctcctgctgctctggcctccgaggtcgccagtgtgtcgactacgtccagtatcgaccctagttcctcccttcctaccctgtctgacctattcgtgtaggacgtacgaggtacgtacctacctttcaccgttcggacccggacaagtaactaaattcgttacgtagggttggtcgtaccgttggtacttcgacgtaacgtaaacggaaaccggaacggggtaacccgtaccccgtaacgttcccccgtanaacggtaaccggaacggtacggtaccgtttaacgtaacggttaggacgggtttaccgggtccgggttaacccgtagaaggtccttacggacggtccgggtccggtagtaccgtcgggaacggaactaggttaaactccgacttcccgacgtactacgtaccgaaactccggtacgtacggtaacctagtaagttgttaacgtttagtaacccttaatttaaccgtacncccgtaaactactttaagacttaacgtacctaccccggtaacctttacccgttaaccgttaaccggttaccgggaccgggtacccggtaacggtcggttaccggaggtaaaccgaaccggttacggaaaacgtacgttggtaacgtccgacgttacccgtaggtccctaggtttcccttaccgttactttaccctccccggtttaccctacg

SEQ ID NO: 211678 - DNA, 908 bp, Homo sapiens
  misc_feature: GYAE6OF01C6DQV.15.37.D04.1.454.CMB.1.raw
tcagtctacgtagccacgaccggtgctcgatttagtagcatactgttgggtttgggggagtcagacccagtcaggacacagcatggacatgagggtccccgctcagctccgtggggcctccgtgctgctctggcctcccgagggtcacctagttggtagtcgaacactccgaagacgtacgaaccctgttcccttccccttccctaccccttgttcctcgtactacttcgtaggtaagggaacacgtaagtaccgttacctaccttcgtaccgttcggacccggtactaagtaacctaaacgttacgttacggtgggttggttccggtcgttaggtactacacgacgaaacggaaaccggaacgggtaaccgtacccctaacgtcccctagtaacgtacgaacggtacggtccttaacgtttacgtaggacggttccggtcggggttacctacgtaaacgtcgtacgacgggccggtacggtacggtacgtggtaacgggactaaggtaacttcccgacttaacccgtaccaaccgtactaaccgtaaaccggtcggtaccgtaacggtaacgttccggttaatttacgttacgtttaccgtaacgtttaacttaacgttccgttaaccgtaacccgttaaacttaccgtaacgttaacccgtacgttaaccccgttaccgttaacccggttttaaccgtttacccgggttttacccggggaaccgggttaaccggggtaccgttaaccgggttaacggtacgggtaaaaacgttaaccgggtaaaaccggtttacgggtacgggttacccggaaccggtttccggaaccgtaaccttacccggttacggtttccttaacccgggttttacctacccgtttacccgttccccggttccctaacccggg

SEQ ID NO: 211679 - DNA, 869 bp, Homo sapiens
  misc_feature: GYAE6OF01D10QS.15.37.D04.1.454.CMB.1.raw
  modified_base (148)..(148): a, c, t, g, unknown or other
  misc_feature (148)..(148): n is a, c, g, or t
tcagtctacgtagccacgaccggtgctcgatttagtagcatactgttggggtttgggggagtcagacccagtcaggacacagcatggacatggacgggtccccgctcagctccgtggggctcctgctgctcgtggcctcccgaggtcncctatggtgtagacataccaagatcgacccagttccctccttcccacctgtctcgctatctaggtaaggacgaacgtagtactcctacttacgtaccgtcggacccgggactaagttaaacctaaaaagtttacgttaacggttaggggttcggggttaccggtaccgttagggttaactaccggaagaaccgtaaaagggaaaacccggaacgggggtaaaccggtaaccccccgttaaaccggttccctaacgtaacgtaacgggaaaacgggtaaccgggtttcctttaaccgttaacgtttaacggggaacggttcccgggttaccggggtaacctaacggaaagtaccgtacgagggtaccgggtaccgggtaggaaccttacggaacgggaaccgttaagtaacccgtttacctaccgttacctaaccgtaaacctaacggtaaaccgaaacgtccggtaaccgtacggtaacgtacggtaagtttacgtttagttaacgtaacttaaacgttacttaacgtacgtaacctaacgtaataagttaaccgacttaccgtaacccgtaccgttaacccgttacggttacggacccgggtaacgggaaccgtaagtacggtagaacgtaacggaacgaaacggttaaacgtcggtacgacgtccgacgtaccctggttaccttacgttaccgtaccttaccttacccgtccggtaccc

SEQ ID NO: 211680 - DNA, 810 bp, Homo sapiens
  misc_feature: GYAE6OF01BMBS7.15.37.D04.1.454.CMB.1.raw
  modified_base (602)..(602): a, c, t, g, unknown or other
  misc_feature (602)..(602): n is a, c, g, or t
tcagtctacgtagccacgaccggtgctcgatttagtagcatactgttggggtttgggggatcagacccagtcaggacacagcataggacagtggacgggtccccgctcagctccgtgggctccgtgctgctcgtcggtcctcccgaggtcgccattggttcgagactactaccgagtacgtccgaacccgtcgttcccttcccttaccctacccgttgtacctcggacctagttcgttagggaaggacgaccgtacggtaccgttaccctaccgtttccgtacggttccgggacccgacctaacgtaactaaagttacgtttacggtaggggttacggttacggtccgttaggtactcgtaacgacggtaaacggaaccggtaagggtaccccgttaccgtaacgttcccacgtaacgtaacggaacggttacggttaccgtttacgttaacgggttaggaaccggttccgggttacccgggtaccttaaggtaacgtcgtacggcgggtccgtacgggtgttaaccgtacgggtagtaactacgttaactcccgtagtaccctaccaccgtaagttaccgacgtcgttacgtacgtacgtntacgtagttattactactacgtttacaaccgtactaccgatacgtacgtactaccttacccgtacctacggttacctacgggttccggaaccggtacggtacgagtaccggtacgaacgtaccggtaacgtacgggtatcggacggtacacggtacctaccgggtctttacggttaccttcgttaccgtttacctcccttaccggtac

SEQ ID NO: 211681 - DNA, 718 bp, Homo sapiens
  misc_feature: GYAE6OF01EAV03.15.37.D04.1.454.CMB.1.raw
  modified_base (203)..(203): a, c, t, g, unknown or other
  misc_feature (203)..(203): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggcctcccaggtgccatgtgtgacatccaagatcgacccagtcctccttccacctgtctcgctatctggtagganacaggactcaccttcacgttcggccggctaagtacaaaattattacgtaggtggttcggtctggtactcagacaacgaaacgacgggaacgacccgtaacgtcctacgactacaaagtaggtcttacgtaacgttaacgacggtcgtacgggtaccctagaacgtacgttcgacgtcggtccggtaggtactacggttacgggaactagtaacgttaccgtacctactacctaaaccgtactaaccaaacggtaccgtcccggtttaacgggaaaccttcggtaaagttcggtttaattttacgaacgttaaacttacgttaaccgtacgtaacctaaacgacctttaagtactaaccttaactacccgtaacccgttaactttaccggtttaccgaccgggtaaccgggaacgtaacggtcgtagggtaacgacgtaaacggtaaacgaagttcggtaccgtacgtacgtacccgactacgttcgttacgtacttaccttacggtccctagacc

SEQ ID NO: 211682 - DNA, 718 bp, Homo sapiens
  misc_feature: GYAE6OF01A4Y7U.15.37.D04.1.454.CMB.1.raw
tcagtctacgtagccacgaccggtgctcgatttagtagcatactgttgggtttgggggagtcagacccagtcaggacacagcatggacatgagggtccccgctcagctcctggggctcctgctgctctggctcccgaggtcgccatgtgtgacactccagactcgaccagtcctcccttccacccttgtctgcattcgtgtaggaagacacgtactcctaccgttcctaacgttccggcccgggacctaacgtaaactaaaattacgtttacgtagggttcggttcgtccgttaggtactcacggaacaaacgaaaccggaaagggacccgacccctaaccgtcccctatacgtaaacgaacggaacggttcctttaacgttaacgtttaacggaaaccggtccgggtttcggggtaccctacgtaaagtccgttacgaacgcccggtacgggtacggtacgtacgggtacgaaacgtacggtaacttccgtaccttacgtacccactaatacccaacgtcgaccgtacggtacgtagtacttagttactttcaaccttagttaactctaccgaactacgtatacgtacactacctactaccgtcttacggttcgacggtacgacgacgtcgagaagagtaacgaacgttacgtggacgtatcggaacctccgttagtcccttaccgtaccttaactcccgttacccgtcccgtaacg

SEQ ID NO: 211683 - DNA, 932 bp, Homo sapiens
  misc_feature: GYAE6OF01DP45H.15.37.D04.1.454.CMB.1.raw
tcagtctacgtagccacgaccggtgctcgatttagtagcatactgttgggtttgggggagtcagacccagtcaggacacagcatggacatgagggtccccgctcagctcctggggctcctgctgctctggcctcccaggtgccatgtgtgacatccagatcgacccagtcctccttccaccctgtctgcatcgtgtaggagacagacgtcctacccttctaccgttcggcccgggaccaacggttaacctaaaaagttacgttaccggttaaggggttcgggttacggtcccgttagggtaacttccgaacgtacgaaaaccggtaaaacccggtaacggggaaaccggtaacccccgtaacgttacccccgtacgtaacgttaaccgaaaacgggtaacgggtaccgttaaccgtttaaccggttttaaaggaaccggtaccgggtttacccgggggttaccccttaacgaaaagtccgtttaccgaccgggtaccggtccggggttaggacgttccgggtaacggggtaagtaaccggtaaacgttccgtaaccctaccctacccgttaaccaaccgtacctaaaacccgtacgggtacccgttaacggtaacccgttaggtaacgtttgtttaaacgttttaccggtaaaccttaaacgtttaacgtttaccgtaccggtaacccaaaaccgttacgttaacgttaacgtaacctttaacccgttccccgttaaaccccgttaccttttacccggttttaccgggaacccgggttaacggggtaaacccaaccgggttacgtacggtaacggtaaaccgttaaaacgggtaaacggttacgtacggttacggtaccgtacgtacccgtaacccttcggttaccttccggtttacccttaccggttccttccccggtcccttaaccccgg

SEQ ID NO: 211684 - DNA, 498 bp, Homo sapiens
  misc_feature: GYAE6OF02G1R2O.15.37.D04.1.454.CMB.1.raw
tcagtctacgtagccacgaccggtgctcgatttagtagcatactgttgggtttggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatattactaggtggttggcctggtatcagcagaaaccagggaaggcccctaagtccctcatcaagaaggcgtctactttagaagctggggtccctcaagattcagcgccggtggatctgggacagaattcactctcaccatcaacagcctggaacctgatgatttgctaacttattactgccaacactatgatactcaccgtacactttggccagggaccaagctggagatcaaggactgtggctgcaccatctgtcttcatctcccgc

SEQ ID NO: 211685 - DNA, 514 bp, Homo sapiens
  misc_feature: GYAE6OF02F56DZ.15.37.D04.1.454.CMB.1.raw
  modified_base (234)..(234): a, c, t, g, unknown or other
  misc_feature (234)..(234): n is a, c, g, or t
  modified_base (289)..(289): a, c, t, g, unknown or other
  misc_feature (289)..(289): n is a, c, g, or t
  modified_base (331)..(331): a, c, t, g, unknown or other
  misc_feature (331)..(331): n is a, c, g, or t
tcagtctacgtagccacgaccggtgctcgatttagtagcatactgttagggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatnttactaggtggttggcctggtatcagcagaaaccagggaagcccctaagtccctnatcaagaaggcgtctactttagaagctgggggtccctcaagnttcagcgccggtggatcgtgggacaggaattcactctcaccatcaacagcctggaaacctgatgtattttgactaacttattactgccaacactatgatactcaccctacacttttggccaggggaccaagctaggagatacaaggactggtgctggcacatctcgtcttcattcctccgtcc

SEQ ID NO: 211686 - DNA, 558 bp, Homo sapiens
  misc_feature: GYAE6OF02IU8G3.15.37.D04.1.454.CMB.1.raw
  modified_base (211)..(211): a, c, t, g, unknown or other
  misc_feature (211)..(211): n is a, c, g, or t
  modified_base (232)..(232): a, c, t, g, unknown or other
  misc_feature (232)..(232): n is a, c, g, or t
  modified_base (265)..(265): a, c, t, g, unknown or other
  misc_feature (265)..(265): n is a, c, g, or t
  modified_base (321)..(321): a, c, t, g, unknown or other
  misc_feature (321)..(321): n is a, c, g, or t
  modified_base (340)..(340): a, c, t, g, unknown or other
  misc_feature (340)..(340): n is a, c, g, or t
tcagtctacgtagccacgaccggtgctcgatttagtagcatactgttgggtttgggggaggtcagacccagtcaggacacagcatggacatgagggtcccgctcagctcctggggctcctgctgctctggctcccaggtgccatgtgtgacatccagatgacccagtctccttccaccctgtctgcatctgtaggagacagagtcaccttnacttgccgggcagtcaaaatntactaggtgttggcctggtatcagcagaaaccngggaagcccctaagtccctcatcaagaagcgtctacttagaagcgtggggtccctnaagattcgagcgcggtagntcgtggacagaattcactctcacatacaacagcctagaacctgatgtatttgactaaacttattactcgaccaactacttatagtaactactacctaacccgtactactttcggaccgtaacgggaccctaagcgtaggaacgtataccgaaaggtaacgttggtacggtactcggacctacctacgttctgttccttacacgtttccctcccgtacc

SEQ ID NO: 211687 - DNA, 537 bp, Homo sapiens
  misc_feature: GYAE6OF02H2ZXV.15.37.D04.1.454.CMB.1.raw
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatattactaggtgttggcctggtatcagcagaaaccagggaagcccctaagtccctcatcaagaaggcgtctacttagaagctggggtccctnaagtnttcagcgcggtggatcgtgggacagaattcactctcaccatcaacacgcctaggaacctgatgtatttgctaacttattactgaccaactactatagtactactacctacccgtactacgttttcggaccgtacggggaccaagcgtaggaacgatacgaaggtactggtcggctgacacatcttgtcttactacttccttcccgtacc

SEQ ID NO: 211688 - DNA, 500 bp, Homo sapiens
  misc_feature: GYAE6OF02HMI5A.15.37.D04.1.454.CMB.1.raw
  modified_base (233)..(233): a, c, t, g, unknown or other
  misc_feature (233)..(233): n is a, c, g, or t
  modified_base (325)..(325): a, c, t, g, unknown or other
  misc_feature (325)..(325): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatnttactaggtgttgcctggtatcagcagaaaccagggaaggcccctaagtccctcatcaagaaggcgtctactttagaagctgggggtccctnaagattcagcgccggtgatctgggacagaattcactctcaccatcaacagcctgaacctgatgatttgcaacttattactgccaacactatgatactcaccgtacacttttgccaggggaccaagctaggagatacaaaggaactgtggctgcacatctgtcttcatctcccgtc

SEQ ID NO: 211689 - DNA, 582 bp, Homo sapiens
  misc_feature: GYAE6OF02HCNVO.15.37.D04.1.454.CMB.1.raw
  modified_base (333)..(333): a, c, t, g, unknown or other
  misc_feature (333)..(333): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgacgggccagtacaaaatattactaggtggttggcctggtatcagcagaaaccagggaacgcccctaagtccctcatacaagaaggcgtactacttagaagcgtagggactcccgtanaagtattcgagcgccggtggatcgtggggacagaacttcactctacaccatacaacacgcctaggaacctgatgtatttgactaactttattactacgtacctaaactactatacgtactacctacctaacccgttactacgttttcggaccgacggggtaaccaagcgtaggagtacgtacgaaacggtaacgtggtcggactcggacctaccgtacttccttcgttccttctacttcccttaccccg

SEQ ID NO: 211690 - DNA, 543 bp, Homo sapiens
  misc_feature: GYAE6OF02IVGA1.15.37.D04.1.454.CMB.1.raw
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatattactaggtggttggctggtatcagcaagaaaccagggaacggcccctaagtccctcatacaagaaggcgtctaactttagaagcgtggggtcccgtcaagattcagcgccggtggatcgtgggacagaattcactctcaccatacaacagcctcggaacctgatgtatttgctaacttattactagacctaacactatagactactctaacccgtactacgttttcgaccgtaggggaccaagtctaggagatacaaggtaactaggtcggactgaccacagttctgttccttctacttcctcccgtcc

SEQ ID NO: 211691 - DNA, 553 bp, Homo sapiens
  misc_feature: GYAE6OF02IKGD3.15.37.D04.1.454.CMB.1.raw
  modified_base (231)..(231): a, c, t, g, unknown or other
  misc_feature (231)..(231): n is a, c, g, or t
  modified_base (332)..(332): a, c, t, g, unknown or other
  misc_feature (332)..(332): n is a, c, g, or t
  modified_base (383)..(383): a, c, t, g, unknown or other
  misc_feature (383)..(383): n is a, c, g, or t
  modified_base (438)..(438): a, c, t, g, unknown or other
  misc_feature (438)..(438): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccggcagtcaaaatnttactaggtggttggcctggtatcagcagaaaccagggaacggcccctaagtccctcatcaagaacggcgtctaacgtttagaagcgttcggggtccctanaagattcaggcgccggtgatcgtgggacagtaattcactcacacatcaacngacctgactgatgtatttagactaacttattactcgaccaacactatgtactacnctaccctactacgtttcgaccgacgggaccacgtacgtaggacgagtacgtaagaacgtaggtcgacgtacgcgtacctacgttcgtcgttacttactacttccttcccgtaccc

SEQ ID NO: 211692 - DNA, 510 bp, Homo sapiens
  misc_feature: GYAE6OF02F6WWG.15.37.D04.1.454.CMB.1.raw
  modified_base (379)..(379): a, c, t, g, unknown or other
  misc_feature (379)..(379): n is a, c, g, or t
  modified_base (426)..(426): a, c, t, g, unknown or other
  misc_feature (426)..(426): n is a, c, g, or t
  modified_base (468)..(468): a, c, t, g, unknown or other
  misc_feature (468)..(468): n is a, c, g, or t
  modified_base (499)..(499): a, c, t, g, unknown or other
  misc_feature (499)..(499): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatattactaggtggttggcctggtatcagcagaaaccagggaaggcccctaagtccctcatcaagaaggcgtctactttagaagcgtggggtcccgtcaagattcagcggccggtggatctgggacagaattcactctcaccatcaacngcctggaacctgatgattttgctaacttattaactgccaacactatnatactcacccgtacacttttggccaggggaccaagctagganatcaaggactgtggctgcaccatctgtcttnactctcccgcc

SEQ ID NO: 211693 - DNA, 526 bp, Homo sapiens
  misc_feature: GYAE6OF02JB3OV.15.37.D04.1.454.CMB.1.raw
  modified_base (234)..(234): a, c, t, g, unknown or other
  misc_feature (234)..(234): n is a, c, g, or t
  modified_base (291)..(291): a, c, t, g, unknown or other
  misc_feature (291)..(291): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (377)..(377): a, c, t, g, unknown or other
  misc_feature (377)..(377): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgcccgggccagtcaaaatnttactaggtggttggcctggtatcagcagaaaccagggaacggcccctaagtccctnatcaagaggcgtactacttagagctggggtccctnaagnttcagcgccggtgatcgtgggacagacttcactctcaccatacaacngcctagaacctgatgtatttgactaacttattactgtaccaactactatgactactcaaccctactactttcggccgagggaccaagcgtaggatagtacgaagactggtcgctcgacctacgatctcgtccttcacttcctccctacc

SEQ ID NO: 211694 - DNA, 513 bp, Homo sapiens
  misc_feature: GYAE6OF02GNBMM.15.37.D04.1.454.CMB.1.raw
  modified_base (290)..(290): a, c, t, g, unknown or other
  misc_feature (290)..(290): n is a, c, g, or t
  modified_base (327)..(327): a, c, t, g, unknown or other
  misc_feature (327)..(327): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatattactaggtggttggcctggtatcagcagaaaccagggaaggcccctaagtcccctnatcaagaaggcgtctactttagaagctggggtccctnaagattcagcgccggtggatcgtgggacagaattcactctcaccatcaacagcctggaacctgatgtattttgctaacttattactgaccaacactatgatactcaccctactactttgcagggaccagctggagatacgaaggactaggtggctgccacatctcgtcttcacttcctcccgtacc

SEQ ID NO: 211695 - DNA, 786 bp, Homo sapiens
  misc_feature: GYAE6OF02IUPG2.15.37.D04.1.454.CMB.1.raw
  modified_base (234)..(234): a, c, t, g, unknown or other
  misc_feature (234)..(234): n is a, c, g, or t
  modified_base (292)..(292): a, c, t, g, unknown or other
  misc_feature (292)..(292): n is a, c, g, or t
  modified_base (335)..(335): a, c, t, g, unknown or other
  misc_feature (335)..(335): n is a, c, g, or t
tcagtctacgtagccacgaccggtgctcgatttagtagcatactgttgggtttgggggaggtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccggccagtacaaaatnttactaggtgttggcctggtatcagtacaagaaaccgagggaacgcccctaagtcccnatacaagaaggtcgtactacgttagaagcgtcggggtacctanaagtattcgagccgtcggtaggactcgtagggacaaggtacttacgactcgtaccaactagtacccaacgacggtcccgtacggtaaccctaggtaacgttacggtaagtttttacggaaaccgtttaaaaccgtttaactttaaaccgttaacggtaacccttaaaacctaaaccgttttaacgtaaccggttaaactttaaccctaacccgtaaacccccgttttaaaccgttaaacccgttttttaccggggaaccccgttaaacgggggtaaccccgaaaccgggttaaccggtaacccgggtaaagtaaccgttaaccggtaaaacgggtaacccgttaacgggttaacgggtaacccgttacggtaacccgtaacccgttaacgtttaacccgttccggtttaaccgtttccgtaacccgtttcccgttaccccccggttaaccc

SEQ ID NO: 211696 - DNA, 532 bp, Homo sapiens
  misc_feature: GYAE6OF02HCRS9.15.37.D04.1.454.CMB.1.raw
  modified_base (296)..(296): a, c, t, g, unknown or other
  misc_feature (296)..(296): n is a, c, g, or t
  modified_base (334)..(334): a, c, t, g, unknown or other
  misc_feature (334)..(334): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
  modified_base (504)..(504): a, c, t, g, unknown or other
  misc_feature (504)..(504): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgcccgggcagtacaaaatattaactaggtggttggcctggtatcagcaagaaaaccagggaacgccccctaaagtcccctnatcaaagaggcgtactacttagaagctggggtccctanaagattcagcgccggtgatcgtgggacagtaacttcactctcaccatcaaacngcctagaaccngtatgtatttnactaattattactcgaccaactactatagatactaccacctaactactttcggaccgagggaccaagcgaggaagatacaaggtaactgtcggcngacaccatctctctctacttcctcccac

SEQ ID NO: 211697 - DNA, 562 bp, Homo sapiens
  misc_feature: GYAE6OF02F449B.15.37.D04.1.454.CMB.1.raw
  modified_base (233)..(233): a, c, t, g, unknown or other
  misc_feature (233)..(233): n is a, c, g, or t
  modified_base (327)..(327): a, c, t, g, unknown or other
  misc_feature (327)..(327): n is a, c, g, or t
  modified_base (378)..(378): a, c, t, g, unknown or other
  misc_feature (378)..(378): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatnttactaggtggttgcctggtatcagcagaaaccagggaacgcccctaagtcccctacatcaagaaggctctactttagaagcgtggggtccctnaagattcagcgccggtgatcgtagggacagaattcactctcaccatcaacngcctaggaacctagatgtatttgactaacttattactacgacctaacactatacgatactcctaacccgtactacgttttcggaccgacggggaccaagtcgtcggagtactacgaacggtaacgtggtcggctcgaccaccgtacttcttacgttccttactacctttccgttaccccgtacc

SEQ ID NO: 211698 - DNA, 580 bp, Homo sapiens
  misc_feature: GYAE6OF02GY2YO.15.37.D04.1.454.CMB.1.raw
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgcccgggccagtacaaaatattactaggtggttggctggtatcagcaagaaaccgagggaacgccctaagtccctcatacgaagaaggcgtactactttagaagtcgtcggggtccctacaagtattcgagcggtccggtggactcgtagggaccaggtaacttcacttctacaccatacaacacgcctacggaacctgatgtatttgactaacttattactacgaccaacactatagtactactacctaccgtactacgtttcggaccgtacgggaccaacgtcgtaggaagtagtaacgaagtaacgtggtggacgtcgacctaccgtatcgttcgttccttacgtacttccgtccccgtacc

SEQ ID NO: 211699 - DNA, 569 bp, Homo sapiens
  misc_feature: GYAE6OF02FR1EO.15.37.D04.1.454.CMB.1.raw
  modified_base (232)..(232): a, c, t, g, unknown or other
  misc_feature (232)..(232): n is a, c, g, or t
  modified_base (290)..(290): a, c, t, g, unknown or other
  misc_feature (290)..(290): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (376)..(376): a, c, t, g, unknown or other
  misc_feature (376)..(376): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccggccagtcaaaatnttactaggtggttggcctggtatcagcagaaaccagggaacggcccctaagtcccctnatcaagaaggcgtctacttagaagctggggtccctnaagnttcagcgccggtgatcgtgggacagaattcactctcaccatcaacngccctaggaacctgatgtatttgactaacttattactcacctaactactatagactacctacctaacccgttactacttttcgggaccgtaacggggacctaagtcgtcggtaagactaccgaaaggtaacgtggtacggtcgtacgtacgtacctattccttacgttccttactacttccttaccccgtacc

SEQ ID NO: 211700 - DNA, 668 bp, Homo sapiens
  misc_feature: GYAE6OF02IMMM3.15.37.D04.1.454.CMB.1.raw
  modified_base (233)..(233): a, c, t, g, unknown or other
  misc_feature (233)..(233): n is a, c, g, or t
  modified_base (294)..(294): a, c, t, g, unknown or other
  misc_feature (294)..(294): n is a, c, g, or t
  modified_base (349)..(349): a, c, t, g, unknown or other
  misc_feature (349)..(349): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtcctccttccaccctgtctgcatctgtaggagacagagtcaccttcacttgccggcagtacaaaatnttacgtaggtggttcgccttggtatcagcaagaaaccgagggaacgcccctaagtccctanaacgtacaaaggacggtcgtacttaacttagaacgtcgttaccgggggtccctanaaagtcttccgaaggccggtccggtggactcgtagggacaagtaacttcgaactctacacactacaactcgcctaggaacctagactagttatttgacttaacttntacncgaaccaactactatcactacctacctaaccgttacttacgtttccgggaaccgtaacggggaacctaacggtcgtaacggtaacgtaacgttaaaccgaaacgggttaccgtacgggttacggtaccgttacgaacccgttaacccgtacgtttacccgttacggttaccctttaaccggaccttttacccccgttaccccggtaacc

SEQ ID NO: 211701 - DNA, 574 bp, Homo sapiens
  misc_feature: GYAE6OF02GIJ3L.15.37.D04.1.454.CMB.1.raw
  modified_base (233)..(233): a, c, t, g, unknown or other
  misc_feature (233)..(233): n is a, c, g, or t
  modified_base (327)..(327): a, c, t, g, unknown or other
  misc_feature (327)..(327): n is a, c, g, or t
  modified_base (379)..(379): a, c, t, g, unknown or other
  misc_feature (379)..(379): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatnttactaggtggttgcctggtatcagcagaaaccagggaacgcccctaagtccctcatcaagaaggcgtctacgtttagaagcgtggggtccctnaagtattcagcgccggtggatcgtgggacagaattcactctcaccatcaacngcctgaacctgatgtatttgactaacttacttactgacctaaacactaatgtaactacctacctaacccgtactaccgttttcgggacccgtaacggggacccaagtcgtacggaagtacgtaacgaaaggaactaggtggacgtacgacctaacctagtcttacggttcttaccgtacttcccgttcccgtacc

SEQ ID NO: 211702 - DNA, 564 bp, Homo sapiens
  misc_feature: GYAE6OF02I0ITO.15.37.D04.1.454.CMB.1.raw
  modified_base (233)..(233): a, c, t, g, unknown or other
  misc_feature (233)..(233): n is a, c, g, or t
  modified_base (328)..(328): a, c, t, g, unknown or other
  misc_feature (328)..(328): n is a, c, g, or t
  modified_base (383)..(383): a, c, t, g, unknown or other
  misc_feature (383)..(383): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatnttactaggtggttgcctggtatcagcacgaaaccagggaacggcccctaagtccctcatcaagaaggcgtactactttagagcgtggggtccctnaagtattcgagccgtcggtggatcgtgggacagtaatcactctcaccatacaacngcctaggaacctgatgtatttgacttaacttatacgtgtaccaacacttatagaactactacctaccgtacttacgtttcggaccgaggggtaacctaagacgtggagtaacgtacgaaggtacgtggtcggtcgtaggacctaccgtatcgttcgttcttcgtacttccttaccccgtcg

SEQ ID NO: 211703 - DNA, 619 bp, Homo sapiens
  misc_feature: GYAE6OF02JF4T2.15.37.D04.1.454.CMB.1.raw
  modified_base (234)..(234): a, c, t, g, unknown or other
  misc_feature (234)..(234): n is a, c, g, or t
  modified_base (345)..(345): a, c, t, g, unknown or other
  misc_feature (345)..(345): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtacaaaatnttactaggtgttggcctggtatcagcaagaaaccaggggaacgaccccctaagtcccctacgatacgaaggaaggcgttactaacgtttagaagcgtgggggtacccctanaagtattcaggcgcggtgatcgtagggacagtatcactctacgaaccatacaacagcctacggaacctgatagtattttacgactaacttattacctcgacctaacgtacttaatacgtactacctacctaacccgtacttacgttttcggaccgtaacggggaaccctaagtccgtaggaacgtataaccgaaggtaaccgtaggtacggtactcggaacctaccgtaagttccgttcggttacctttcaaccgtttcccttaccccgtaccg

SEQ ID NO: 211704 - DNA, 561 bp, Homo sapiens
  misc_feature: GYAE6OF02HQIRN.15.37.D04.1.454.CMB.1.raw
  modified_base (233)..(233): a, c, t, g, unknown or other
  misc_feature (233)..(233): n is a, c, g, or t
  modified_base (284)..(284): a, c, t, g, unknown or other
  misc_feature (284)..(284): n is a, c, g, or t
  modified_base (325)..(325): a, c, t, g, unknown or other
  misc_feature (325)..(325): n is a, c, g, or t
  modified_base (457)..(457): a, c, t, g, unknown or other
  misc_feature (457)..(457): n is a, c, g, or t
  modified_base (539)..(539): a, c, t, g, unknown or other
  misc_feature (539)..(539): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatnttacaggtggttgctggtatcagcaagaaccagggaagcccctaagtcctnatcaagaggcgtctactttagaagtcgtggggtccccgtanaagacttcaggccgaccgggtggactcgtagggggacaaggaatttcacgttctactaaccactacgaaacacgccgtacggaacctagactagtattttcgactaacttacttaactgaccaactactatntatactacaccgtactacgtttcgaccgtacgggacaagcgtagagactacgaaggtaactaggtgactgctacctatcgtntccttctacttcctcccgtacc

SEQ ID NO: 211705 - DNA, 581 bp, Homo sapiens
  misc_feature: GYAE6OF02F67PK.15.37.D04.1.454.CMB.1.raw
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtacaaaatattactaggtggttggcctggtatcagcaagaaaccagggaacggccccctaaagtcccctacatacaaggaacggcgtacttaactttaggaacgtcgtcggggtcccctnaaagtnttcgagcgccggtggatcgtagggacagaattcactctacaccatacaacacgcctaggaacctgatgtatttgactaacttattactcgacctaacacttatagactacctcctaacccgtacttacgtttcggaccgtacgggaccaagctaggagtaataacgaagtaacgtggaggtccgtgaccaccgtattccgtcgttccttctacttcccgtacccgtaccg

SEQ ID NO: 211706 - DNA, 606 bp, Homo sapiens
  misc_feature: GYAE6OF02FMTXW.15.37.D04.1.454.CMB.1.raw
  modified_base (422)..(422): a, c, t, g, unknown or other
  misc_feature (422)..(422): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtccaccttcacttgccgggccagtcaaaatattactaggtggttggcctggtactcagcaagaaaccgagggaacggcccccttaaggtcccctacatacgaaggaaggcgttactaaccgtttaggaacgtcgttcgggggtcccctagaacgtattcgaggccggtccggtggacttccgtagggacaggaactttcgacttcgtcaccatccaacngccctaggaacctgatgtatttgactaacttacttactcgtacctaacactatacgtactactactacccgttactacgttttcgaccgtacgggaccacgacgtaggtagtacgtaacgaaggtacgtaggtcgtactcgcgtacccgtatccttcggtaccttcctacttcccgtcctaccg

SEQ ID NO: 211707 - DNA, 603 bp, Homo sapiens
  misc_feature: GYAE6OF02FV2SD.15.37.D04.1.454.CMB.1.raw
  modified_base (233)..(233): a, c, t, g, unknown or other
  misc_feature (233)..(233): n is a, c, g, or t
  modified_base (394)..(394): a, c, t, g, unknown or other
  misc_feature (394)..(394): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatnttacaggtgttggcctggtatcagcaagaaaccagggaacgcccctaagtccctacatacaaggaagcgtactactttagaagcgtggggtaccctcaacgtattccgaagcggccgggtggagttcgtgggacagaacttcaacgtctcaccatacaacngcctggaacctgatgtattttagactaacttacttactcgtaccaacacttatcgaactactaccaacccgttaactaccgttttcggacccgtaacggggtaccaaggtcgtaggaacgtactaccgaaaggtaacgtacggttcggtaccgtacggaccctaccgagttccgttcgttccttacgtacttacccgttcccgtacccg

SEQ ID NO: 211708 - DNA, 601 bp, Homo sapiens
  misc_feature: GYAE6OF02IWB5U.15.37.D04.1.454.CMB.1.raw
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
  modified_base (290)..(290): a, c, t, g, unknown or other
  misc_feature (290)..(290): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtagganacagagtcaccttcacttgcccgggcagtcaaaatntacgtaggtgttgcctggtatcagacagaaaccgagggaacggcccctaagtccctnactcaaggaaggcgtactactttaggaagtcgtcggggtcccgcaaggtattcgagccggccggtggatcgtgggacagtaacttcactctcaccatacaacganccgtagaacctnagtgtactttgactaacttattactgacctaactactatgtaactacctacaacccgttactaccgttttacggacccgtaggggaacctaacggcgtaggaacgtagtaaccggaaaggtaacgtggtacggtcctacggtacctaccgtataccgtttcgttaccttacgtaccttcccgtacccggtaccc

SEQ ID NO: 211709 - DNA, 778 bp, Homo sapiens
  misc_feature: GYAE6OF02JIPOA.15.37.D04.1.454.CMB.1.raw
  modified_base (196)..(196): a, c, t, g, unknown or other
  misc_feature (196)..(196): n is a, c, g, or t
  modified_base (234)..(234): a, c, t, g, unknown or other
  misc_feature (234)..(234): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccacctgtctgcatctgtagganacagagtcaccttcacttgccgggccagtacaaaattnttacgtagggtggttaggccttggtactcagcaagaaaccgagggaacggacccctaagtcccctcatacgaaagtaacggcgttactaacttttaaggaacggtccgttacgggggtaccccgtacgaaaggtatttaccgaggtcccgggacccgggttggaacgttccggtaagggggaacctaagggtaaaacttttcccgaactttacccgtaccctaaacccgtaattaacccaaaacgacggtcccggtaaacggtaacccgtagtaacgtcgtttaagttttacggaccttaaactttaacgttaacctacgtaaccctaaaccttaacttacgttacgtaacttaaccctaccctaaacccgttactttaaccgtttaccggtaacccggtaacgggggaaccctaaacgggtacgtaacggaacgtaaacgtaacggaaacggttaacggtacgggttaggtacccgttaggaacctaacccgtaattccgtttacggttaccttacggtacccttaccggttcccccgtaacc

SEQ ID NO: 211710 - DNA, 722 bp, Homo sapiens
  misc_feature: GYAE6OF02HCXA4.15.37.D04.1.454.CMB.1.raw
  modified_base (683)..(683): a, c, t, g, unknown or other
  misc_feature (683)..(683): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcactctgtaggagacagcgtcaccttcacttcggccggcacgtacaaaattataacgtaggtggttggccttaggtatcgacgcaaacggtaaaccgaaggggaaccgaccccctaacggtccccctactaactacgaaaggacgggtccgttaccttaacgtttacggaacggtccggttccgggggtaccccgtacgtaaaacggtcttaccaaggggcccgtaccggggtacggagttccggtagggaaccaaggtaactttccgaacctttccgaaccctaaccctacttaacccgaaccgtacgttacccgtacggaacccgtgtaacgttagttaagtttcgtaactaacgttaacgtttactaccgtaccaaactacttactacgactacctacccgtaccgtaccttacgtttaccggaccggtacggggaaccctaggtcgaggtaagacgtaacgaacggtagtaggtcggaccgtgacccgtaactntaccgttacgttaccttacttccgtccctaccggtaccc

SEQ ID NO: 211711 - DNA, 634 bp, Homo sapiens
  misc_feature: GYAE6OF02GFED9.15.37.D04.1.454.CMB.1.raw
  modified_base (235)..(235): a, c, t, g, unknown or other
  misc_feature (235)..(235): n is a, c, g, or t
  modified_base (296)..(296): a, c, t, g, unknown or other
  misc_feature (296)..(296): n is a, c, g, or t
  modified_base (337)..(337): a, c, t, g, unknown or other
  misc_feature (337)..(337): n is a, c, g, or t
  modified_base (397)..(397): a, c, t, g, unknown or other
  misc_feature (397)..(397): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttcgccgggccagtacaaaatnttacgtaggtggttggcctggtatcgagcaagaaaccagggaacgcccctaagtcccctanatacaaggaggctactactttagaagcgttcggggccctanaagtattcgagcgccggtgactcgtagggacagtaattcactctcaacctataccaaacncgtaccgtacggtaacctagagttagtacttttagaacctaaactttaacttacctacgtaaccgtaaactacctaattacgtaacttacctacctaaccccgttacttaccgttttcggaccgtaacggggtaacctaacgtacgtaggaagtacgtacgtaaacggtacgtaggtcggtacgttcgaaccgtaccgtactccgttcgttccttacgtaccgttcctcccgtaccg

SEQ ID NO: 211712 - DNA, 603 bp, Homo sapiens
  misc_feature: GYAE6OF02JFAPT.15.37.D04.1.454.CMB.1.raw
  modified_base (234)..(234): a, c, t, g, unknown or other
  misc_feature (234)..(234): n is a, c, g, or t
tcagtctacgtagccacgaccggtgctcgatttagtagcatactgttgggtttgggggagtcagacccagtcaggacacagcatggatatgagggtccccgctcagctcctggggctcctgctgctctggctcccaggtgccatgtgtgacatccagatgacccagtctccttccaccctgtctgcatctgtaggagacagagtcaccttcacttgcccggccagtacaaaatnttactaggtgttgcctggtatcagcagaaaccagggaacggcccctaagtcccctacgatacaagaacggcgtactacgtttagaagcgttcgggggtccctacaaaggtacttccagccgccgggttggactgtgggacaggaacttcacgtctacaccatcaacagtcctaggaaccctgtaacgtgtactttgctaacttattactcgtacctaacacttatagactacctacaacccgttacttaccgtttacggaccgtaagggacctaaaggccgttaggacgtactacgtaacggaccttaggtcggtcgtaacgtacctaccgatcgttcgttacccgttactacttcccttcccggtacc

SEQ ID NO: 211713 - DNA, 836 bp, Homo sapiens
  misc_feature: GYAE6OF02F6RTL.15.37.D04.1.454.CMB.1.raw
  modified_base (234)..(234): a, c, t, g, unknown or other
  misc_feature (234)..(234): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtccaccttcacttgccggccagtacaaaatnttactaggtggttgccttggtatcagcaacgaaaccaggggaacgcccctaaagtccctacatacgaaggtaacggcgttactaaccgtttaaggaacgtccgttcggggggtaccccgttacgaaaggtactttaccgaacggtccgggtcccggggttaggtaacttcggtaaggggtaaccaaaggtaaactttaccaaacctttcctaccgaaacccttaacgttacccaaaaccgtacggtaacccgttaacgggtaaaccccgttacggtaaacgtttacgtttaaacgttttttacggaaccttttaaaacctttaaagttttaaccctaacggtaacccctaaaacttacccgtttaaaagttaacgtaaaccgtttaacccttaacccgttaacccccggtttaaacgttaacgttttttaccggggaacccgggtaaaccgggggtaaccctaaacgggtaccgttagggtaaaccgtaacgttaaccgaaaacggggtaaccgttacgggttacggtaccgttacgaccccgtaaccgtactttaccgttaccgtttaccttaccgacgtttccccgttacccgttacccg

SEQ ID NO: 211714 - DNA, 689 bp, Homo sapiens
  misc_feature: GYAE6OF02I6G56.15.37.D04.1.454.CMB.1.raw
  modified_base (153)..(153): a, c, t, g, unknown or other
  misc_feature (153)..(153): n is a, c, g, or t
  modified_base (613)..(613): a, c, t, g, unknown or other
  misc_feature (613)..(613): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtcgccatgtgtgacntccagatcgacccagtcctcccttcccaccctgtctagctattcgtggtacggaacgaccgtaggacgtcctacccttactacgttcggcccggacctaagtaccaaaattacgttacgtagggttcggttcgccgttaggtactcacggacaacggtaaaccggaggggtaaccgtacccccttaacgtccctacactaacgaaggacggtctaaccgttaacttaggaacgtccggtacggggttacccgtactaagtacttacgacggtccggacggtggaacgttacgtacggacaaggtactctaccgtctacacctactaccacaaccgtccgtacgtaacttagtagttcttacttcgaacttacttattacctactaacctaactactatactactaccgtactacccgtaacttcgttaccggaccgtaacgggactaacgcgtaggtaanaccgttaagaacgtcggtagtacggctacggaacctaccgattcgtacgttactccgtacgttcccgtaccctacg

SEQ ID NO: 211715 - DNA, 155 bp, Homo sapiens
  misc_feature: GYAE6OF02HPDA9.15.37.D04.1.454.CMB.1.raw
  modified_base (152)..(155): a, c, t, g, unknown or other
  misc_feature (152)..(155): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtcgannnn

SEQ ID NO: 211716 - DNA, 629 bp, Homo sapiens
  misc_feature: GYAE6OF02FUOO0.15.37.D04.1.454.CMB.1.raw
  modified_base (212)..(212): a, c, t, g, unknown or other
  misc_feature (212)..(212): n is a, c, g, or t
  modified_base (234)..(234): a, c, t, g, unknown or other
  misc_feature (234)..(234): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaaccttnacttgccgggccagtcaaaatnttacaggtgttggcctggtatcagcaagaaaccagggaacggcccctaaagtccctcatacgaaggacggcgtctaacgtttagaaaggtctacgggggttcccctacgtaaagatttccaaggtccggaccgggtggagtcgtggggacagaaagtttcaacgtctccgacagtcaaacagcctaggaaccctagatgtattttagctaacttaacttactacgtaccaaactaactatacgtactactccaacccgttaacctacgttttcggacccgtacggggacctaacgtactaggaacgtacgttaacgaaaggaacgtaggtacggtaccgttacgacctaaccgtacgtcgtacggttacttacgtacttccgttaccccgtaccg

SEQ ID NO: 211717 - DNA, 682 bp, Homo sapiens
  misc_feature: GYAE6OF02GUFXN.15.37.D04.1.454.CMB.1.raw
  modified_base (300)..(300): a, c, t, g, unknown or other
  misc_feature (300)..(300): n is a, c, g, or t
  modified_base (345)..(345): a, c, t, g, unknown or other
  misc_feature (345)..(345): n is a, c, g, or t
  modified_base (412)..(412): a, c, t, g, unknown or other
  misc_feature (412)..(412): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggcctcccaggtgccatgtgtgacatccagatgacccagtcctccttccaccctgtctgcatctgtaggagacagagtcaccttcacttcggccggaccagtacaaaatattacgtaggtggttggcctggtatcgagcaacgaaccgagggaacgcccctaagtcccctanatacgaagaaggctactaacgttaggaagtcgtacggggtcctanaagtattcgacggcggccggtaggacttcgtagggaccagaacttcactctacacctataccaacgngccgtacggaacctgtacgtagttacgtttacgacttaactttaacgttactacgtaacccaaactaacttacgtacgaacttacctaccgttaaccccgttaccttaaccgttttaccggaccgtaaccgggggtaacctaacggtaccgtaggtaacgtaacgtaaccgaaacgggtaacgttacgggtacggtccgttaccggacccgtaacccgtacgttaccgttacgttacccgtttacttaccttaccccgttccccgtaccc

SEQ ID NO: 211718 - DNA, 696 bp, Homo sapiens
  misc_feature: GYAE6OF02JWE8F.15.37.D04.1.454.CMB.1.raw
  modified_base (240)..(240): a, c, t, g, unknown or other
  misc_feature (240)..(240): n is a, c, g, or t
  modified_base (303)..(303): a, c, t, g, unknown or other
  misc_feature (303)..(303): n is a, c, g, or t
tcagtctacgtagccacgaccggtgctcgatttagtagcatactgttgggtttgggggaggtcgagacccagtcaggacacagcatggacatgagggtccccgctcagctcctggggctcctgctgctctggctcccaggtgccatgtgtgacatccagatgacccagtcctcccttccaccctgtctgcatctgtagagacagagtcaccttcacttcgccgggacagtaccaaaattnttacgtaggtggttcgccttggtatcagcaagaaaccgtaggacgtacccctaagtcccctanataccaaaggacgacgttactaactttaggaacgtcgtacggggtccctacgaagtcttacgaccggtcggtaccggtagacgttacggtagggaaccgaagttaacttccgaccttacgtaccactactaaccgaactcgaccgtaggaccctgtaatcgtatttacgacttaacttaagtcctacgcctaaactactagtagttaacttacacccgtaacccttcgttaaccgtttaccgggacccggtaacgggtaaccgtaaacgtttccggaaagggtaactacggtaaacgttaagggaccgttaggtcggtaccgttacacccggttaaccctacgtttccgttacggttacccctttagtacccgtacccgtttacccccgtacc

SEQ ID NO: 211719 - DNA, 817 bp, Homo sapiens
  misc_feature: GYAE6OF02I8K2M.15.37.D04.1.454.CMB.1.raw
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagactcgacccagtcctccttccaccctgtctgcatctgtagacacagacgtcaccttcacgttcgccggcctagtaactaaaattacttacgtgggttggttcggccgttaggtactcgacgtacgaaacgaaaccggaaggggaaccggtccccttaacgtcccctacgtaacgaccggaaaggtaacggtcgtttaaccttaccgggttttaaaacgacgggtccgggtccgggggttaaccccgtactaaacggttagttacccggaacgggccccgttaccggggttcgggtaaacgtccgggtttaaggggaaacctaaacgggttaactttcccgaaaccgtttccaaccgtaacgtaccttaaccggaccgtcgaccccgtacggtaaccgtacgtacgttagttacgtttacgttaacttaaacttaactttacgtacccgttacctaaaccttacttaacgtaacgtacttaccttaacccgtaaccgttaacgtttaccgtttaccggtaaccgtaaccgggtacgttaaaccgtcggtacggtaaacgtacgtaacgtaacggtaacggttacggtacggtaccgtacggtaccaccgtaccgttccgttaccttaccgttacggtacctttcccgttacccgttacccg

SEQ ID NO: 211720 - DNA, 781 bp, Homo sapiens
  misc_feature: GYAE6OF02IGCA5.15.37.D04.1.454.CMB.1.raw
  modified_base (196)..(196): a, c, t, g, unknown or other
  misc_feature (196)..(196): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggngacagagtcaccttcacttggccgggccaggtaccaaaagtattacgtaggtaggttcggccttgggtactcagcaagaaaccgagggaaccggtacccctaagtccctacaactcgaaagaaggtccgttactacgttttaacggaagtcgtcggggtccgtacaaggtacttacgacgtccggcgggtaggtacgtgttacggggaactacggtaactttaccgaacctccttaacccaaccgtaacctacctaaacctaccggtacccgtaaccgggtaacccgtttacggtacgtttaacggttaactttttaccgggtaaccgttaaaaccgtttacgtttaacccggttactaacccgtaaacctaacttaacgttaacgtaaacccgttaactaccccttaacccggttaaccttaaccgggttttaccggaccgggtaaccgggtaaccgtaaaccggtacgttacggtaacggtaactaaaccggaaccgtaacggttacgtcgggaccgttaccggacctaacccggtatttcccgtacttccgtttacctacgttccccttacccgttaacccg

SEQ ID NO: 211721 - DNA, 604 bp, Homo sapiens
  misc_feature: GYAE6OF02JHBRC.15.37.D04.1.454.CMB.1.raw
  modified_base (211)..(211): a, c, t, g, unknown or other
  misc_feature (211)..(211): n is a, c, g, or t
  modified_base (235)..(235): a, c, t, g, unknown or other
  misc_feature (235)..(235): n is a, c, g, or t
  modified_base (272)..(272): a, c, t, g, unknown or other
  misc_feature (272)..(272): n is a, c, g, or t
  modified_base (292)..(292): a, c, t, g, unknown or other
  misc_feature (292)..(292): n is a, c, g, or t
  modified_base (328)..(328): a, c, t, g, unknown or other
  misc_feature (328)..(328): n is a, c, g, or t
  modified_base (394)..(394): a, c, t, g, unknown or other
  misc_feature (394)..(394): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttnacttggcccggccagtacaaaatnttacgtaggtcggttcgcctggtatcagcagaaaccngggaagcccctaagtccctnactcaagagcgtctagtttagagcgtggggtccctnaagtacttcgagcgccggtagtagtcgtagggacagtaattcgaacttcaccgacataccgaaacncgtaccgtacggaacctgtacgtgtatttgactaacttacttacacgtcaacgacttagtagtactacctccgacccgttactacgtttacggaccgtacgggaacctacgtcgtacggtagagtaccgtaacggtaacgtcggtcggtccttagtacccaccgtacgttaccgttcgttccgttacgtaccttccgttccccgtaaccg

SEQ ID NO: 211722 - DNA, 790 bp, Homo sapiens
  misc_feature: GYAE6OF02J0GX9.15.37.D04.1.454.CMB.1.raw
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcattcngtagganacagagtcaccttccacgttcggcccgggccagtacaaaaattacttaacgtagggtcggttaggccttaggtatcacgctaaggaaacctaggggaacgcccctaacgtcccgtacaataccgtaaggacggtaccgttactaaccgttttagaacggtaccggttgggggtacccccgtagtaaacggtactttccgaacggtccggtccggggaaagtttcgggtaacgtacggtaacgggtaacgtaaacggttaccttacgttcctaccgtactaaccctacgaacgtaacgtaccgtaaccgtacggaaaccttagtaaccgtttgtactttaacggtaacctttaacgtttaacgttacctaaccggtaacctaaacgttacgttaaccgtaacttaaccttaaccccgtacgtttaaacccgttaaccgtttacgggtttaccgggaaacccgggtaacggttaacctaagggtacccgtaggaactaacggttaaccgaacggttacggtaccgttacggaacgtaccgtaccgtacgtaccggttctacgtttacctacgtttaccccgttccgttaacccg

SEQ ID NO: 211723 - DNA, 743 bp, Homo sapiens
  misc_feature: GYAE6OF02G17BD.15.37.D04.1.454.CMB.1.raw
  modified_base (310)..(310): a, c, t, g, unknown or other
  misc_feature (310)..(310): n is a, c, g, or t
tcagtctacgtagccacgaccggtgctcgatttagtagcatactgttgggtttgggggagtcagacccagtcaggacacagcatggacatgagggtccccgctcagctcctggggctcctgctgctctggcctcccgaggtgccatgtgtgacatccagactgacccagtcctccttccgaccctgtctgcatctggtagagacagacgtcaccttcacttcgccggaccagtaacaaaatattacgtaggtggttcggcctggtatcacgtcaacgaaaccgagggaaccgtccccgtaacgtccctanacgtacaaggtaacgcgttactaacgtttaagaacgtccggtacgggggtacctacgaagtacttacgacggtccggtaccgggtggtaaccgtcggtacgggtaacctaaggttaacttaccgtaactccctaccgaacctaactaacgaactacgtacccgtaacgtaaccgtgtaacgttacggttactttcgaacttaacgttacgttaccacgtaacctaaacgttactaacgtacgaccttaccgtaacccgttacccgttaacgttaccggtttaccggtaaccggtaccgggtaaaccgtacgtaccggtacgggtaacgtaacgtaaccgtaacggtaacggttaggtaccggacttaccggtacccgtaactcgggttaccctcggtttaacccgttacgtaccgtttcccgtacgttacccg

SEQ ID NO: 211724 - DNA, 642 bp, Homo sapiens
  misc_feature: GYAE6OF02F4RDZ.15.37.D04.1.454.CMB.1.raw
tcagtctacgtagccacgaccggtgctcgatttagtagcatactgttgggtttgggggagtcagacccagtcaggacacagcatggacatgagggtccccgctcagctcctggggctcctgctgctctggcctcccaggtgccatgtgtgacatccagatcgacccagtcctccttcccaccctgtctgcatctggtaggacgacagacgtcctaccttcgacttcggcccgggacagtacaaaattagttacgtagggttcggttacgccgttaggtactcgagacaaacggaaaaccgaggggaaccggtaccccgttaacggtcccctagaacgtacgaaacggacggtccgttactaacgtttacggaacgtcggttacggggtccctacgaagtacttcgacggcggtcggtggatcgggaggactagtaactcacgtccactacactacaactcgccgtacggaactgattgtactttacgaccttaagttactacgacgtaacctaactactacgtacgtactacctaccgtaccttactacgtttcgaccggaggtaccgagtcgagtacgactacgaacgtacggtacgtggtactacgacactcgtcttcgttactcgtacttcctaccgtc

SEQ ID NO: 211725 - DNA, 746 bp, Homo sapiens
  misc_feature: GYAE6OF02IJTRU.15.37.D04.1.454.CMB.1.raw
tcagtctacgtagccacgaccggtgctcgatttagtagcatactgttgggtttgggggagtcagacccagtcaggacacagcatggacatgagggtccccgctcagctccgtgggctcctgctgctctggctcccaggtcgccatgtgtgacatccagatcgacccagtccttcccttccaccctgtctgcatcgtgtaggagacagacgtctaccttcgacgttcggcccgggtactaacgtacaaaaattcgttacgtagggttcggttggaccgttggtatacacgtacgaacgaaaccggaggggaaccggtacccctaaacggtcccctacgaactacgaaaggacggtaccttacgttaacgttacgaacggtcggtaccggggttcccgtaagtaacgtagtccacggccggtacggtcggacgtcgtagggactagtaactcacgtactacacctaactccaacgcgtaccgtacggtaacctgtacgttagtacgttacgtaaccttaaacgtttacgttacgtacgtacctaaaccgttactaagtacgttaacctaccgtacccgtacccgtttaacgtaccgttttaccgggaccggtaacgggtaacccgagttaccggtaaggtaaccgaagttaaccggaaaggtaaccgttgggtaccgtacccgttcgaacccttacgtactttccgttaccgttacttaccctaccggttccccttaacccggtcccg

SEQ ID NO: 211726 - DNA, 734 bp, Homo sapiens
  misc_feature: GYAE6OF02JT0NL.15.37.D04.1.454.CMB.1.raw
  modified_base (169)..(169): a, c, t, g, unknown or other
  misc_feature (169)..(169): n is a, c, g, or t
  modified_base (191)..(191): a, c, t, g, unknown or other
  misc_feature (191)..(191): n is a, c, g, or t
  modified_base (257)..(257): a, c, t, g, unknown or other
  misc_feature (257)..(257): n is a, c, g, or t
  modified_base (683)..(683): a, c, t, g, unknown or other
  misc_feature (683)..(683): n is a, c, g, or t
tcagtctacgtagccacgaccggtgctcgatttagtagcatactgttgggtttgggggagtcagacccagtcaggacacagcatggacatgagggtccccgctcagctccgtgggctcctgctgctctggctcccaggtcgccatgtgtagacatccagtatcgacccngtcctccttaccgaccctgtcngacattccgtagtaggacacgagtacgtccaaccttcacgttcggcccggctaagtactaaaattntacgtagggttggtcggccgttggtactcgaacgcgaaacgaaaccggtaagggtaccgacccccttaacggttcccctacaacgtaccgaaaggtaccggtcgttacctaaaccgtttaggaacggtccggtaccggggttacccctagaacgttaacgttccgaaccggcggtaccggtacggctacgggtaggaacctaaggtacttcgaaccgtcgtaaccaccgataaccaacggtacctcggaacgtaacgtcgtagttacgtacgttacgtacgtaaactttacgtaacgccgtaacctaacgttaactacgttacgaacctacccgtaccgttaaccgtaccgttaccgttacggaaccgttaccgggacaacgtcgtaacggacgtacaacggtacgcgttacggtcgtaccggtanacccgtactacggttactacgttacctacggttacctccgtacccgttacg

SEQ ID NO: 211727 - DNA, 919 bp, Homo sapiens
  misc_feature: GYAE6OF02GFDH9.15.37.D04.1.454.CMB.1.raw
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtcctccttccaccctgtctgctatctggtaggacgacagacgtcctaccttctacttcggcccgggacctaagtaacaaaaattacgtttaccgtaagggttcgggttcggtcccttaggggttactacgaacggtaccaaacggaaaaaccccgtaaggggggaaaccgtaccccccttaaaaggttccccctacgaaacttacccgaaaacgggtaacgggtcccgtttaccgtttaaaccgttttaagggaaaccggtttccgggtttacggggggttacccccgttacgaaaacgggttaccttttacgaacgggtcccggtacccgggggttaggtaacgttcccgggtaaggggttaaccgaaacgtttaacgtttacctaacctacccttccgaaccctaacttaacccgtaaaccgtacgttacccgtaacggtacccgttaagtacgttaggtttacgtttacgtaacgttaacctttaacttacgtacccgtaacgtaacccttaacgttaacgttcgtaaacccgttacccttaccccgttaacccgttaaccgttaccggttttacccgggacccgggtaaccggggtaaccctaacgggtaccggtaacgggtaacgttaaccgtaaccgggtaaacggtaccggtttaaccgggtcggttacccgtaccgtacccgtaacccgttagttcccgtaccggtttcccgttaccgttaccgtttcccccgttacccggtacc

SEQ ID NO: 211728 - DNA, 701 bp, Homo sapiens
  misc_feature: GYAE6OF02I1G42.15.37.D04.1.454.CMB.1.raw
tcagtctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatcgacccagtcctccttccacccgtgtctgcatctgtaggagacagacgtcaccttcgacttcggccggtccaagtactaaaattacttaacgtagggtggttcgaccttaggtatcgaacgcaacggtaaaccgaggggaaccgtaccccgtaacgtcccactacgtacgaaaggacggtccgtacttaacgttaggaacgtccggttacgggtccctagaagtcttacgacggtcggacggtgactcggtagggacagttactcgaaccttcactaccaatccgaaacgtcgtaccgtacgaacccgttgattacggttatttacggaactttaaacgtttattaacccgtacgtaaccctaactacgttaactacgtaaactcctaccgttaccctacgttacgtttccggaaccgacggtaccacgtcgtaggtaacgtacgtacgtaagcgttcggtaacggtaccgtacgtaacctaccggttacttacccgttacgtttcccgtaccgttaaccgtttccccctaccggttaaccc

SEQ ID NO: 211729 - DNA, 433 bp, Homo sapiens
  misc_feature: GYAE6OF01C3JDL.22.62.F07.1.454.CMB.1.raw
  modified_base (351)..(351): a, c, t, g, unknown or other
  misc_feature (351)..(351): n is a, c, g, or t
  modified_base (423)..(433): a, c, t, g, unknown or other
  misc_feature (423)..(433): n is a, c, g, or t
tcagacatacgcgtcacgaccggtgctcgatttagtagtcgcataaagggaaggccctagaatggcttgcactcatcgattgggatggtgataaatactacagcacatctctgaagaccagactcaccatctccagggacacctccaaaaccgggtggtcctttcaatgaccaacatggaccctgtggactcaggcacatattactgtgcccggacacgctgtcgatacaatgaatatgcagactttgactattggggccacggactcctggtctccgtctcctcggcctccaccaaggcccatcggtcttccccctggcgccctgctccaggagccactccgagagcacngcggccctgggctgcctggtcaaggtactacttccacgcgtatgtctgagcgggctgggcaaggcgcatagnnnnnnnnnnn

SEQ ID NO: 211730 - DNA, 453 bp, Homo sapiens
  misc_feature: GYAE6OF01B9EB3.22.62.F07.1.454.CMB.1.raw
  modified_base (329)..(329): a, c, t, g, unknown or other
  misc_feature (329)..(329): n is a, c, g, or t
  modified_base (443)..(453): a, c, t, g, unknown or other
  misc_feature (443)..(453): n is a, c, g, or t
tcagacatacgcgtcacgaccggtgctcgatttagtagtcgcataaagggaaggccctagaatggcttgcactcatcgattgggatggtgataaatactacagcacatctctgaagaccagactcaccatctccagggacacctccaaaaaccgggtggtcctttcaatgaccaacatggaccctgtggactcaggcacatattactgtgcccggacacgctgtcgatacaatgaatatgcagactttgactagttggggccacggactcctggtctccgtctcctcggcctccaccgaagggccccatccggtccttccccctggccnccctgcctccgaggacgccacctccgagacgcacgagccggccctgggctgcctggtacaaggactacttccacgcgttatgtctgacggcgggctgggacaaggcgacatagnnnnnnnnnnn

SEQ ID NO: 211731 - DNA, 434 bp, Homo sapiens
  misc_feature: GYAE6OF02GYR1A.22.62.F07.1.454.CMB.1.raw
  modified_base (427)..(434): a, c, t, g, unknown or other
  misc_feature (427)..(434): n is a, c, g, or t
tcagacatacgcgtcacgaccggtgctcgatttagtagtcgcataaagggaaggccctagaatggcttgcactcatcgattgggatggtgataaatactacagcacatctctgaagaccagactcaccatctccagggacacctccaaaaaccgggtggtcctttcaatgaccaacatggaccctgtggactcaggcacatattactgtgcccggacacgctgtcgatacaatgaatatgcagactttgactattggggccacggactcctggtctccgtctcctcggcctccaccaagggcccatccggtcttccccctggccgccctgctccaggacgccacctccgagacgcacagcggccctgggctgcctggtcaaggctacttccacgcgtatgtctgagcgggctggcaaggcgcatagnnnnnnnn

SEQ ID NO: 211732 - DNA, 564 bp, Homo sapiens
  misc_feature: GYAE6OF02H2MO9.22.62.F07.1.454.CMB.1.raw
  modified_base (539)..(539): a, c, t, g, unknown or other
  misc_feature (539)..(539): n is a, c, g, or t
  modified_base (541)..(564): a, c, t, g, unknown or other
  misc_feature (541)..(564): n is a, c, g, or t
tcagacatacgcgtcacgaccggtgctcgatttagtagtcgcataaagggaaggccctagaatggcttgcactcatcgattgggatggtgataaatactacagcacatctctgaagaccagactcaccatctccagggacacctccaaaaaccgggtggtcctttcaatgaccaacatcggaccctgtggactcaggcacatattactgtcgcccggacacgctgtcgatacaatgaatatgcagtactttgacttagttcggggccacggtcctcgtcggtcctccggtcctccgtcggccctccgacccgaacgggcccctagtccggttccctttcccccgtggcccgtccccgtcgcctccgacggacgcctacccgtccgagcgcaccgacggcccggtcccgtgggcctcggtcccgtagggtaccgaaacgggtacctttaacccgttcccgaccggtccggttaacgtttcggtacgtagggacgggtcccggggtacgtcgggaccggaacgggtccgaacgtagtacgncnnnnnnnnnnnnnnnnnnnnnnnn

SEQ ID NO: 211733 - DNA, 816 bp, Homo sapiens
  misc_feature: GYAE6OF01EH3QR.49.23.C01.1.454.CMB.1.raw
  modified_base (245)..(245): a, c, t, g, unknown or other
  misc_feature (245)..(245): n is a, c, g, or t
tcagagtcgagagacacgaccggtgctcgatttagtacacgtgattagggattgggggtgggctcaggaggcagagctctgggaatctcaccatggcctggacccctctcctgcctccccctcctcactttctgcacagtctctgaggcctcctatgagctgacacagtccaccctcgctgtcagtcgtccccaggacaaacggccaggatcacctgctcgtggagatgctatgaccaaaaagtntatgacttagttggtaccatcaagaagtcgacggccacggtcccctagttacgtggtctatctagtggacggaccaaccgaaaccgccccgtaccgggtaactccccgtaacgacgtacttccgtcgtcggtcctaccgtaaggtttacgggactacggtccggaccctacccgtgtaccgagtccgagggtccggggacccgtagggtacgggaagggtagtaggggtaacgggttagtaacgtttaccgtaacgtttacggtttaactaaccgtaaacgtaacgtaaccttaaacgtttaacccttaaccttacgttacgtaacgggtttaggggttacggggttacccggggtaacggggaaccggggtaaccgtaacgggtacccgttaccgggtaaccccggttacccggtaaacggggttacccaacccgggtaacccccgggtaacgggttcccccggtttacccccgggacccccccggttttacccgggtaccccctttaaccccggttttccccgggtttaccccccggtttcccccccggttccccccgttttacccccg

SEQ ID NO: 211734 - DNA, 697 bp, Homo sapiens
  misc_feature: GYAE6OF01AHISU.49.23.C01.1.454.CMB.1.raw
  modified_base (255)..(255): a, c, t, g, unknown or other
  misc_feature (255)..(255): n is a, c, g, or t
tcagagtcgagagacacgaccggtgctcgatttagtacacgtgattagggattgggggtgggctcaggaggcagagctctgggaatctcaccatggcctggaccccctctcctgcctccccctcctcactttctgcacagtctctgaggcctcctatgagctgacacagtccaccctcgctgtcagtcgtccccaggaccaaacggccaggactccacctgcctcgtggagatgctagttacgaaccaaaaagtntatgtactttagttcgtaccatacagaagtcgacggccacggtcccctgtacgtggtcatcgtagtaggacgaaccaacccgaaaccgcccgtaccggactcccgtagagtacttccgcgtcggcctacgtaaggttacggactcggtcggaccctacccgtgaccgagtaccgagggtccgggaccgtagggtcggagggtagtagggaggttgtaacgtttaccgtacgttacgttaacctacgtaaacgtacgtaacttacttaacctacttactagtaacggttgggtacgggttacgggacgggtacggaacctacggtcgttaaccggtaccgttaccgtacgggtacgaaccggtacccggaacggtcccgtccccgtacccccggttacggttcccaccggtttcccctcccggttcccccgttcccgttcccg

SEQ ID NO: 211735 - DNA, 691 bp, Homo sapiens
  misc_feature: GYAE6OF01C5PL8.49.23.C01.1.454.CMB.1.raw
  modified_base (242)..(242): a, c, t, g, unknown or other
  misc_feature (242)..(242): n is a, c, g, or t
tcagagtcgagagacacgaccggtgctcgatttagtacacgtgattagggattgggggtgggctcaggaggcagagctctgggaatctcaccatggcctggacccctctcctgcctccccctcctcactttctgcacagtctctgaggcctcctatgagctgacacagtccaccctcgctgtcagtcgtcccaggacaaacggccaggatcacctgctctggagatgcattgaccaaaaagntatgtacttagttggtaccatacaagaagtcgacggccacggcccctagtactggtcatctatgagacaaccaaacgacccgacgggactccctagagtacttctcgtcggactccgtaggtttacgggacgtagtcggaccctaccgtgaacgtacgtcgaacgggtcggggacccgaggggtcgggaagggagtcggggaagggttactaacgtttaacgtacgttaggttaacctacgtaaacgacgtaactaacgtttaacaaccttacgtacgtaacggttacgggggttacggttaccgggaacgggtaacgggaaccgaagccgtacggtacccgtaccggtaacggttacccgaacgtaccccgtaaacggtcccgtaccccggtcccccgttacggtcctaacccgttcccgtaccggtttccccccacccgtttccccg

SEQ ID NO: 211736 - DNA, 598 bp, Homo sapiens
  misc_feature: GYAE6OF01E1TB0.49.23.C01.1.454.CMB.1.raw
  modified_base (240)..(240): a, c, t, g, unknown or other
  misc_feature (240)..(240): n is a, c, g, or t
  modified_base (444)..(444): a, c, t, g, unknown or other
  misc_feature (444)..(444): n is a, c, g, or t
tcagagtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgcttattggtaccatcagaagtcacggccacggccccctgtacgtggtcatctagtggaggaccaaccgaaaccgccccgtccgggactccctagagtacttctctcggctcgtaggtttacgggacagtcggcccacccgtgacagtcgaggtcggggcccagggtggaggagtggaggtgtacttactacgtcgttacncaacgagtaactattactactactcaagttacgggtcgttcgggacggaacggacaagtccgtcggacccgttccgacggtcacgtacccgaagggtcctaccggtcccccgttacgggtcctaccgttccttcccgttcccccacccgttccc

SEQ ID NO: 211737 - DNA, 697 bp, Homo sapiens
  misc_feature: GYAE6OF01DSHET.49.23.C01.1.454.CMB.1.raw
  modified_base (241)..(241): a, c, t, g, unknown or other
  misc_feature (241)..(241): n is a, c, g, or t
tcagagtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaaagntatgcttattggtaccatcagaagtcaggccaggcccctgtactggtcatctatgagacaccaacgccctcgggactccctagagtacttcctctcggtcctaccgtaggtttacgggactaggtcggaccctaccccgttggaacctaggtaccgtaacggggtcgggggaccccgtaaggggtgggaacgggtaggttagggaaggggttgtaacgtttaaccgttaacgttacggtttaacctacgaaaccgtaaggtaaccttaacgtttaaccttaaccttaacttacgtaacggtttaaggggttcgggtttacggggaccgggaacggggtaacccaaggtccgttacggtacccggtccgtaaggttaccgacgaccccgaaggtcccgtaccggtccccccgtacgggtcctacccgtccgttcccggttccccgtccccttccccg

SEQ ID NO: 211738 - DNA, 562 bp, Homo sapiens
  misc_feature: GYAE6OF01AI7C0.49.23.C01.1.454.CMB.1.raw
  modified_base (240)..(240): a, c, t, g, unknown or other
  misc_feature (240)..(240): n is a, c, g, or t
  modified_base (331)..(331): a, c, t, g, unknown or other
  misc_feature (331)..(331): n is a, c, g, or t
tcagagtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgcttatggtaccatcagaagtcaggccaggcccctgtactggtcatctatgaggacaccaaacgccctccgggatccctagagattcnctggctcgagtttagggacagtcggccaccgtgacagtcgaggtcggggcccgagggtggaggagtggagggtgtattactagtgttactacaacagactattactactactctagtaggtcgttacgggacggtagggaccaggctacggaccgtaccgtaggtaccgacgacccgaaggccgtccgccccgtcggtcctaccgtccttccgttcccccacccgttcccg

SEQ ID NO: 211739 - DNA, 812 bp, Homo sapiens
  misc_feature: GYAE6OF01DYU0L.49.23.C01.1.454.CMB.1.raw
  modified_base (620)..(620): a, c, t, g, unknown or other
  misc_feature (620)..(620): n is a, c, g, or t
  modified_base (749)..(749): a, c, t, g, unknown or other
  misc_feature (749)..(749): n is a, c, g, or t
tcagagtcgagagacacgaccggtgctcgatttagtacacgtgattagggattgggggtgggctcaggaggcagagctctgggaatctcaccatggcctggacccctctcctgcctccccctcctcactttctgcacagtctctgacggcctcctatgagctgacacagtccaccctcgctgtcagtcgtcccaggacaaacggccaggactccaccttctcgtggagactgctattcgaaaccgaaaaagtatatacgtactttaagttacggtaacctaataccgtaaaggtaaggtaccaacgggacccgaaccgggtaccccccgttaggttaaccgttacgggttactaacgttacgttaaacgttacggaacggaaacccgaaacccggtaaaacccggtaccccggttaccccgggaaccttaccccggtaaccgaacggtacttacgttccgtacggtaccgttacgtacgggtttaacgggacgtacggtaccggtacccacccggtagaaccgtaggtaccgtagggtaccggggaccgtaacggggtaggaggtacggtagggtaggggtacgttaaacgttacgttacgtaacggttaacaacgtaanaacgtaactaacgttaaccttacgtacctacgtaggtacgggttcggacgggtacgggacgggtaacgaacggtccggtacgacccggttctaaacgggtcccgtaaccggacccggacgggtaccccnccgggttaccccccgtggtcccgtccttaccgtccccgttcccccgttacctccccgttcccg

SEQ ID NO: 211740 - DNA, 796 bp, Homo sapiens
  misc_feature: GYAE6OF01DBPSP.49.23.C01.1.454.CMB.1.raw
  modified_base (242)..(242): a, c, t, g, unknown or other
  misc_feature (242)..(242): n is a, c, g, or t
tcagagtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtcgtccccaggaacaaacggccaggatcacctgctctggagatgcattgaccaaaaagntatgtcttattggtaccatcaagaagtcaggccacgcccctgtactggtcatctagtgaggaccaccaaccgacccgtccgggactcccgtagatacttctcgtcggcttccgaggtttaggactacggtcgacccacccgtgaccgtaggttaccgacggggttcggggggaccccgtaagggggttcgggaaaggggtacgttaggggtaacggggttacgttaaacgttttaacccgttaaccgtttacgttttaaccctaaccgtaaacgtaacggttaaccttaacgttttaacccttaaccgtttaacttaccggtaaaggtttaacggggggtttaccggtttaccgggggaacggggtaacggggtaaaccccgtaacgggttacccggttaccgggtaacccggttacccggttagggttacccgaaccgggtacccccggtaaacgggttcccgttaccccggtccccccccggtttaccgggttccccttaaccggttccccgttttacccccggtccccccggtttccccctttaccccccg

SEQ ID NO: 211741 - DNA, 730 bp, Homo sapiens
  misc_feature: GYAE6OF01ETMLN.49.23.C01.1.454.CMB.1.raw
  modified_base (348)..(348): a, c, t, g, unknown or other
  misc_feature (348)..(348): n is a, c, g, or t
tcagagtcgagagacacgaccggtgctcgatttagtacacgtgattagggtagttgggggtgggctcaaggaaggcagtacgcctctagggaatcctcgaccatggcctggacccctctcctgctccccccgtcctcgacctttcgtgtccactagtctcgtgaggcctcctatgagctgacacagtccaccctggctgtctagtcggtccccaggacgaaacggccaggactcgacctgctcgtggacatgactattcgaccgaaaaagctaatcgacttattacggtaacctatacaagtaggtcgacggccgacgtcccctagtacgtacggtctagtacgtagnggaacggaaccaaccgaaaccgtccccgtacgggacttacccgtaacgaacgtaccttactcgtacgactacgtaaggttacggaacgtcgtacggccctaaccgtagacgtacgcgtaacggtaccggggacccagggtacgggaagtacgtagggtaggtactacgttaacgtacgtacgttaccgtaaccgtaacacgttacctaagttaaccgtactaacgttcgtaacgtacggttacggtcgggtaacggacggtaaccacgttacgtaaccgtaccgttaccgtacgtaccgtaccgtacccgttaacgtcccgtacccgtccccgttacggtacccgtcgttacccgtacccgttcccccgtcccccgttcccg

SEQ ID NO: 211742 - DNA, 705 bp, Homo sapiens
  misc_feature: GYAE6OF01DK0WS.49.23.C01.1.454.CMB.1.raw
  modified_base (242)..(242): a, c, t, g, unknown or other
  misc_feature (242)..(242): n is a, c, g, or t
tcagagtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtcgtccccaggacaaacggccaggatcactgctctggagatgctattcgaccaaaaagntatgacttagttaggtaccatacaagaagtcaggccacggcccctgtactggtcatctatgaggaccaaccgaaaccgccccgtacgggactcccgtaacgagtacttcgtcgtcggcctaccgtaaggtttacgggaactacggtcggacccctacccgttgacctagtccgacgggtcggggacccgaggggtacgggaaggtagtagggtagggttcgtaacgtttaacgtacgtttagtacctaacgaacgtacgaaccgttaatttaactaacttacgttacgtaacggttaagggttcgggttaccggggacgggtaacgggaaccgaacggtaccgtccggtaaccggtccgttaacggtacccgaacggtaccccgaagggtccccgttaccggtccccccttacgggttaccctaccgttcccgttacccgttaccccctaccccgttcccccg

SEQ ID NO: 211743 - DNA, 749 bp, Homo sapiens
  misc_feature: GYAE6OF01EUZZT.49.23.C01.1.454.CMB.1.raw
  modified_base (113)..(113): a, c, t, g, unknown or other
  misc_feature (113)..(113): n is a, c, g, or t
tcagagtcgagagacacgaccggtgctcgatttagtacacgtgattagggattgggggtgggctcaggaggcagagctctgggaatctcaccatggcctggacccctctcctncctccccctcctcactttctgcacagtctctgaggcctcctatgagctgacacagtcaccctcgctgtcagtcgtcccaggacaaacggccaggatcacctgctcgtggagatgacattgaaccaaaaagatatgtcttattggtacatcagaagtcacggccacggtcccctgtactggtcatctagtagacggaccaaccaacggacccgtccggtataccctacgagtactctcgtcgctcgaggttaggactaggtcgacctacctagacgagtcgaggttcggggacccaggggtaggacggtagtagggagggttagtactttaacgtacgtttaagttaccgtaactaaacgtaagaaccgtttaacttttaaccgtaactttaacccggtacgttaaacgggtttagggggtttccgggtaacccggggtaggggtaaaccggggaaccttaaacggtaccggtttaacccgggaaacccccggtttccggtaaaggggttaccccgaaccggggttaaaccccaaccggggtccttacccccccgggggtaccccctttacgggggtacccttaaccccggttcccgttttaacccccggttacccccctaacccccgtttccccgg

SEQ ID NO: 211744 - DNA, 370 bp, Homo sapiens
  misc_feature: GYAE6OF01E2Q1Y.49.23.C01.1.454.CMB.1.raw
  modified_base (302)..(310): a, c, t, g, unknown or other
  misc_feature (302)..(310): n is a, c, g, or t
  modified_base (312)..(370): a, c, t, g, unknown or other
  misc_feature (312)..(370): n is a, c, g, or t
tcagagtcgagagacacgaccggtgctcgatttagtacacgtgatttagggattgggggtgggctcaggaggcagagctctgggaatctcaccatggcctggaccccctctcctgcctcccccctcctcactttctgcacagggttgtcggcggagggaccaagtctgaccgtccgtaggtcacgcccgaaggcctggccccccctgggtcactcctcgttacccccaccccttccttcctctcctacgtcctctcgacggccgggtcgtgggaccgaacggccgtcgaaagttggatgcgnnnnnnnnnannnnnnnnnnnnnnnnnnnnnnnnnnnnnnnnnnnnnnnnnnnnnnnnnnnnnnnnnnn

SEQ ID NO: 211745 - DNA, 850 bp, Homo sapiens
  misc_feature: GYAE6OF01DQJ7H.49.23.C01.1.454.CMB.1.raw
  modified_base (628)..(628): a, c, t, g, unknown or other
  misc_feature (628)..(628): n is a, c, g, or t
  modified_base (673)..(673): a, c, t, g, unknown or other
  misc_feature (673)..(673): n is a, c, g, or t
  modified_base (759)..(759): a, c, t, g, unknown or other
  misc_feature (759)..(759): n is a, c, g, or t
  modified_base (843)..(843): a, c, t, g, unknown or other
  misc_feature (843)..(843): n is a, c, g, or t
tcagagtcgagagacacgaccggtgctcgatttagtacacgtgattagggagttggggggtgggctcaggaggcagagctctgggaatctcaccatggcctggacccctctcctgcctccccctctcactttctgcacagtctctgacgcctctatgagctgacacagtcaccctcgctgtcagtcgtccccgaaggaacgaaacggccgaaggaatccaccgtacgtcctacgtcgggagtacgtacgtctaacttacgaaccgaaaaaagtactatagttacgtttaagttacggttaaccgtactaacggtaaaggtaaacggtacgacgggtaccccgtaaccggccccggttacgttacggttacggtacgtattaaccggtagtacggaaccgtaacccgaaacccgtaaaaccccggtaaccccggtacccgggtaacccttaccccgtaaacggtcttaaccgtttaccgttccggtaccgtaccgttaacccggtaaggtttaaccggggtaaccgtcggtaaccggtaccccgtaaccgtacgtaaccgtacggtttaccggaacgggttacccggggggacccgtaacggggttagggaaacggtaggtttacgggngggttaaaccgttaatttaaaccgttcccgtttagtttaaacccnccgtaaaacgtacgtaattaactttaaccgttactaacggtacgtaacggttaggggtacccggtagggaccggtaagtaaccggngcgttaccgaccgttccgtaaacggcgtaacaccccggtagtcccggcccgtaacccgtgtcctaccttctaacccgttccccnccttccg

SEQ ID NO: 211746 - DNA, 275 bp, Homo sapiens
  misc_feature: GYAE6OF02HBUZU.49.23.C01.1.454.CMB.1.raw
  modified_base (257)..(275): a, c, t, g, unknown or other
  misc_feature (257)..(275): n is a, c, g, or t
tcagagtcgagagacacgaccggtgctcgatttagtacacgtgattagggattgggggtgggctctaggaggcagagtctctgggaatctcaccatggcctggacccctctcctgcgtcccctcctcactttctggcacagggtgttcggcggagggaccaagctgaccgtcctaggtcagcccaaggctgccccctcggtcactctgttcccgcctcctctctctcgactctgagcgggctggcaaggcgcatagnnnnnnnnnnnnnnnnnnn

SEQ ID NO: 211747 - DNA, 521 bp, Homo sapiens
  misc_feature: GYAE6OF02I963X.49.23.C01.1.454.CMB.1.raw
  modified_base (241)..(241): a, c, t, g, unknown or other
  misc_feature (241)..(241): n is a, c, g, or t
  modified_base (515)..(515): a, c, t, g, unknown or other
  misc_feature (515)..(515): n is a, c, g, or t
tcagagtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaaagntatgcttattggtaccatcagaagtcaggccaggcccctgtactggtcatctatgaggacaccaaacgaccctccgggatccctagagattctctggctccagtttagggacagtcggccacctgacagtcagtcgggcccaggtggaggatggagggtgattactactgttactcaacagacattactactactcagtagggtgttcggcggagggaccagctgaccgtcgtaggtcgacgcccaggctcgcccctcggtcactctcgtcccnccctcc

SEQ ID NO: 211748 - DNA, 533 bp, Homo sapiens
  misc_feature: GYAE6OF02GX113.49.23.C01.1.454.CMB.1.raw
  modified_base (525)..(525): a, c, t, g, unknown or other
  misc_feature (525)..(525): n is a, c, g, or t
tcagagtcgagagacacgaccggtgctcgatttagtacacgtgattagggattgggggtgggctcaggaggcagagctctgggaatctcaccatggcctggacccctctcctgctcccctcctcactttctgcacagtctctgaggcctcctatgagctgacacagtcaccctcgctgtcagtgtccccaggacaaacggccaggatcacctgctctggagatgcattgaccaaaaagatatgcttattggtaccatcagaagtcaggccaggcccctgtactggtcatctatgaggacaccaaacgaccctacgggatccctagagattctctgctccagtttaggacagtggccacctgacagtcaggtcgggccgaggtggaggagtgagggtgattactacgtgttactcgaacagactattactactactacatagggtgttcggcggagggaccagcgtcgaccgtcgtaggtcacgcccaaggcctcgcccccgtcggtccaccgtcctcgttccccncccttccc

SEQ ID NO: 211749 - DNA, 533 bp, Homo sapiens
  misc_feature: GYAE6OF02IYOD6.49.23.C01.1.454.CMB.1.raw
  modified_base (241)..(241): a, c, t, g, unknown or other
  misc_feature (241)..(241): n is a, c, g, or t
  modified_base (336)..(336): a, c, t, g, unknown or other
  misc_feature (336)..(336): n is a, c, g, or t
tcagagtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaaagntatgcttattggtaccatcagaagtcaggccaggcccctgtactggtcatctatgaggacaccaaacgccctcgggactcccgtacgagacttcnctcggctccaggtttagggacagtcggccacctgacagtcaggtcggggccgaggtggaggagtggagggtgattacgtactgttactcaacgagactattactactactcagtaggtgtcggcggaggacagcgtagaccgtcgtaggtcgacgccgagcctccgccccgtcgtccacctctcgttccctccctcc

SEQ ID NO: 211750 - DNA, 621 bp, Homo sapiens
  misc_feature: GYAE6OF02IM8IV.49.23.C01.1.454.CMB.1.raw
  modified_base (239)..(239): a, c, t, g, unknown or other
  misc_feature (239)..(239): n is a, c, g, or t
  modified_base (331)..(331): a, c, t, g, unknown or other
  misc_feature (331)..(331): n is a, c, g, or t
  modified_base (604)..(604): a, c, t, g, unknown or other
  misc_feature (604)..(604): n is a, c, g, or t
tcagagtcgagagacacgaccggtgctcgatttagtacacgtgattagggattgggggtgggctcaggaggcagagctctgggaatctcaccatggcctggacccctctcctgctcccctcctcactttctgcacagtctctgaggcctcctatgagctgacacagtcaccctcgctgtcagtcgtcccaggacaaacggccaggatcacctgctctggagatgcattgaccaaaaagntatgcttattggtaccatcagaagtcaggccaggccctgtactggtcatctatgagacaccaacgacctccgggatccctacgagtacttcnctggctccgtaaggtttacggaactaggtcggaccctaacccgtgaacgtacggttcgaacgggtcgggggacccgtagggtacgggaagggtaagtgggaaggggttagaagtttaaccgtacgttacgtttaaccgtacaaaactagaacctaattaacctaacgttaactcgtaagttaacgggttgttacgggacgggtagggaaccaaggcgtcgtaccgtcgtaggtcaagtcccgaaggccttacgccccgtcggtaccacttccncgtttcccaccgttccc

SEQ ID NO: 211751 - DNA, 519 bp, Homo sapiens
  misc_feature: GYAE6OF02HY8Z5.49.23.C01.1.454.CMB.1.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (503)..(503): a, c, t, g, unknown or other
  misc_feature (503)..(503): n is a, c, g, or t
tcagagtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctgganatgcattgaccaaaaagntatgcttaattggtaccatcagaagtcaggccaggcccctgtactggtcatctatgagacaccaaacgcctccggatcccgagagacttctcgtcggctccgaggtcacgggacaacggtcaacagttcggccatcgagtggacgtccgaggcaagaggacgaggctagactattagttgacaatacaacagacaacagttgtacttatgtcttagactgacgacagtccacgtccgtggtacacgacccgacgcccaacccntccgtctactcgtccg

SEQ ID NO: 211752 - DNA, 685 bp, Homo sapiens
  misc_feature: GYAE6OF02FEHB5.49.23.C01.1.454.CMB.1.raw
  modified_base (247)..(247): a, c, t, g, unknown or other
  misc_feature (247)..(247): n is a, c, g, or t
  modified_base (490)..(490): a, c, t, g, unknown or other
  misc_feature (490)..(490): n is a, c, g, or t
tcagagtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtcgtccccaggacaaacggccaggactcacctgctctggagatgctattacgaaccaaaaagtntatgtacttagttcggtaccatacgagtaacgtcgacggaccgacggtcccctagtacgtggtacatcgtaagtacggaacggaccaacccgaaacccgccccgtaccgggacttccccgtaacgtagtacttcctcgtcggtcctacgtagggtttacggacgtacggtccgaccctacccgtggaacctacggtacgagggtccgggggaccgtaggggtacggaggtagtgggtagggtntaacgttactacgtacgttacacaactacgtaactactttacctactacgttgagggttacgggtacggttacgggaccggtacggaacctacggtccgtacgtaccgttcgtacgtaccgaccggaccgaccggtcctacccggccccgttcggtaccctaccgttcccttaccccgtcccctacccttccccg

SEQ ID NO: 211753 - DNA, 532 bp, Homo sapiens
  misc_feature: GYAE6OF02JH21P.49.23.C01.1.454.CMB.1.raw
  modified_base (240)..(240): a, c, t, g, unknown or other
  misc_feature (240)..(240): n is a, c, g, or t
  modified_base (445)..(445): a, c, t, g, unknown or other
  misc_feature (445)..(445): n is a, c, g, or t
  modified_base (515)..(515): a, c, t, g, unknown or other
  misc_feature (515)..(515): n is a, c, g, or t
tcagagtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgcttattggtaccatcagaagtcaggccaggcccctgtactggtcatctatgaggacaccaaacgccctcgggatccctacgagacttctctggcctaccgaggtttagggacagtcggccaccgtgacagtcaggtcggggcccaggtggaggagtggagggtgattactacgtgttactcaacagactattacactactnagtagggtgttcggacggaggaccaagcgtacgaccgtcgtaggcacgaccaggcctcgcccctcggccncgtctcgtcccgcctcc

SEQ ID NO: 211754 - DNA, 556 bp, Homo sapiens
  misc_feature: GYAE6OF02GPH63.49.23.C01.1.454.CMB.1.raw
  modified_base (239)..(239): a, c, t, g, unknown or other
  misc_feature (239)..(239): n is a, c, g, or t
  modified_base (330)..(330): a, c, t, g, unknown or other
  misc_feature (330)..(330): n is a, c, g, or t
tcagagtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccagacaaacggccaggatcacctgctctggagatgcattgaccaaaaagntatgcttattggtaccatcagaagtcaggccaggcccctgtactggtcatctatgaggacaccaaaccgacctccgggatccctacgagtnttctctggctctaggtttagggacaggtcggccaccgtgacagtcgaaggtcggggcccgagggtggaggagtggtagggtgaagttactacgttgttactactaacagtactattactactactcagtagggtgtcggcggaggaccaagcgtgaccgtcgtaggtacgacgacccgaagctccgccccgttcggtccacgttcctccgttccccacccttcccg

SEQ ID NO: 211755 - DNA, 529 bp, Homo sapiens
  misc_feature: GYAE6OF02FX46N.49.23.C01.1.454.CMB.1.raw
  modified_base (239)..(239): a, c, t, g, unknown or other
  misc_feature (239)..(239): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (376)..(376): a, c, t, g, unknown or other
  misc_feature (376)..(376): n is a, c, g, or t
tcagagtcgagagacacgaccggtgctcgatttagtacacgtgattagggattgggggtgggctcaggaggcagagctctgggaatctcaccatggcctggacccctctcctgctcccctcctcactttctgcacagtctctgaggcctcctatgagctgacacagtcaccctcgctgtcagtgtccccaggacaaacggccaggatcacctgctctggagatgcattgaccaaaaagntatgcttatgtaccatcagaagtcaggccaggcccctgtactggcatctatgagacaccaaacgcctcgggatcctaganattcnctgctccagttaggacagtgccacctgacagtcaggtcgggccaggtggagngtggaggtgattacgtactgttacacaacagactatactactactacattagggtgttcggacggtaggaccagcgtcgacgtaccgtagtccgaggaccacggtcctcgtccccgtcggtcctacgttcctcgttaccccgacccttccccg

SEQ ID NO: 211756 - DNA, 582 bp, Homo sapiens
  misc_feature: GYAE6OF02GDPE9.49.23.C01.1.454.CMB.1.raw
  modified_base (329)..(329): a, c, t, g, unknown or other
  misc_feature (329)..(329): n is a, c, g, or t
tcagagtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaaagatatgcttatggtaccatcagaagtcaggccaggcccctgtactggtcatctatgaggacaaccaaacgccctcgggactccctacganattctctggctccgtaggtttagggacaggtcgaccacctgacagtcaggtcgggccgagggtggaggagtgggagggtgtaacttacgtacgtagttactacaactagaactattaactactactctaagttgggtacgttcgggacggacgggaaccaagtccgtacgaccgtaccgtaggtacaacggacccgaaggtcctccggaccccgttcggtacctaccgttccgtccgttcccccacccttccc

SEQ ID NO: 211757 - DNA, 318 bp, Homo sapiens
  misc_feature: GYAE6OF02I71SB.49.23.C01.1.454.CMB.1.raw
  modified_base (143)..(143): a, c, t, g, unknown or other
  misc_feature (143)..(143): n is a, c, g, or t
  modified_base (256)..(256): a, c, t, g, unknown or other
  misc_feature (256)..(256): n is a, c, g, or t
  modified_base (263)..(264): a, c, t, g, unknown or other
  misc_feature (263)..(264): n is a, c, g, or t
  modified_base (267)..(268): a, c, t, g, unknown or other
  misc_feature (267)..(268): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (277)..(318): a, c, t, g, unknown or other
  misc_feature (277)..(318): n is a, c, g, or t
tcagagtcgagagacacgaccggtgctcgatttagtacacgtgattagggattgggggtgggctcaggaggcagagctctgggaatctcaccatggcctggacccctctcctgcctccccctcctcactttctgcacagggtnttcggcggagggaccaagctgaccgtcctaggtcagcccaaggctcgccccctggtcactctcgttcccacctcctctctctcgactctagcggccggtctggacaacgggcnccatagnncgnnantngntcnnnnnnnnnnnnnnnnnnnnnnnnnnnnnnnnnnnnnnnnnn

SEQ ID NO: 211758 - DNA, 598 bp, Homo sapiens
  misc_feature: GYAE6OF02JDBKJ.49.23.C01.1.454.CMB.1.raw
tcagagtcgagagacacgaccggtgctcgatttagtacacgtgattagggattgggggtgggctcaggaggcagagctctgggaatctcaccatggcctggacccctctcctgctccccctcctcactctctgcacaggttctgaggcctcctatgagctgacacagccaccctggtgtcagtcgtccccaggacagacggccaggatcaccttgtttaggagattacgttaacgaaaggatagtggtacagttggtaccagacagaagacgaggccaggcccctagtcttggtagtataataaagacagtgagacggccctgaagggactcccgtagacgcgtattctacgtggtctaccgagtcctagaacgggaactaacgtacgtacctaacggttacgaacctataccgaaggtcggacgtaccgaggtacaagggaacgacgaggtctagaactagttatagtacaatacagcaagaccgtacggtagttaacttacggtcgggtagttacgggacggtaacggacaacgcgtacgacgtacgaggtcacgcgaagcctccgtcccgtcgacacgtcgtaccgtcctacccg

SEQ ID NO: 211759 - DNA, 754 bp, Homo sapiens
  misc_feature: GYAE6OF02H19OL.49.23.C01.1.454.CMB.1.raw
tcagagtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtccaccctcgctgtcagtcgtcccaggaacaaacggcaggactcactgctcgtggagatgcattacgaaccaaaaagtgtaatgtactttagttacggtaaccatacaaggaacggtcgaacggccgacggtccccgttagtacgtcggtactacgttctagtaggacggaaccaaccgaaaccgtaccccgtacggtaacctacccgtaacgacgtacgttcgtcgtcggtacctacgtaaggttacgggaacgtacggtacggtccctaacctaggaaccgtaggtacgtacgggtccggggtaccgtagggtagggaaggtaggtgggaagggttcgtaagttaccgtagttacgttaaccactaacgtaagtacttaagttaactaacttacgacgttaggttacgggttacggtaccgggtaacgggacgggtaaccgaaacggtccggttaacggtacccggttacgtaaccggtacgtaacccggaaccggtaccgggtcccgttaccccggtcccccggttcggtacccgtaacccggtttccccggtttacccggttcccccgtaccccgtttccccg

SEQ ID NO: 211760 - DNA, 741 bp, Homo sapiens
  misc_feature: GYAE6OF02I6SV9.49.23.C01.1.454.CMB.1.raw
tcagagtcgagagacacgaccggtgctcgatttagtacacgtgattagggattgggggtgggctcaggaggcagagctctgggaatctcaccatggcctggacccctctcctgcctccccctcctcactttctgcacagtctctgacggcctcctatgagctgacacagtccaccctcgcctgtactagtcgtacccccgaggaaccaaaccggcccaaggactaccaccctggccttcgtgggaaacgtcgtggccctaattccgaacccgaaaaaagtattacgtgtacgtttattccggtaacctaattaccaaggtaatccgacgggtcccgtaacggtccccttaggtaccgttcggtacctaacttctagtaggaaccggaaccaaccgaaaacccggtccccgtaccgggacttaccccgaggtactagttccgtcgccgggtccttaccgtagggtttaacggcgtacgtacggcccaccgtacgcgtacggaccggtcggtacggggcctagggcggaggtagtagggtacggtatacgttacttacgtacggttacgtacaaccgtacgtacgtaacttaccacgttactcgtagttacgggtggttcggacggggaacgtacacgtcgtaaccgtaccggtaccgtaggaccgtaacggaccgtacggtcccaccccggttcccggtcccgtaccttccgttaccgtccccttaccccgacccgttcccc

SEQ ID NO: 211761 - DNA, 560 bp, Homo sapiens
  misc_feature: GYAE6OF01D1B07.41.57.F02.1.454.CMB.1.raw
  modified_base (346)..(346): a, c, t, g, unknown or other
  misc_feature (346)..(346): n is a, c, g, or t
  modified_base (556)..(556): a, c, t, g, unknown or other
  misc_feature (556)..(556): n is a, c, g, or t
  modified_base (560)..(560): a, c, t, g, unknown or other
  misc_feature (560)..(560): n is a, c, g, or t
tcagtctatactatcacgaccggtgctcgatttagctcgatatagttgggtttggggggaagaggaagactgacggtccctgagactctcctgtgcagcctctggattcacgtttagcttggaatggatggcctgggtccgccagcctctagggaagggtctggagtgggtggccaacataaatccagatggaagtcgcaggttttatggggactctgtgaagggccgattcaccatctccagagacaacgccaggaactcactgtctctacaaatgaatagcctgagagccgacgacacggctatttattactgtgcgacaacttcagatgcagctgctaaacgngttcggggccaacgggaccctggtccaccgtctcctacaaccctccaaccgaacgggcccacgtccggtccttcccccgtggcccgtcccctcgcctccgacggacgccaccctccgagacgcacgacgccggcccgtgggcctcggccgtcggtacaacggacttactccatacgtatacgactgacggcgggcgtggcgaacggcganatgn

SEQ ID NO: 211762 - DNA, 546 bp, Homo sapiens
  misc_feature: GYAE6OF01DXGD7.41.57.F02.1.454.CMB.1.raw
  modified_base (347)..(347): a, c, t, g, unknown or other
  misc_feature (347)..(347): n is a, c, g, or t
  modified_base (419)..(419): a, c, t, g, unknown or other
  misc_feature (419)..(419): n is a, c, g, or t
  modified_base (544)..(545): a, c, t, g, unknown or other
  misc_feature (544)..(545): n is a, c, g, or t
tcagtctatactatcacgaccggtgctcgatttagctcgatatagttgggtttggggggaagaggaagactgacggtccctgagactctcctgtgcagcctctggattcacgtttagcttggaatggatggcctgggtccgccagcctctagggaagggtctggagtgggtggccaacataaaatccagatggaagtcgcaggttttatggggactctgtgaagggccgattcaccatctccagagacaacgccaggaactcactgtctctacaaatgaatagcctgagagccgacgacacggctattttattactgtgcgacaacttcagatgcagctgctaacgnttggggccaggaccctggtcaccgtctcctcaacctccaccgaacgggcccatccgtcttcccccgtggccnccctcgcctccaggacgccaccctccgagacgcacgacgccggcccgtgggcctcgccctggtcaacggacttacctccagtacgtatacgacgtgacggcggcgtggacgaacggcgacagtgnng

SEQ ID NO: 211763 - DNA, 530 bp, Homo sapiens
  misc_feature: GYAE6OF01AFR6Y.41.57.F02.1.454.CMB.1.raw
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
  modified_base (525)..(525): a, c, t, g, unknown or other
  misc_feature (525)..(525): n is a, c, g, or t
  modified_base (529)..(530): a, c, t, g, unknown or other
  misc_feature (529)..(530): n is a, c, g, or t
tcagtctatactatcacgaccggtgctcgatttagctcgatatagttgggtttgggggaagaggaagactgacggtccctgagactctcctgtgcagcctctggattcacgtttagcttggaatggatggcctgggtccgccagcctctagggaagggtctggagtgggtggccaacataaaatccagatggaagtcgcaggttttatggggactctgtgaagggccgattcaccatctccagagacaacgccaggaactcactgtctctacaaatgaatagcctgagagccgacgacacggctatttattactgtgcgacaacttcagatgcagctgctaacgagttggggccagggaaccctggtccaccgtctcctcaacctccaccaggcccatcgtccttccccngccgccctgctccaggacnccacctccgagacgcacacgccggccccgtgggcctcgcccgtggtcgaacggactacttccatagtatagactggaggcggctggcgaaggcganatgnn

SEQ ID NO: 211764 - DNA, 581 bp, Homo sapiens
  misc_feature: GYAE6OF01EL58D.41.57.F02.1.454.CMB.1.raw
  modified_base (580)..(581): a, c, t, g, unknown or other
  misc_feature (580)..(581): n is a, c, g, or t
tcagtctatactatcacgaccggtgctcgatttagctcgatatagttgggtttgggggaagaggaagactgacggtccctgagactctcctgtgcagcctctggattcacgtttagcttggaatggatggcctgggtccgccagcctctagggaagggtctggagtgggtggccaacataaatccagatggaagtcgcaggttttatggggactctgtgaagggccgattcaccatctccagagacaacgccaggaactcactgtctctacaaaatgaatagcctgagagccgacgacacggctatttattactgtgcgacaacttcagatgcagctgctaaacgattcggggccacggggaaccctggtccaccgtctccctacaacctccaccgaacgggcccacgtccgtccttcccccgtcggccgcccctcgcctccgaggacgccaccctccgagacgaccaccgacggccggccccgtcggggcctcggcccgttgggtaccgaaggacccttaccttccaattagtagtacgactggacggccgggcgtgggaccgaaacgggcgacagtgnn

SEQ ID NO: 211765 - DNA, 627 bp, Homo sapiens
  misc_feature: GYAE6OF01DLDHT.41.57.F02.1.454.CMB.1.raw
  modified_base (209)..(209): a, c, t, g, unknown or other
  misc_feature (209)..(209): n is a, c, g, or t
  modified_base (348)..(348): a, c, t, g, unknown or other
  misc_feature (348)..(348): n is a, c, g, or t
  modified_base (453)..(453): a, c, t, g, unknown or other
  misc_feature (453)..(453): n is a, c, g, or t
tcagtctatactatcacgaccggtgctcgatttagctcgatatagttgggtttggggggaagaggaagactgacggtccctgagactctcctgtgcagcctctggattcacgtttagcttggaatggatggcctgggtccgccagcctctagggaagggtctggagtgggtggccaacataaatccagatggaagtcgctaggttttanggggactctgtgaagggccattcaccatctccagagacaacgccaggaactcactgtctctacaaatgaaatagcctgagagccgacgacacggcttatttattactgtgcgacaacttcagatgcagctgctaaacgngttcggggaccaagggaacccctggtccaccgttctcctacaacctccaaccgaagggccccagtccgtccttcccccgtggccgcccctcgcctccgacggacnccacccgtccgacgacgaccacgacgccggcccgtcgggcctcgtcccgttgggtaccgaaacgggtaccttaaccgttaccctaagttacggttaagtacggtaaccgttagggaccgggtccgggggtcccgttaggggaccggtaaacgggcccgacgtaacgtaggcgag

SEQ ID NO: 211766 - DNA, 720 bp, Homo sapiens
  misc_feature: GYAE6OF01DO737.41.57.F02.1.454.CMB.1.raw
  modified_base (209)..(209): a, c, t, g, unknown or other
  misc_feature (209)..(209): n is a, c, g, or t
tcagtctatactatcacgaccggtgctcgatttagctcgatatagttgggtttggggggaagaggaagactgacggtccctgagactctcctgtgcagcctctggattcacgtttagcttggaatggatggcctgggtccgccagcctctagggaagggtctggagtgggtggccaacataaatccagatggaagtcgctaggttttanggggactctgtgaagggccattcaccatctccagagacaacgccaggaactcactgtctactaacaaatgaaatagcctagagacgcccgacgacgacggtcttatttacttactgtgccgaactaacttcatagtcgccagctagacgtaacgagttacggggaccaacgggaacccttggaccctaccgtctaccctaccaaccctcccgaaccgtaacgggcccctacgttcccggttaccccttccccccgtggcccgtacccccgttcgcccgttcccgacgggaccacccgtaaccccgtccggaaacgacgtaccgaaccgaccggcccggtccccggtacgggcccttaccgggtccccgttagggttaacccgaaacgggttacccttaaccgttacccgtaaagttaaacggtaacgttacgtaaccggttacgggaaccgggtcccggggtaaccgtcggggaacccgtaacggggtaccccgaagtaacgtagcgtaac

SEQ ID NO: 211767 - DNA, 625 bp, Homo sapiens
  misc_feature: GYAE6OF01C0ZDL.41.57.F02.1.454.CMB.1.raw
  modified_base (446)..(446): a, c, t, g, unknown or other
  misc_feature (446)..(446): n is a, c, g, or t
  modified_base (622)..(622): a, c, t, g, unknown or other
  misc_feature (622)..(622): n is a, c, g, or t
tcagtctatactatcacgaccggtgctcgatttagctcgatatagttgggtttggggggaagaggaagactgacggtccctgagactctcctgtgcagcctctggattcacgtttagcttggaatggatggcctgggtccgccagcctctagggaagggtctggagtgggtggccaacataaatccagatggaagtcgctaggttttatggggactctgtgaagggccgattcaccatctccagagacaacgccaggaactcactgtctctaacaaatgaaatagcctgagagccgacgacacggctatttattactgtgcgacaacttcaagatgcagctgactaacgattcgggggacccaagggaacccctggtccaccgtcctccctaccaaccctcccaaccgaacgggccccaacgtccggtccttccccccgtggcccnccccgtcgcctaccgagacgccacccgtccgacgacgccacgaccgccggcccgtcggggtcctacgtcccgtagggtaccaaacggtaccgtaccttaccgtaacgttacgttaagtacgaccgtaggaacgggtccggggacgtacgggaccgaacgggtcgaccgaagtaggnacg

SEQ ID NO: 211768 - DNA, 852 bp, Homo sapiens
  misc_feature: GYAE6OF01CP3RH.41.57.F02.1.454.CMB.1.raw
  modified_base (847)..(847): a, c, t, g, unknown or other
  misc_feature (847)..(847): n is a, c, g, or t
  modified_base (849)..(849): a, c, t, g, unknown or other
  misc_feature (849)..(849): n is a, c, g, or t
tcagtctatactatcacgaccggtgctcgatttagctcgatatagttgggtttggggggaagaggaagactgacggtccctgagactctcctgtgcagcctctggattcacgtttagcttggaatggatggcctgggtccgccagcctcgtaggggaagggtctgggagtggggtcggaccaacataaatccagatggaagtcgcgtagggtttttagtggggactcgtggtggaacgggccgattcaaccatctaccagagacaacgccaggaacctcactgtctactaacaaatgaaatacgcctaggacgacggcccgaacgaccgtacggtactttaattttaacgttactggtcgaccgtaacttaaaccttcgaagtattacggacctaagggtccttaggaaccgttaaaacggtacgggtttaccggggggaaccccgaaaccgggggttaaacccctttcgggttacccccgtaacccggtttccccttacccccgtttaacccgaaaaccccccgttaccccgaaaaccgggaaacccggggtccccgttaaacccggttcccccgggtttcccccgtttaccccccccggtcggggtccccccggttcccccgttaccggtacccgttaccccggaacggggaacccgtcccccggtaaaccccggttcccggaaacggaaccgaacccgaaccggaaccgggtccccggggaacccgttcggggtccgtccggttcccggttacgggtaccgtaacgggtacccttaccgtaacctacgttagtacgtacggtacgtaggacggtcgggacgtgggaccgaacgggtccatacgngngcg

SEQ ID NO: 211769 - DNA, 579 bp, Homo sapiens
  misc_feature: GYAE6OF01B9CQK.41.57.F02.1.454.CMB.1.raw
  modified_base (209)..(209): a, c, t, g, unknown or other
  misc_feature (209)..(209): n is a, c, g, or t
  modified_base (356)..(356): a, c, t, g, unknown or other
  misc_feature (356)..(356): n is a, c, g, or t
  modified_base (512)..(512): a, c, t, g, unknown or other
  misc_feature (512)..(512): n is a, c, g, or t
  modified_base (574)..(574): a, c, t, g, unknown or other
  misc_feature (574)..(574): n is a, c, g, or t
  modified_base (579)..(579): a, c, t, g, unknown or other
  misc_feature (579)..(579): n is a, c, g, or t
tcagtctatactatcacgaccggtgctcgatttagctcgatatagttgggtttggggggaagaggaagactgacggtccctgagactctcctgtgcagcctctggattcacgtttagcttggaatggatggcctgggtccgccagcctctagggaagggtctggagtgggtggccaacataaatccagatggaagtcgctaggttttanggggactctgtgaagggccgattcaccatctccagagacaacgccaggaactcactgtctctaacaaatgaatacgcctgagacgccgacgaccacggcttaatttattacgtgtgacgactaattcagatgcagctagcgtaacgngttcgggccgacgggaaccctggtaccaccgtctccctacaaccctccaacccgacggcccaacgtcccggtcccttcccccgtcggccctccccgtcgtcctaccgacggacgcctaccgcccgtagacgaccacgtcgcccggtccgtcgggcncgtcgtcggacaagtacctactccatagtatacgacgtagacggcggctggacgacggacanagtgn

SEQ ID NO: 211770 - DNA, 752 bp, Homo sapiens
  misc_feature: GYAE6OF01BN010.41.57.F02.1.454.CMB.1.raw
tcagtctatactatcacgaccggtgctcgatttagctcgatatagttgggtttggggggaagaggaagactgacggtccctgagactctcctgtgcagcctctggattcacgtttagcttggaatggatggcctgggtccgccagcctcgtagggaagggtctggagtgggtggccaacataaatccagatggaagtcgcaggttttatggggactctgtggaagggccgattcaccatctccagagacaacgccaggaactcactgtctctaacaaatgaatagcctagagacgccgacgacacggcttatttattactgtgcgaacacttcagatcgacagctgaccgttaaacggagtttcggggggacccaacgggggtaacccccttgggtaccccgtaaccccggttcccttaccccctaccgaaacccccttaccccgaaaccccggaaaccggggtaccccctaaccgtttccccgggtttacccccttttccccccccggtcgggcccccggtccccccgttcgcccgttacccgaacgggacccgccctaacccccgttacccggaacggaccgacccaaccgaaccgggccccgggcccccggttggggcccgttcggacccgttcgggtaaccgaacgggtaccctttaccgtttacccgaattaacgtaagttaacggtaccgttaggacgggccggggtaccgtacggggaccgaaacggggcccagtacgtaggcag

SEQ ID NO: 211771 - DNA, 561 bp, Homo sapiens
  misc_feature: GYAE6OF01DEWXN.41.57.F02.1.454.CMB.1.raw
  modified_base (544)..(544): a, c, t, g, unknown or other
  misc_feature (544)..(544): n is a, c, g, or t
  modified_base (556)..(556): a, c, t, g, unknown or other
  misc_feature (556)..(556): n is a, c, g, or t
  modified_base (561)..(561): a, c, t, g, unknown or other
  misc_feature (561)..(561): n is a, c, g, or t
tcagtctatactatcacgaccggtgctcgatttagctcgatatagttgggtttggggggaagaggaagactgacggtccctgagactctcctgtgcagcctctggattcacgtttagcttggaatggatggcctgggtccgccagcctctagggaagggtctgggagtgggtggccaacataaatccagatggaagtcgctaggttttatggggactctgtgaagggccgattcaccatctccagagacaacgccaggaactcactgtctctaacaatgaatagcctgagagccgacgacacggcttatttattacgtgtcgcgactacttcagtatgcagctgactaacggagttcggggaccagggaaccctggtccaccgtcctcctacaccctccaaccgacgggcccagtccgtccttcccccgtggcccgtcccgtgacctccgacggacgccaccctccgagcgacacgacggccggccgtgggctcggcctggaccaaggtacctacttccatacgtatacgctggacggcggcgnggacgaggtcangtagn

SEQ ID NO: 211772 - DNA, 971 bp, Homo sapiens
  misc_feature: GYAE6OF01EKTI4.41.57.F02.1.454.CMB.1.raw
tcagtctatactatcacgaccggtgctcgatttagctcgatatagttgggtttggggggaagaggaagactgacggtccctgagactctcctgtgcagcctctggattcacgtttagcttggaatggatggcctgggtccgcagcctcgtagggaaggtctggagtggggtgccaacataaatccagatggaagtcgctaggttttagtcggggacttcgtggtaggaacggggcccgtaatttccaaccctaattcccgtaccaaggaacgaaccaaaccggccgaagggaaaccttaccaacgttcgttacctacttaaacaaaaattggtaaaataacggcccttagggaaacgacgaccccggaaccgtaaccgaaccgggttccttaaattttttaagttaaccgtggttcggaccgaaacctaaactttccgaagtattcgacgtaagcttgacgtaaaaccggtgtttacgggggacccaacggggttaacccctgggtacccgaaaccccggtttcctacccctacccgtaaaccccgtccccgaaaacccgggaaccggggtaccccctaacggttccccgggtttacccccgtttcccccccggttacgggacccccgtcccccgttaccggtacccgttaacccggaacgggtaccgaaccccgtaaccccgttacccgggaaacggtacccgaacccgtaacgaaccccgggtcccgggtaacccccggtcggggttacccgttaaccgggtcccggtttaaccggggtaaccggtaaaacccgggttaaccccgtttaaacccgttttaacccggaaaacgtttttaaacccggggttaaaagttaaaccggggttcccggtttaacggggaaaccggggtccccgggggtaacgtttacccggggggaaaccccgtaaaacgggtacccgggtaacgtaaccgtttaagggcctagg

SEQ ID NO: 211773 - DNA, 800 bp, Homo sapiens
  misc_feature: GYAE6OF01B273S.41.57.F02.1.454.CMB.1.raw
  modified_base (180)..(180): a, c, t, g, unknown or other
  misc_feature (180)..(180): n is a, c, g, or t
  modified_base (792)..(792): a, c, t, g, unknown or other
  misc_feature (792)..(792): n is a, c, g, or t
  modified_base (797)..(797): a, c, t, g, unknown or other
  misc_feature (797)..(797): n is a, c, g, or t
  modified_base (800)..(800): a, c, t, g, unknown or other
  misc_feature (800)..(800): n is a, c, g, or t
tcagtctatactatcacgaccggtgctcgatttagctcgatatagttgggtttgggggaagaggaagactgacggtccctgagactctcctgtgcagcctctggattcacgtttagcttaggaatggatggcctggtccgcagcctgtaagggaaggttcgtggagtgggtcgaccaaanaataaactccgaagagtagggaacgtcgacgttaagggtttttaggcggggtacctcgttggtacggaacggggtccctattaccaccacttacctccgaagacgaccgaaccgcgtaacggactcgacgttcgtacctactaacctaaagtcgtaagtacgcctaggaaccgtacgaccggtaccgaacgtacggttacttttaacgtttaacgtttactcgggtacgtaaccggaaactttaaccgttcgaaaggtacgtcgaactcgtacgtaccgtaaccgtaacggtcggtaaccggggaccgtaaccgggtacccttacgggtaccctaccgtttacccgacccgtaaccccgtaaccccttacccgaacgggtaacccggtccctttaccggtacccgttccccccgtttccccggtagggtcccccgtaccggtacgttacccgtaacgggacgtcccggacccttacccgtaacggacaccgaccgtcggaccgtaccggtcccgtagggtccctgggtacccgtcgtaacgacgtaccttaccgtgttaagctttaacggacgtaccggtgaccggggtcgacggtcgaacgtacggtcaancgtangtn

SEQ ID NO: 211774 - DNA, 706 bp, Homo sapiens
  misc_feature: GYAE6OF01DZCX6.41.57.F02.1.454.CMB.1.raw
  modified_base (702)..(702): a, c, t, g, unknown or other
  misc_feature (702)..(702): n is a, c, g, or t
tcagtctatactatcacgaccggtgctcgatttagctcgatatagttgggtttggggggaagaggaagactgacggtccctgagactctcctgtgcagcctctggattcacgtttagcttggaatggatggcctgggtccgccagcctctagggaagggtctggagtgggtggccaacataaatccagatggaagtcgctaggttttagtggggactcgtgtgaagggccgattcaccatctccagagacaacgccaggactcactgtctctaacaaatgaatacgcctagagacgccgacgacgacggtcttatttattactgtgacgactaacttcagtatgcagctacgactaacgtggttacggggaccgacggggtaaccctcggtccgtacccgttcctaccctaccaaccctacccgaaccgaaccgggcccctaacgttcccggttaccccttcccccgtcggccccgtcccgtcgcccgtaccgacggaccgccacccgtccggacgaccgaccgaccgaccgggtcccggtcccggtcgggtccgttccggtcccggttagggtaacccgtaaacgggtaccctttaacccgttaccgtaaagttaacgttaacgtaacggtaccggtagggaacggggtccggggtaaccgtacggggaacccggtaacggggaccctacggtaacgttgngacg

SEQ ID NO: 211775 - DNA, 528 bp, Homo sapiens
  misc_feature: GYAE6OF02GX08R.41.57.F02.1.454.CMB.1.raw
  modified_base (527)..(528): a, c, t, g, unknown or other
  misc_feature (527)..(528): n is a, c, g, or t
tcagtctatactatcacgaccggtgctcgatttagctcgatatagttgggtttgggggaagaggaagactgacggtccctgagactctcctgtgcagcctctggattcacgtttagcttggaatggatggcctgggtccgccagcctctagggaagggtctggagtgggtggccaacataaatccagatggaagtcgcaggttttatggggactctgtgaagggccgattcaccatctccagagacaacgccaggaactcactgtctctacaaatgaatagcctgagagccgacgacacggctatttattactgtgcgacaacttcagatgcagctgctaacgattggggccagggaaccctggtcaccgtctcctcaacctccaccaagggcccatccggtccttcccccgtggccgccctcgcctccacggacgccaccctccgagacgcacacgccggcccgtgggcctgcctggtcaaggactacttccatagtatagactgagcgggctggcaggcgcatgnn

SEQ ID NO: 211776 - DNA, 562 bp, Homo sapiens
  misc_feature: GYAE6OF02IQ1XF.41.57.F02.1.454.CMB.1.raw
  modified_base (562)..(562): a, c, t, g, unknown or other
  misc_feature (562)..(562): n is a, c, g, or t
tcagtctatactatcacgaccggtgctcgatttagctcgatatagttgggtttggggggaagaggaagactgacggtccctgagactctcctgtgcagcctctggattcacgtttagcttggaatggatggcctgggtccgccagcctctagggaagggtctggagtgggtggccaacataaatccagatggaagtcgcaggttttatggggactctgtgaagggccgattcaccatctccagagacaacgccaggaactcactgtctctacaaatgaatagcctgagagccgacgacacggctattttattactgtgcgacaacttcagatgcagctgctaacgagttggggccagggaaccctggtcaccgtctcctcaacctccaccaacgggcccacgtccgtccttccccctggccgccctcgcctcccgacggacgccaccgtaccgagacgcaccacgcggcccgtcgggcgtcgccgtcggtaccgaaacgggacctaacttccgaagttagtaatacgactcggagtcgggctggcgaacgggcgacgatagn

SEQ ID NO: 211777 - DNA, 547 bp, Homo sapiens
  misc_feature: GYAE6OF02GG0X9.41.57.F02.1.454.CMB.1.raw
  modified_base (545)..(546): a, c, t, g, unknown or other
  misc_feature (545)..(546): n is a, c, g, or t
tcagtctatactatcacgaccggtgctcgatttagctcgatatagttgggtttgggggaagaggaagactgacggtccctgagactctcctgtgcagcctctggattcacgtttagcttggaatggatggcctgggtccgccagcctctagggaagggtctggagtgggtggccaacataaatccagatggaagtcgcaggttttatggggactctgtgaagggccgattcaccatctccagagacaacgccaggaactcactgtctctacaaatgaatagcctgagagccgacgacacggctatttattactgtgcgacaacttcagatgcagctgctaacgattggggccagggaaccctggtcaccgtctcctcaacctccaccaacggcccatcgtccttccccgtggccgccctgcctcccgaggacgccaccctccgagacgcacacgccggcccgtgggcctcgcccgtggtaccaacggaccttaccttccattagtactagactgacggcgggcgtggacaagggccgacagtagnng

SEQ ID NO: 211778 - DNA, 591 bp, Homo sapiens
  misc_feature: GYAE6OF02IPPSB.41.57.F02.1.454.CMB.1.raw
  modified_base (589)..(590): a, c, t, g, unknown or other
  misc_feature (589)..(590): n is a, c, g, or t
tcagtctatactatcacgaccggtgctcgatttagctcgatatagttgggtttggggggaagaggaagactgacggtccctgagactctcctgtgcagcctctggattcacgtttagcttggaatggatggcctgggtccgccagcctctagggaagggtctggagtgggtggccaacataaatccagatggaagtcgcaggttttatggggactctgtgaagggccgattcaccatctccagagacaacgccaggaactcactgtctctacaaatgaatagcctgagagccgacgacacggctatttattactgtgcgacaacttcagatgcagctgctaacgagttcgggggccaaggggaacccctggtccaccgttcctcctccaaccctccaaccgacgggcccacgtccggtccttcccccgtggcccgccctgcctccgacggacgccaccctccgacgacgccacgacgccggcccgtgggcctcggcccgtcggtaccgaacgggtaccttaaccgttccaagttacgtaattacggacgtggacggccgggtcgtcgggacgaacgggccgacacgtgnng

SEQ ID NO: 211779 - DNA, 568 bp, Homo sapiens
  misc_feature: GYAE6OF02GTFUC.41.57.F02.1.454.CMB.1.raw
  modified_base (342)..(342): a, c, t, g, unknown or other
  misc_feature (342)..(342): n is a, c, g, or t
  modified_base (566)..(566): a, c, t, g, unknown or other
  misc_feature (566)..(566): n is a, c, g, or t
tcagtctatactatcacgaccggtgctcgatttagctcgatatagttgggtttgggggaagaggaagactgacggtccctgagactctcctgtgcagcctctggattcacgtttagcttggaatggatggcctgggtccgccagcctctagggaagggtctggagtgggtggccaacataaatccagatggaagtcgcaggttttatggggactctgtgaaggccgattcaccatctccagagacaacgccaggaactcactgtctctacaaatgaatagcctgagagccgacgacacggctatttatactgtgcgacaacttcagatgcagctgctaacgnttcggggccagggaccctggtcaccgtctcctcaacctccaccaagggcccagtccggtccttccccgtggcccgtccctcgcctccgacggacgccaccgtccgagacgcacacggccggcccgtcgggctcgccgtggtaccaaacggtacctacttccgaagttacgtactacggactaggacggtccgggacgtcgggaccgaagggccgacaacgtagncg

SEQ ID NO: 211780 - DNA, 615 bp, Homo sapiens
  misc_feature: GYAE6OF02FHBT1.41.57.F02.1.454.CMB.1.raw
  modified_base (316)..(316): a, c, t, g, unknown or other
  misc_feature (316)..(316): n is a, c, g, or t
  modified_base (583)..(583): a, c, t, g, unknown or other
  misc_feature (583)..(583): n is a, c, g, or t
  modified_base (613)..(613): a, c, t, g, unknown or other
  misc_feature (613)..(613): n is a, c, g, or t
tcagtctatactatcacgaccggtgctcgatttagctcgatatagttgggtttggggggaagaggaagactgacggtccctgagactctcctgtgcagcctctggattcacgtttagcttggaatggatggcctgggtccgccagcctctagggaagggtctggagtgggtggccaacataaatccagatggaagtcgcaggttttatggggactctgtgaagggccgattcaccatctccagagacacgccaggaactcactgtctctacaatgaatagcctgagacgccgacgacaccggctatttatactgtncgacaacttcagatgcagctgactaacgattggggccaggggaaccctggtcaccgtctcctaccaaccctccaacccgaacgggcccacgtcccggtccctttccccccgtgggccccgtccccgtcgacccgttcccgacgggacgccaccctcccggagacgccacgacggccggccccgtgggcctcgcccgtgggtaccgaacggtaccttaccgttcccaagttacgtaacgtacggtaacgtggaacggccgggtaccgngggtaccgaacgggccgtacgaagtacggncg

SEQ ID NO: 211781 - DNA, 725 bp, Homo sapiens
  misc_feature: GYAE6OF02GVLCS.41.57.F02.1.454.CMB.1.raw
  modified_base (212)..(212): a, c, t, g, unknown or other
  misc_feature (212)..(212): n is a, c, g, or t
tcagtctatactatcacgaccggtgctcgatttagctcgatatagttgggtttggggggaagaggaagactgacggtccctgagactctcctgtgcagcctctggattcacgtttagcttggaatggatggcctgggtccgccagcctcgtagggaagggtctggagtgggtggccaacataaatccagatggaagtcgcgtaggttttagnggggtactctgtggaagggccgtattcacatctccagacacacgcaggactcactgtctcaacaatgaatacgcctagagacgccgacgacgacggattattacgttactgtcgaccgtaacctaacctttgaagtagttcggacctaagtccgttacgtacctaaaccggtaggttaccgggggtacccgaaacggggttaaccctgggtaccccgtaaccggttccttaccccttaacctaaccccgtcccgtaaaacccggaaccgggtacccctacggttccccggtttccctttacccccggcggtaccccgccccgttcggcccgttaccggaacggtaccgtcccgtaaaccccgttccgggaagtaacccgcgtaaccggaccggtcccgggtcccgtgggccttccgccgtacggtaccaacggtcctacccttgaacttacgtagtacggtacgtacggcggaccggtcggtacggactaacgggccgtagtagaggcgtacg

SEQ ID NO: 211782 - DNA, 802 bp, Homo sapiens
  misc_feature: GYAE6OF02HSLHF.41.57.F02.1.454.CMB.1.raw
  modified_base (95)..(95): a, c, t, g, unknown or other
  misc_feature (95)..(95): n is a, c, g, or t
  modified_base (215)..(215): a, c, t, g, unknown or other
  misc_feature (215)..(215): n is a, c, g, or t
  modified_base (352)..(352): a, c, t, g, unknown or other
  misc_feature (352)..(352): n is a, c, g, or t
tcagtctatactatcacgaccggtgctcgatttagctcgatataggttgggtttagggggaagaggaagactgacggtccctgagactctcctgngcagcctctggattcacgtttagcttggaactggatggcctgggtccgccagcctcgtagggaaggtctggagtgggtgccaacataaaatccagatagggaagtcgctaggtttttagnggggtactcgtgtaggaacgggtccaagttccaccgtactctacgagacgacaacgccgaagactccagtctctactaacgaatagaatacgacctgaagacggccgaacggacgacgtactatttacgtatggtanccgaactaacttcagtatcgactacacgtgtactaaacgtacgttacggggaccgaacggttaaacccgtcggtaccaacccggttccgtttccctaacctaaacccccgtacccgaacccgaaaccggggtccccctaaacgtccccggtttaaccccgtttacccccccggtccggtaccccgtcccgttaacccgtcccgtttaaccccggtaaccgggaaccgttacccgaacccccggtttaaccggtaaacgggacccgtaccaaccgaaccgggtccccgggtaccccggtaacccggggtccgtcccggtaccggttaccggttaccgggtaaacgggtaccctaccgtttaacccgagtttaacggtcgtaaccggtaacggttaacggaccggtcgggtacccggttcggaaggaccggtacgaaccggagtagaacgcg

SEQ ID NO: 211783 - DNA, 769 bp, Homo sapiens
  misc_feature: GYAE6OF02JH2XM.41.57.F02.1.454.CMB.1.raw
  modified_base (141)..(141): a, c, t, g, unknown or other
  misc_feature (141)..(141): n is a, c, g, or t
  modified_base (179)..(179): a, c, t, g, unknown or other
  misc_feature (179)..(179): n is a, c, g, or t
  modified_base (213)..(213): a, c, t, g, unknown or other
  misc_feature (213)..(213): n is a, c, g, or t
  modified_base (766)..(766): a, c, t, g, unknown or other
  misc_feature (766)..(766): n is a, c, g, or t
tcagtctatactatcacgaccggtgctcgatttagctcgatatagttgggtttggggggaagaggaagactgacggtccctgagactctcctgtgcagcctctggattcacgtttagcttggaatggatggcctgggtccncagcctacgtagggagggtctggacgtgggtgaccaanataaatccagagtggaagtcgcgtaggttttagngggactgtgtggacgggcctattcacctatccgtacaggtacgaccgaaccgtccgaacggtaacctctaaccgttgttccttacgtaaacgaaatttacggaacttaacggcctgggaacgtacggacccgtacgaacgacggtacttattttagtaccgttggcgaacgtactaacttgagtcgtgacagtcgtacggaaccgtaagtacggggttccggggacccgtaacggggtaaacccttggggacccttaccgtccgttaccctaacccgaaccttaccccgaacgggtaacccgtaccccgtagttaccccggttccctttaccccggtaccggtccccgtcccggtaccgtaccggtaccgtaccgggaccgtacccgtacccgtcggaacgaccgacgaccgaccgggccgtccggacggtcctacgtcgtagtaccgtaacgaccttacgaccgttaagtaccggtttagacggtaccggttaggtaccggtaccggtccggtaggaacccggtacggggaccttaacggagaccgggttanacg

SEQ ID NO: 211784 - DNA, 497 bp, Homo sapiens
  misc_feature: GYAE6OF01C7LWK.43.86.H09.1.454.CMB.1.raw
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtggtctggcactgatttcacactgacaatcagcagggtgaggctgaggatgttgggtttattactgcatgcaacttcacactggcctccgttcactttggccagggaccaggtgagatcaaacgatgtgctgcncntc

SEQ ID NO: 211785 - DNA, 504 bp, Homo sapiens
  misc_feature: GYAE6OF01CSWEX.43.86.H09.1.454.CMB.1.raw
  modified_base (407)..(407): a, c, t, g, unknown or other
  misc_feature (407)..(407): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctactgaattggattcagcagaggccaggccaatctccaaggcgacctaatttataaggtttctaaccgggactctggggtcccagacagattcagcggcagtgggtctggcactgatttcacactgacaatcagcaggtgagctgaggntgttgggtttatactgcatgacaacttcactactggcctccgttctactttggccagggaccaagggtgagatcaaacgactgtggactgcncntcg

SEQ ID NO: 211786 - DNA, 587 bp, Homo sapiens
  misc_feature: GYAE6OF01B7I2L.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactcgtggggtcccagacagattcagcggcagtgggtctggcactgatttcacactgacaatcagcgagggtggaggcgtggaggtagttggtttgggtttttattacgttggtctagttgacctaaactttcaacctaaccgttcggtcccttccgtttcctaccgtttttcggacccgtacgggggaacccgtaagggtggaaggagttaccgaaaccggtaacgttcggtacggtcgtagccaccgtagttaccg

SEQ ID NO: 211787 - DNA, 932 bp, Homo sapiens
  misc_feature: GYAE6OF01BWSGZ.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctccgtggggctgctaatgctctgggtcccaggatccgggtggggatgttgtgatgactcagtctccactctccctgcccgtcacccttgggcacgccggcctccatctcctgcaggtctagtgaaacgcctcgtacacgttgatggaaacacctacttgaattggattcagcaggaggccaggccaatcctaccgaaaggccgtaccttaaagttttaagtaaacgggttttaccgtaaacccggggtacttccggttacgggggttaccccaaggtaaccgtaacggtacgtttacccgaagggtcccgggtacgtaacggggttcggggttcctaggggtaccctaaaccgtttggtaactttttacccgaaccgtaaccgttacggtaaacctaaacgttaccgaacgggtacccgggtaaagggggttacggggtaacggggtaccgttaaggggtaacggggttaacggttttacggggttttttagggggttttttttaaacgttttaaccggtttacgggttaccgttaaacggtttaaccgggtaacccttaaaaacccgtttttacccgaaacccggttaacccgtttacccggggttacccccttttacccgggttttacccgttaacccggtttttttaccgggggtaaccccgggtaaaccgggggggttaaaccccgttaaaacgggggtttacgggggtaaaaccggttaaaccggttaaacccggtaaaaaaccgggttaaaccggttacggggttaccgggtaccgttaccggtaacccgtaaaccccgttaacgttttaaccccgg

SEQ ID NO: 211788 - DNA, 618 bp, Homo sapiens
  misc_feature: GYAE6OF01AOPWF.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccgttgggcagcccggcctccatctcctgcaggtctagtgaaagcctcgtacacgttgatggaaacacctactgaattggattcagcaggacggccaggccaatcctccaaaggccgaccctaaattttacgtaacggttttcctaaaccggggtactccgtagggggtccccaggaccagattcaggcggcaggtggtcgtggcactgactttcacactgacaatcgagcgagggtggaggtcgtggagggtagttggtttagggttttattacgttgtctagttaggactaaacttcgacctaacgtcggtcccttcccgttccgtacgttttcggacccgtaaggggaccgtaaagggtcggaaggtacgtacgaaaccggtaacgttacggtacggtacgttacgacctaaccgtgttcccg

SEQ ID NO: 211789 - DNA, 544 bp, Homo sapiens
  misc_feature: GYAE6OF01DGYSH.43.86.H09.1.454.CMB.1.raw
  modified_base (301)..(301): a, c, t, g, unknown or other
  misc_feature (301)..(301): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgttctgggtcccaggatccggtggggatgttgtgatgactcagtctccactctccctgcccgtcacccttgggcagccggcctccatctcctgcaggtctagtgaagcctcgtacacgttgatggaaacacctacttgaattggattcagcagaggccaggccaatctccaaggcncctaatttataaggttttctaaccgggactcgtgggtcccagacagattcagcggcagtgggtctggcactgatttcacactgacaatcagcagggtgaggctgaggatgtttgggtttattactgtcatgactaaacttcactacgtgtcccttccgttactacgttttggacgtacggggacctaaagggtggaacgaatacgaaaacgaacgtggtaggtctagaccacctagtcttacg

SEQ ID NO: 211790 - DNA, 521 bp, Homo sapiens
  misc_feature: GYAE6OF01CKC17.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtgaggctgaggatgttgggtttatactgcatgacaacttcactactgccttccgttctacgttttggccaggggaccaagggtcggagactcgaaacgaactggtcggactgcaccgtagtccg

SEQ ID NO: 211791 - DNA, 542 bp, Homo sapiens
  misc_feature: GYAE6OF01D6WGH.43.86.H09.1.454.CMB.1.raw
  modified_base (536)..(536): a, c, t, g, unknown or other
  misc_feature (536)..(536): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgaatggaaacacctacttgaattggattcagcagagccaggccaatctcaagcgacctaatttataaggtttctaacggactcgtgggtcccagacagattcagcggcagtgggtctggcactgatttcacactgacaatcagcgaggtggagctgaggatggttggttttatactgcagtgactaaacttcaactactacggcccttccgttctacgttttcggaccgtaggggtacctaaagggtggtaagagttacgaaaacgtaacgtcgtacgggactgccacgngtaccg

SEQ ID NO: 211792 - DNA, 531 bp, Homo sapiens
  misc_feature: GYAE6OF01DA02I.43.86.H09.1.454.CMB.1.raw
  modified_base (382)..(382): a, c, t, g, unknown or other
  misc_feature (382)..(382): n is a, c, g, or t
  modified_base (528)..(528): a, c, t, g, unknown or other
  misc_feature (528)..(528): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaacacctacttgaattggattcagcagaggccaggccaatctccaaggcgacctaatttataaggtttctaaccgggactcgtggggtcccagacagattcagcggcagtgggtctggcatgatttcacnctgacaatcagcgagggtggaggcgtgagggtattggtttgggttttattacgtgctatgactaacttcactactcggcccttcgttctacgtttcggaccgagggaccaagggtggagatacaaacgtaatgtggctgaccactntcg

SEQ ID NO: 211793 - DNA, 534 bp, Homo sapiens
  misc_feature: GYAE6OF01CIVVU.43.86.H09.1.454.CMB.1.raw
  modified_base (301)..(301): a, c, t, g, unknown or other
  misc_feature (301)..(301): n is a, c, g, or t
  modified_base (436)..(436): a, c, t, g, unknown or other
  misc_feature (436)..(436): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaagcncctaatttataaggttctaaccgggctcgtgggtcccagacagatcagcgcagtggtctggcactgattcacactgacatcagcgaggtgagatgaggtagtgttaggtttatacgtgcatgactaaacttcacncgtgcccttccgttctacgttttcggaccgtacggggacctaaagggtggaagtaactaccgaaacgtaactggtacggacgtagcaaccgtgttccg

SEQ ID NO: 211794 - DNA, 515 bp, Homo sapiens
  misc_feature: GYAE6OF01BRAP0.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactgcatgcaacttcactactggcctccgttcacttttggcctaggggacctaaggtggagagtcaaacgactgtggctagcacctgtcg

SEQ ID NO: 211795 - DNA, 515 bp, Homo sapiens
  misc_feature: GYAE6OF01AJDE8.43.86.H09.1.454.CMB.1.raw
  modified_base (512)..(512): a, c, t, g, unknown or other
  misc_feature (512)..(512): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctggaggattggttgggttttattacgttgctatgacaacttcactactggcctccgttcactttgcctaggggaccaaggtggagatcaaacgactgtcggctgcacntcg

SEQ ID NO: 211796 - DNA, 595 bp, Homo sapiens
  misc_feature: GYAE6OF01A2I4A.43.86.H09.1.454.CMB.1.raw
  modified_base (302)..(302): a, c, t, g, unknown or other
  misc_feature (302)..(302): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcncctaatttataaggtttctaaccgggatcgtggggtcccagacagattcagcggcagtgggtctggcactgatttcactactgacaatcagcgagggtggaggctaggagggtagttggtttagggttttattacgtgtactagttaggtactaaacttcaactaccttgggcccttccggttcctaccgtttttcgggacccggtaggggtaacccgtaagggtcggtaggtaacgtacgaaaaccggtaacgtcggtacgggtacttacggacctaaccgtagtttaccgg

SEQ ID NO: 211797 - DNA, 536 bp, Homo sapiens
  misc_feature: GYAE6OF01AYD1S.43.86.H09.1.454.CMB.1.raw
  modified_base (532)..(532): a, c, t, g, unknown or other
  misc_feature (532)..(532): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactcgtggggtcccagacagattcagcggcagtgggtctggcactgatttcactactgacaatcagcgagggtggaggcgtaggaggtagttggtttagggtttttattacttggctagtgactaaactcactactcgccttccgttactacgtttggaccaggggaccaagggtgagatacaaacgactggtcgctagcaccnttcg

SEQ ID NO: 211798 - DNA, 561 bp, Homo sapiens
  misc_feature: GYAE6OF01ENWG9.43.86.H09.1.454.CMB.1.raw
  modified_base (556)..(556): a, c, t, g, unknown or other
  misc_feature (556)..(556): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactcgtggggtcccagacagattcgagcggcaggtgggtctggcacgtgtatttcactactgacaatcagcgagggtggaggctggaggtagttggtttgggttttattacgtgtctatcgactaaacttcactacgttcggtccttccgttctacgtttcggaccgtaggggaccgtaagggtcggaagtagtacgaaacgtacgtacggtcggctagcctaccgngttcg

SEQ ID NO: 211799 - DNA, 538 bp, Homo sapiens
  misc_feature: GYAE6OF01BIYQ9.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactcgtgggtcccagaccagtattcagcggcagtgggtctggcactgtacttcacactgacaatcagcgagggtggaggctggaggtatggtttgggttttattactgctatgacaaacttcactactcggtcctccgttctacgtttcggccgtaggggacctaagggtggaagtactcgaaacgacgtcgtggctagccacgtatcg

SEQ ID NO: 211800 - DNA, 834 bp, Homo sapiens
  misc_feature: GYAE6OF01DD54E.43.86.H09.1.454.CMB.1.raw
tcagtgtgagtagtcacgaccggtgctcgatttagtgctatagacgttagggtttggggacgtgagtcacggactcctcagttacaccgttctctaccaatgaggctccctgctcagacctcctggggctgctaactgcgtcgttggggtcccaggagtccggtgggggtactgtttgtgtattagacgtcacgtctccactcgtccctgcccgtcacccgttgggcacggccgggccgtccagtcctccgtgcgaaggtcctagtagaaacgtcctcgtacgtacgttcgaagtacggtaaactaccctttacgttacgttaaaactttgggtaacctttccggaagaccgaaggacggaccccgtacggggaccccctaaaccgttccgttaccccgaaagggtcccggtaacccgtttaaaaggttttaacgttaaacggggttttaccgtaaacccgggggtacttccgttacgggggtttacccaaggtaccgtaagtaagtttccgaaaggtcggtactaaggttcgggtctagggactacgttggtactttaccggacctacgtacgaaccctaattaccgacgacgaagggttacggaacggtaccgtaaggaacggtaggttaggtttacggttttacttacgtacgtactaagttacgtaaccgtaaccgtttacgaaccgtacgtaccgggtcccgttaccgttccggttaccgttttacgggaccgttaacggggtacccgtaaggggttacgggaagttaacggtacgtaaaacggtacgttaagggtcggtaccgttacgtaccgaaccgttcgttaccg

SEQ ID NO: 211801 - DNA, 516 bp, Homo sapiens
  misc_feature: GYAE6OF01ER4EB.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaacgggactctggggtcccagacagattcagcggcagtgggtctggcactgatttcacactgacaatcagcagggtgaggctgaggattgttgggttttatctgcatgcaaacttcactactggtccttccgttctacgtttggccgaggggaccaagggtggagatcaaacgtaatggtgctagcaccatccg

SEQ ID NO: 211802 - DNA, 523 bp, Homo sapiens
  misc_feature: GYAE6OF01CZ7GQ.43.86.H09.1.454.CMB.1.raw
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (427)..(427): a, c, t, g, unknown or other
  misc_feature (427)..(427): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctcatctcctgcaggtctagtgaaacgcctcgtacacgttgataggaaacacctacttgaattggattcagcagagcaggccaatctccgaaggcgacctaatttataagtttctaacggactcgtggggtcccagacagacttcagcgcagtggctggcactgtatttcgactactagacaatcagcgaggtgagcngagnttgttggtttatacgtgnatgactaacttcactacgtcgtccttccgtctacgtttggcccgagggtaccaagggtcggagatacgaaacgtactgtacgctagacctcattcg

SEQ ID NO: 211803 - DNA, 636 bp, Homo sapiens
  misc_feature: GYAE6OF01EJUXJ.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgataggaaacacctacttgaattggattcagcagacggccaggaccaatcctaccgaaacggccgtaccttaaattttacgttaacggttttaccgtaaacccgggtacttcgtacggggtcccaaggacagtattcgaggcggacgtaggtcgggtctgggcctacgttgtactttcactactagactaactcgagcgagggtggacggtcgtaggtaggtagttggtttagggttttattacgtgtactagtcgaactaacttacgactacgttcggtccttccgttacgtaccgtttcggaccggtacggggtaaccgtaagggtcggaagtaacgttaccgaaacggtacgttacggtcggtacgtacggacctaccgtgttaccg

SEQ ID NO: 211804 - DNA, 521 bp, Homo sapiens
  misc_feature: GYAE6OF01EKIVE.43.86.H09.1.454.CMB.1.raw
  modified_base (518)..(518): a, c, t, g, unknown or other
  misc_feature (518)..(518): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactcgtggggtcccagacagattcagcggcagtgggtctggcactgatttcacactgacaatcagcagggtggaggctgaggatgttgggttttattactgcatgcaaacttcactactggccttccgttctacgtttggccgtagggaccaagggtcggagactacgaaacgaactgtcgctagcaccntcg

SEQ ID NO: 211805 - DNA, 602 bp, Homo sapiens
  misc_feature: GYAE6OF01B7CX6.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgccttaaatttataaggttttctaaccgggacttcgtggggtcccagacagattcagcggcaggtgggtctggcactgatttcacactgacaatcagcgagggtggaggcgtaggaggtagttggtttagggttttattacgttgctagtcgtacctaaaccttcaaccgtacgttcggtacccttccgttacctacgttttcgggacccgtacggggtaacccgtaaagggtcgggtaaggtaacgtaccgaaaacgtaaccgtaggtacggtacgtaggcccgtaaccgtagttacccg

SEQ ID NO: 211806 - DNA, 513 bp, Homo sapiens
  misc_feature: GYAE6OF01EHFV0.43.86.H09.1.454.CMB.1.raw
  modified_base (217)..(217): a, c, t, g, unknown or other
  misc_feature (217)..(217): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (505)..(505): a, c, t, g, unknown or other
  misc_feature (505)..(505): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagcgtggttttcctcgttgctcttttaagaggtgtccagtgtcaggtgcagctggtggagtctggggganacgtggtccagcctgggaatccctgacactctcctgtgcagcctctggattcaccttcaataattatgcatgcatgggtccgccaggctcctggcaaggggctggagtgggngcattanatcatctgataggaagttagaaacgtactacgacaggactccgtaggaacgggccgtagtcacatctaccgaggacaattacaagcgcactctgtatctgacaatgaacagcctagacacctagaggacgacgtactatttatactgtgcggagtagacgaggtggggngtcgtacg

SEQ ID NO: 211807 - DNA, 535 bp, Homo sapiens
  misc_feature: GYAE6OF01CYW6C.43.86.H09.1.454.CMB.1.raw
  modified_base (531)..(531): a, c, t, g, unknown or other
  misc_feature (531)..(531): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaacactacttgaattggattcagcagaggccaggccaatctccaaggcgacctaatttataaggtttctaaccgggactctggggtcccagacagattcagcggcagtggtctggcactgatttcacactgacaatcagcgagggtggaggcgtggaggattggtttgggttttattacgttgcatgctaaacttcacacgtcggccttccgttctacgttttcggccgtacggggtaccaagggtggagagtacaaacgtaactgtcggactagcacnttcg

SEQ ID NO: 211808 - DNA, 723 bp, Homo sapiens
  misc_feature: GYAE6OF01C841Y.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtgggatgttgtgatgactcagtctccactcctccctgcccgtcacccgttgggccacggccggcctccatctcctgctaggtctagtgaaacgcctacgtactacgttgatacggaaacctaccttacttagaagttggattcagacagacggccaacggccaatcctaccgaaggtccgtacctttaaagttttaacgttaaacggttttaccgtaaaaccggggtacctttcggtaccggggttaccccaaggtaacctaacggtactttaccgaacggccgggtaccgtaagggttcggggttcttcggggactacgttggtaactttacgaacctacgtacgaactaagtacgaggacgtaggggttaggaaggtcgtaggaagggttagtttaggttttagggttttacttagttcgacgtaagtacgtaaccgtaaacttcgaaccgtacgtccggttcccttaccggttaccttacgttttcggaccggtacggggtaaaccgtaagggtacgtaagtaacgtaacgaaaccgtaacgttggtacgtacgtagtaccgtaccgtgttccg

SEQ ID NO: 211809 - DNA, 592 bp, Homo sapiens
  misc_feature: GYAE6OF01BXKNP.43.86.H09.1.454.CMB.1.raw
  modified_base (370)..(370): a, c, t, g, unknown or other
  misc_feature (370)..(370): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactcctccctgcccgtcacccttgggcagccgcctccatctcctgcaggtctagtgaaagcctcgtacacgttgatggaaacacctacttgaattggattcagcagacgccaggccaatcctaccgaaaggccgaccttaaattttataaggtttctaaaccgggacttcgtaggggtcccagacagattcagcggnaggtgggtctggcacgtgtactttcactactagacaatcagcgagggtggaggtcgtaggagggtagttaggtttagggtttttattacgttgactagtacgtactaaaccttacgaccgtacgtcggtcccttccgttacgtacgtttcggaccgtacgggaccgtaagggtcggaagacgtacgaaacgacgtaggtacggactagacctacgcttaccg

SEQ ID NO: 211810 - DNA, 823 bp, Homo sapiens
  misc_feature: GYAE6OF01CWELD.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctcgtgggtcccaggatccggtggggatgttgtgatgactcagtcctccactcctccctcgcccgtcacccgttgggcagccggcctccatctcctgcaggtctagtagaaacgtcctacgtactacgttgaagttacggaaaacctaccttacgttagaaagtttggactttcgaaggcgaaggacggacccgaacggaccctaaatcccgtaccgaacggtccgtaacctttaaagttttaacgtaacggtttacccgtaaaccgggtcttcggtaccggggtacccaaggtaccaaggtacttacggaacgggccggtacgtaagggttcgggtaccgtacgggacctacgttagttaacctttaccgaaccgtacgttacgaaacctaaacgttaccgaacgggtacgggtaagggggttacgggaacgggtacggttagggtaagggtttaggttttaggggtttttaacgggtttttaacttacggtacggtacgtaacgttacggtaaccttaaaccgttccgaaaccgttaccgttaccggttcccctttaccggtttaccgtttaaccggttttccgggaacccgggtaaccggggtaaccggtaaacggggtacggtaaacgtaacgttaaccgaaaacgggttacgttacggtaccggtacgtaccgacctaaccgtcgttacccg

SEQ ID NO: 211811 - DNA, 567 bp, Homo sapiens
  misc_feature: GYAE6OF01CV0DY.43.86.H09.1.454.CMB.1.raw
  modified_base (388)..(388): a, c, t, g, unknown or other
  misc_feature (388)..(388): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgaccttaatttataaggttttctaaccgggactcgtggggtcccagacagattcagcggcaggtgggtctggcactgatttcaacnctagacaatcagcgagggtggaggctgaggattgttgggttttattactgctatgactaaacttcaactcgtcggtcccttccgttctaccgttttcggaccgtacggggaccgtaaagggtcggtagacgtaaccgaaaccgtaacgttaggtacgacgtagcctaccgtagttaccg

SEQ ID NO: 211812 - DNA, 618 bp, Homo sapiens
  misc_feature: GYAE6OF01C6ZVT.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgccaggtctagtgaaagcctcgtacacgttgatggaaacacctacttgaattggattcagcagaggccaggccaaatctccaaggcgacctaatttataaggtttctaaccgggactctggggtcccagacagattcagcgcagtgggtctggcactgatttcacactgaacatcagcgagggtggaggcgtgaggtagttggtttgggttttacttacgttgctagtggtacctaaactttccgaactacgttcggtccctttcccggttacttaccgtttttcgggaccccgtagggggtaaccccgaaaggggttacgggtaaggtaactaacccgaaaaccggtaaacgttcggttaacggggtaccttaggtaaccccgtaccgtagtttacccgg

SEQ ID NO: 211813 - DNA, 568 bp, Homo sapiens
  misc_feature: GYAE6OF01D6SUH.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccgcctccatctcctgcaggtctagtgaaagcctcgtacacgttgatggaaacacctacttgaattggattcagcagaggccaggccaatctccaaggcgaccttaatttagtaaggtttctaaccgggactcgtggggtcccagacagattcagcggcaggtgggtctggcatgatttcacatgacaatcgagcgagggtggaggtctggaggtagttggtttaggttttattacgttgtctattgacctaaacttcgaactacgttcggtcttccgttactacgttttcggccgtacggggtaccgtaagggtacggagacgtacaaacggtaacgtggtcggtacgtagccaactacgttccg

SEQ ID NO: 211814 - DNA, 595 bp, Homo sapiens
  misc_feature: GYAE6OF01D5Z0Z.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgataggaaacacctacttagaattggattcagcagaggccaggccaatctaccgaaggccgaccttaatttagtaacggtttacgtaaccgggtactcgtacggggtacccagacagattcgagcggcaggtcgggtctgggactacgtgactttcactactagaacaatacgagcgtagggtaggaggtcgtaggaggtagtttggtttaggttttagttacgttagtacgtagtacgtactaaactttcactacgttcgtccttaccgttctacgtttcggaccgtacgggaaccgtaggtcggtagacgtacgaacgtacgtaggtgactagcctaccgtgttcg

SEQ ID NO: 211815 - DNA, 643 bp, Homo sapiens
  misc_feature: GYAE6OF01EKLHN.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgtccgtcacccttgggcagccggcctccatctcctgcaggtctagtgaaagcctcgtacacgttgatggaaacacctacttgaattggattcagcagaggccaggccaatctccaaggcgcctaaatttataaggtttctaaccgggactcgtggggtcccagacagattcagcggcagtgggtctggcactgatttcacactgacaatcagcgagggtggaggctaggagggtagttggtttgggtttttaattacgttgtacctaagttaggacctaaacctttccaaccgtaccgttcggtacccttcccggtttaccttaaccgtttttcgggacccgtaacggggggtaaaccccgtaaaggggttacgggtaaaggtaacgttaaccgaaaaaccgggtaaaccgttagggttaccgggtacttaccgggaccctaaacccgtagtttaccccgg

SEQ ID NO: 211816 - DNA, 544 bp, Homo sapiens
  misc_feature: GYAE6OF01BODEF.43.86.H09.1.454.CMB.1.raw
  modified_base (303)..(303): a, c, t, g, unknown or other
  misc_feature (303)..(303): n is a, c, g, or t
  modified_base (342)..(342): a, c, t, g, unknown or other
  misc_feature (342)..(342): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagacgtggtccagcctgggaagtccctgacactctcctgtgcagcctctggattcaccttcaataattatggcatgcacgtgggtccnccaggctcctggcaaggggctgggagtgggtgcacttanatcatctgatggaagtagaaagtactacgcagactcgtaggaacgggccgatcaccatctcgaggacatacaagcgcactctgtatctgactaagtacgaacacgacctagaccaccgtaggacggacgtaacggtacttaatttagttacgttggtacgacggaaggtacggacggtagggttggggggtacgtcgtacgg

SEQ ID NO: 211817 - DNA, 566 bp, Homo sapiens
  misc_feature: GYAE6OF01CAXFV.43.86.H09.1.454.CMB.1.raw
  modified_base (562)..(562): a, c, t, g, unknown or other
  misc_feature (562)..(562): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaacgtcctcgtacacgttgatggaaacacctacttgaattggattcagcagaggccaggccaatcctccaaggccgacctaaattttataacggttttctaaccgggactcgtcggggtacccagaacagattcagcggcagtcgggctggcactgtatttcactactgaactaatcagcgagggtggaggcgtggaggtagttggtttgggttttattacgtgctatgtactaaacttcactacgtcgtcccttaccgttctacgtttcggaccgtagggacctagggtcggagtactaacgaaacgtacgtggtacgctagcctacgtnttcg

SEQ ID NO: 211818 - DNA, 570 bp, Homo sapiens
  misc_feature: GYAE6OF01DE583.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctactgaattggattcagcagaggccaggccaatctccaaggcacctaatttataaggtttctaaccgggactcgtcggggtcccagacagattcagcggcagtgggtctggcactgatttcactactagacaatcagcgagggtggaggcgtagaggtagttcggtttagggttttatttactgctagtgactaacttacactacgtcggtcccttccgttctacgttttcggaccgtacggggtaccgtaagggtcggtaagacgtaccgaaaacgtaacgtacggtcggactagcctaccgtagttaccg

SEQ ID NO: 211819 - DNA, 590 bp, Homo sapiens
  misc_feature: GYAE6OF01A2XGG.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatcctaccgaaggccgaccttaaatttacgtaaacggttttcctaaaccgggtacttcgtacggggtcccaagacagattacgagcggcaggtgggtcgtggcacgtgtactttcactactgacaatcagcgagggtggaggctaggaggtagttggtttggttttattacgtgactagtgactaaacttcaacgtcgtcggtcccttccgttctacgtttcggaccgtaacggggtaaccgtaagggtcggaagacgtaacgaaacgtacgtggtacggctagacctaccgtgttaccg

SEQ ID NO: 211820 - DNA, 516 bp, Homo sapiens
  misc_feature: GYAE6OF01B6P2Y.43.86.H09.1.454.CMB.1.raw
tcagtgtgagtagtcacgaccggtgctcgatttagtgctatagaccttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtgaggctgaggatgttgggttttatactgcatgcaacttcactactggccttccgttctacttttcggccgaggggaccgaagggtggagtatcgaaacgactgtggctgcaccatcg

SEQ ID NO: 211821 - DNA, 613 bp, Homo sapiens
  misc_feature: GYAE6OF01D1JT4.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccgggtggggatgttgtgatgactcagtctccactctccctgcccgtcacccttgggcagccggcctcatctcctgcaggtctagtgaaacgcctcgtacacgttgatgaaacacctacttgaattgattcagcagaggccaggccaaatcctaccgaacggcgtacccttaattttataaggttttacctaaccgggaactcgtcggggtcccaagacagattcgagcggcaggtcgggtctgggcacgtgtactttcaacactgaacaatcgagcgagggtggaggtcgtggaggtagttggttttgggttttaattcgtgtctaagtgaaccttaacgttacactacgttccggtccctttcccgttacgttacgtttcggaccggtaacggggtaccgtaagggtggtaacgacgttaccgtaaaacggaacttcgggtacggtacgtagtacctacccgtattccg

SEQ ID NO: 211822 - DNA, 557 bp, Homo sapiens
  misc_feature: GYAE6OF01EVJZQ.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgacctaatttataagtttctaaccgggtactcgtgggtcccagacagattcagcggcaggtgggtctggcactgtactttcactactgaacaatcagcgagggtggaggctagagggtagttggtttagggttttattacgtgtctatgcagtacttcactaccgttcggtcccttccgttctacgttttcggccgtaacggggtaccgaagggtaggaaggtactacgaaacgacgtagtcggatcgcacctacg

SEQ ID NO: 211823 - DNA, 526 bp, Homo sapiens
  misc_feature: GYAE6OF01B3BVQ.43.86.H09.1.454.CMB.1.raw
  modified_base (521)..(521): a, c, t, g, unknown or other
  misc_feature (521)..(521): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctggaggtattggtttgggttttattacgtgctatgctaaacttcactactggccctcgttcactttggccaggggacccaagggtggagatcaaaacgtactgtcggctggcaccgngtccg

SEQ ID NO: 211824 - DNA, 615 bp, Homo sapiens
  misc_feature: GYAE6OF01BF77M.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaacgcctcgtacacgttgataggaaacacctacttgaattggattcagcagacggccaggccaatctaccgaaggcgtaccttaaattttataaggtttacgtaaaccgggactcgtcggggtcccagacagtattcagcggcaggtgggtctggcactgtactttcactactgacaatcagcgagggtggaggctggaggtagttggtttagggttttatacgtgtctatagtacctaacttcacgtaccgttcggtcccttccgttacttaccggttttcgggacccggtaacggggtaaccgaagggtacgggtaagtaacgtaaccgaaaaccggtaacggttacggtacgggacgttaggaccctaaccgtagttcccg

SEQ ID NO: 211825 - DNA, 563 bp, Homo sapiens
  misc_feature: GYAE6OF01CQB3I.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactcctccctgcccgtcacccttgggcagccggcctccatctcctgcaggtctagtgaaacgcctcgtacacgttgataggaaacacctacttgaattggattcagcagaggccaggccaatctccaaggcgacctaatttataaggtttctaaccgggtactcgtggggtcccagacagattcgaggcggcaggtgggtctgggcactgtatttcacactgaacaatcagcgagggtggaggcgtggagggtatttgggtttagggttttattacgtgctagtgacctaaacttcactacgtcggtcccttccgttctacgtttcggccgaggggtaccgagggtcggagtactacgaaacgtacgtggtacggctagccactgttccg

SEQ ID NO: 211826 - DNA, 625 bp, Homo sapiens
  misc_feature: GYAE6OF01ENEOW.43.86.H09.1.454.CMB.1.raw
  modified_base (618)..(618): a, c, t, g, unknown or other
  misc_feature (618)..(618): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaacgcctcgtacacgttgatggaaacacctacttgaattggattcagcagaggccaggaccaatctccgaacggcgtaccttaatttagttaacggtttacgtaaccgggtactcgtcggggtacccaggacagattcgagcggcaggtcgggtctcggctacttggtacttttccaactacgttacgaactaatcgaacggcgaggggtggagggcgtaggagggtagtttgggttttagggttttaattacgttgactagtagacctaaacttccgaactaccgttacggtcccttccgttacgtaccgttttcggaccgtacggggtaaccgtaagggtacggaagtactacgaaaacgtacgtacggtcggtctagcctacgngttaccg

SEQ ID NO: 211827 - DNA, 584 bp, Homo sapiens
  misc_feature: GYAE6OF01D4ZDE.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagcccggcctccatctcctgcaggtctagtgaaacgcctcgtacacgttgatacggaaacacctacttgaattggattcagcagacggccaggccaatctacgaaggcgacctaatttataaggtttctaaccgggactcgtcggggtcccagacagacttcagcgacaggtgggtctggctactgactttcaactactgacaatacagacgagggtggaggcgtaggaggtagttggtttagggtttatttacgtgctatagactaacttcgactacgtcggtccttccgttactacgtttcggaccggtacgggaccgtaagggtacggtaggaacttaaccgaaaacgtacgttaggtcggactacgacctaccgcgttccg

SEQ ID NO: 211828 - DNA, 597 bp, Homo sapiens
  misc_feature: GYAE6OF01EAUZ4.43.86.H09.1.454.CMB.1.raw
  modified_base (592)..(592): a, c, t, g, unknown or other
  misc_feature (592)..(592): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagcccggcctccatctcctgcaggtctagtagaaacgcctcgtacacgttgataggaaacacctacttgaattggattcagcagacggccaggccaatcctaccgaaggccgtaccttaaatttagtaaggttttaccgtaaaccgggtactcggtacggggtacccagacagtacttcgaggcggctaggtcgggtctggcacgtgtaactttccaactactagaacactacgagacggagggtggaggcgtaggaggtagttggttttagggttttattacgtgtactagtacgtaactaaacttcaacgtacgtcgtccttccgttactacgtttcggaccgtagggacgtaagggtgagacgtacgaaacgtagtgtcgctagctacgnttacg

SEQ ID NO: 211829 - DNA, 582 bp, Homo sapiens
  misc_feature: GYAE6OF01A5FQ1.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagcccggcctccatctcctgcaggtctagtgaaagcctcgtacacgttgatggaaacacctacttgaattggattcagcagaggccaggccaatctccaaggcgcctaatttataaggtttctaaccgggtactctggggtcccagacagattcagcggcaggtgggtctggcatgatttcacactgacaatcagcgagggtggaaggctggaggtagttggtttgggttttaattacgtgctagtgacaaaccttcaacctactcggtcccttccgttacctaaccgttttcgggacccgtacggggaacctaaagggtcggaaggaacgtacgaaaaccgtaacgttcgggtacggtactaggacctaacccgtagttccg

SEQ ID NO: 211830 - DNA, 625 bp, Homo sapiens
  misc_feature: GYAE6OF01A7B77.43.86.H09.1.454.CMB.1.raw
  modified_base (386)..(386): a, c, t, g, unknown or other
  misc_feature (386)..(386): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctcccttgcccgtcaccttgggcagccgcctcatctcctgcaggtctagtgaaacgcctcgtacacgttgatggaaacacctattgaattggattcagcagaggccaggcctaagtctaccgaaggccgaccttaaattttacgtaacggttttaccgtaacccgggtacttcggttacggggtacccaggacagtattcgaggcggtnaggtggtcctggacctacttgtactttaccacgtactagaacctaatcgaacgcgtaggggtaggtaggtacgtaggaacggtagtttggtttacgggttttattacgtgacgtagtagtaaccttaacttccgacgttaccgtcggtccctttccggttacttacgtttcgggaccgtagggaacctagggtacgagtaacgtacgaaacggtctagtcggctacgcctacgtatccg

SEQ ID NO: 211831 - DNA, 788 bp, Homo sapiens
  misc_feature: GYAE6OF01A88J4.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccgggtggggatgttgtgatgactcagtctccactctccctgcccgtcacccttgggcacgccggcctccatcctcctgcaggtctagtgaaagcctgtacacgttgatggaaacacctacttgaattggattcagcaggacggccaggccaaatcctaccgaaggccgtaccttaaagttttaacgttaacgggttttaccgtaaaacccggggtaccttccggtacgggggttaccccaaggtaaccgtaaggtaactttacgaacggccgggtacgtaagggttcggggttccttacggggacctaaaccgtttggtaaactttttacccgaaccgttaaccgtttacggaaaccgtaaaacgttaccgaacgggtaccgggtaaaggggggtttaggggaacggggttccgttaaggggtaaaggggttacggttttaggggttttaaggggttttttaacttaacggttgtacgtacgtttacgaaccgttaaaccttccgaaccgtaccgttccgggtccccttaccggtttaccgtacgttttcgggaccggtaacggggtaaccgtaagggtcggtaacgtacgtaaccgaaacggtaacgttcggtacgggacgttagaccgtaaccgtgttaccg

SEQ ID NO: 211832 - DNA, 763 bp, Homo sapiens
  misc_feature: GYAE6OF01CJH6X.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctccgtggggctgctaatgctcgtgggtcccaggagtccgggtggggatgttgtgatgactcagtcctccactcctccctcgcccgtactacccgttgggcacggcccggtcctccatcctccgtgctaggtctagtagaacgcctcgtactacgttagaatacggaaacctaccttattagtaagttggacttacgagacgacgggacggaccgaacggtacctaacgtccgtaccgaacggtaccgtaaccttttaaagttttaacgttaaacgggttttaccgtaacccggggtacttaccgggttaccggggacccaacggtaacgtacgtacgttacgaacggcggtacgtagggtcggtcgtggacctacgttgtacgtttcaactaccgtactaacgaactcggagtacgggtaggggtaggaggtcgttaggtagggttaggttttcgggtttaggttttactacggtgtacgtaagtaccgtaaccttaaccttacaacccgtacgttccggtcccttttcccggttacgttaccggtttaccggggacccggtaacggggtaacgtaaggggtacggtaaagtaccgtaaccggaaaacggttcgtagggttaccgacgtaaccgcccgttaacgttacgttccg

SEQ ID NO: 211833 - DNA, 511 bp, Homo sapiens
  misc_feature: GYAE6OF01C3ESK.43.86.H09.1.454.CMB.1.raw
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
  modified_base (379)..(379): a, c, t, g, unknown or other
  misc_feature (379)..(379): n is a, c, g, or t
  modified_base (505)..(505): a, c, t, g, unknown or other
  misc_feature (505)..(505): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctgtacacgttgatggaaacactacttgaattggattcagcagagccaggccaaatctccaaggcncctaatttanaaggtttcaaaccgggactcnggggtcccagacngattcagcggcagtgggtctggcactgaatttcanactgacaatcagcaggtgaggctgagatgttcggtttatactgcatgcaaacttcactacgtcggcctccttacacttttggacagggaccaaggtagagatacgaaaacaactagtggactgacnccagtc

SEQ ID NO: 211834 - DNA, 549 bp, Homo sapiens
  misc_feature: GYAE6OF01A9C54.43.86.H09.1.454.CMB.1.raw
  modified_base (358)..(358): a, c, t, g, unknown or other
  misc_feature (358)..(358): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggnagtggtctggcactgatttcacactgacaatcagcagggtggaggctgaggattgttgggttttatactgcatgctaaacttcacactcggccttccgttctacgttttcggaccgtacggggaaccgtaagggtcgggagtagtaccgaaaacgaacgttggtacggacgtacgacgacccgtattaccg

SEQ ID NO: 211835 - DNA, 555 bp, Homo sapiens
  misc_feature: GYAE6OF01BNSER.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttcaaccgggactcgtgggtcccagacagattcagcggcaggtgggtctggcacgtgtatttcactactgacaatcagacgagggtggaggcgtggaggtagtttggtttagggtttttattacgttgactagtcggactaaacttcacgtacgtcgtcccttccgttctacgtttcggccgtacggggaccgagggtggagagtacgaaacgtacgtggtcggactgccactgttcg

SEQ ID NO: 211836 - DNA, 630 bp, Homo sapiens
  misc_feature: GYAE6OF01BGX2C.43.86.H09.1.454.CMB.1.raw
  modified_base (302)..(302): a, c, t, g, unknown or other
  misc_feature (302)..(302): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcnctaatttataaggtttcaacgggactctcggggtccagacagtattcagtcggcaggtgggtctggcactgtatttcacactgaacaatcagcgagggtggaggctggagggtattgggttttagggttttaattacgttggactagttacggtacctaaactttaccgaccgtaacgttccggtacccttccggtttaccttacgtttttcgggacccgtaacgggggaacccgtaaaggggttcgggtaacggaacgttacccgaaaaaccgggttaacctagggttaccgggtacgttacggccctaaacccgtacgtttacccg

SEQ ID NO: 211837 - DNA, 924 bp, Homo sapiens
  misc_feature: GYAE6OF01B8F24.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctcgtcggtccaggtacgtcgggtgggattgttgtagtatacgtactactacgtcctaccaccttccctcccgtccggtccccgtcctacccgggttcggggaccaccggcccggtccctacctcgttccctcgtcgacgtacggtactaggtaacgaaccgtccgtacgtaaccgtaggttagtaacgtaaaccggtaaaccttaacccgttacgttaagtaacgttaggtaacttacgaacggacgaacgggaccggaccgaacgggtaaccctaacgttcccgtaaccggaaacggtacccctttaaccgttttaaaagttttaaacggttaaccgggttttaaccccggaacccgggttactttaccggggtaccgggtaaccccaaggtaaccgtaagttaccttacggacgggtccggtacgttaggggttcggtacgtacgggtaccttacggttaggttaccttaaccacgtaaccgtacggtaaacctaacgtacggtaacggagggtaacggggtacgggaacggtacggtagggtaagggtttacggtttttaggggttttaacggttttaacgtacggtataacgtaggttaaccaaaccgtttaaaccgtccgtaaaccgttccggtcccggttacccgtttaccccgtttacgttacccggtttacgggaacccggggtaaccgggttaaacggaaacggggtaggtaacgttaaacccggttaaacggaaaaccggttcgtacgggttaccgacgttaaccggaccttacggtactttaccgg

SEQ ID NO: 211838 - DNA, 620 bp, Homo sapiens
  misc_feature: GYAE6OF01A71JV.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccgggtggggatgttgtgatgactcagtctccactctccctgcccgtcacccgttgggcagccgcctccatctcctgcaggtctagtgaaacgcctcgtacacgttgatggaacactacttgaattggattcagacaggaggcaaggccaaatctaccgaacggccgaccttaattttagtaacgggtttactaaccgggtacttcgttcggggtacccagacgagtattcgaggcggctaggtggtctgggacacgttagtactttacactactagaactaatcagcgtagggtggaggtcgtaggaggtagttggtttaggttttagttacgtgtctagtgactaacttaccgatccgtacggtcccttacgttcgtacgtttacgggaccgtacgggtaaccgtaagggtaggaacggtacgtaccgaaacggtacgttacggtacggtacgtaggtaccgtaccgtagttaccg

SEQ ID NO: 211839 - DNA, 581 bp, Homo sapiens
  misc_feature: GYAE6OF01DBTLP.43.86.H09.1.454.CMB.1.raw
  modified_base (298)..(298): a, c, t, g, unknown or other
  misc_feature (298)..(298): n is a, c, g, or t
  modified_base (575)..(575): a, c, t, g, unknown or other
  misc_feature (575)..(575): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagcccggcctccatcctcctgcaggtctagtgaaagcctcgtacacgttgataggaaacacctacttgaattggattcagcagacggcaggccaatcncaaggcaccttaatttatacggtttacaaccgggtactcgtcgggtccagacagtacttcgagcgcaggtcgggtctcggctacgtgtatttcactactagaacatcgaggcgagggtggaggtcgtggaggtagtttggtttagggtttattacgtgactagttacgaactaacttcactacgtcggtccttccgttacttacgtttcggacgtaacggggacctaagggtcggaataacgtacgaaaacgtacgtggtacggactacgacacgtnttaccg

SEQ ID NO: 211840 - DNA, 522 bp, Homo sapiens
  misc_feature: GYAE6OF01BNI93.43.86.H09.1.454.CMB.1.raw
  modified_base (372)..(372): a, c, t, g, unknown or other
  misc_feature (372)..(372): n is a, c, g, or t
  modified_base (514)..(514): a, c, t, g, unknown or other
  misc_feature (514)..(514): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactcgtggggtcccagacagattcagcggcagtgggtctggcnctgatttcacactgacaatcagcagggtggaggctgaggattggttgggttttattactgcatgacaaacttcactactggccttaccgttctacttttggccgtaggggaccaagggtggagatcaaacgaactgtaggcngcacatcg

SEQ ID NO: 211841 - DNA, 529 bp, Homo sapiens
  misc_feature: GYAE6OF01EDHYU.43.86.H09.1.454.CMB.1.raw
  modified_base (517)..(517): a, c, t, g, unknown or other
  misc_feature (517)..(517): n is a, c, g, or t
  modified_base (525)..(525): a, c, t, g, unknown or other
  misc_feature (525)..(525): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaacgcctcgtacacgttgatggaaacacctacttgaattggattcagcagaggccaggccaatctaccaaggcgacctaatttataaggttttctaaccgggtactcgtggggtcccagacagattcagcggcagtgggtctggcactgtatttcaacactgaacatcagcgagggtggagcgtgaggtattgtttgggttttatctgcatgactaactcactactcgccttcgttctacgtttggaccgtagggaccgaggtgagatacgaaacgtactagtgacngacacgtntccg

SEQ ID NO: 211842 - DNA, 552 bp, Homo sapiens
  misc_feature: GYAE6OF01DOG3R.43.86.H09.1.454.CMB.1.raw
tcagtgtgagtagtcacgaccggtgctcgatttagtgctatagacttgggtttggggactgatcaggactcctcagttcaccttctcacaatgaggctcctgctcagctcctggggctgctaatgctctgggtcccaggatccggtggggattgttgtgatgactcagtctccactctccctgcccgtcacccttgggcagccggcctcatctcctgcaggtctagtgaaacgcctcgtacacgttgataggaaacacctacttgaattggattcagcagaggccaggccaatctccaaggcgacctaatttataaggtttactaaccgggactcgtcgggtcccagacagattcagcggcaggtggtctggctactgtactttcactactagaacatacagacgagggtggaggcgtggaggtagttggtttgggttttattacgtgctatgaactaacttcactacgtcgtccttccgttctacgttttcggaccgacggggaccgaagggtggaagataacgaaacgtatcggtggactgacactgtcg

SEQ ID NO: 211843 - DNA, 591 bp, Homo sapiens
  misc_feature: GYAE6OF01CEJF9.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgaatggaaacacctacttgaattggattcagcagaggccaggccaaatctccaaggcgacctaatttataaggtttctaaaccgggctctggggtcccagacagattcagcggcagtgggtctggcacgtgatttcacactgacaatcagcgagggtggaggcgtaggaggtagttggttttggggttttaatttacgttgtactattggaactaaacgtttcaacaccgttggtacccttccgtttactacgttttacgggccgtaacggggaacctaagggtcggaagtaacgtacgaaaacggtaactacggtagggacctggacctaccgtaagttcccg

SEQ ID NO: 211844 - DNA, 567 bp, Homo sapiens
  misc_feature: GYAE6OF01B6WBD.43.86.H09.1.454.CMB.1.raw
  modified_base (304)..(304): a, c, t, g, unknown or other
  misc_feature (304)..(304): n is a, c, g, or t
  modified_base (347)..(347): a, c, t, g, unknown or other
  misc_feature (347)..(347): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagcttgggttttcctcgttgctcttttaagaggtgtccagtgtcaggtgcagctggtggagtcgtgggggagacgtgggtccaggcctgggaactccctgacactctcctgtgcagcctctggattcacttcaatatatggcatgcactggggtccnccaggcctccgtggcaagggggctgggagtggggtgcacttanatcatctgatggaagtagaaagtactacgcagactccgtagaagggccgatcacactctaccagggacaattacaagccgactactctgtactctgactaaagtcgtaaacgacgccttacgacctaaccgtaggagggacggacggtacgttaatttactttacgttggtacgacggaaggtacggaacgtaggtttagggggggtagtacgtaaccgg

SEQ ID NO: 211845 - DNA, 668 bp, Homo sapiens
  misc_feature: GYAE6OF01CBV8V.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccgggtggggatgttgtgatgactcagtctccactctccctgcccgtcacccgttgggcagccggcctccatctcctgcaggtctagtgaaagcctcgtacacgttgataggaaacacctacttgaattggattcagcagacggccaggccaatcctaccgaaaggccgtaccttaaattttaacgtaaggttttaccgtaaaccgggtacttcgtcggggtacccagaaccagtacttcgaggcggcgtaggtgggtctggctacgtgtacgtttcactacgtgaactaatcgagacgaggggtgaggacgtaggaggtagtttggtttaggttttaattacgtgtatagtcgtaacgtaaacttccgaacgtacgttccgtcccgtttacccgtttaccttaaccggttttccgggaccggtaaacgggggtaacccgtaaggggttacgggtaacgaacgttaaaccgaaaacggtaaccgttcgggtacggttaccgtaggtacccaccgttaagttcccg

SEQ ID NO: 211846 - DNA, 569 bp, Homo sapiens
  misc_feature: GYAE6OF01BWYQ4.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctcatctcctgcaggtctagtagaaacgcctcggtacacgttgataggaaaccaccttacttagaattggattcagcagacggccaggccaatctaccgaaggccgacttaatttacgtaacggtttaccgtaaccgggacttcgtcggggtacccagacgagtattcgaggcgataggtcggtctggactactgtaactttcactactagacaatcgagacgagggtggagcgtagaggtagttggtttgtttagtacgtgtactagtagactaactcactacgtcgtccttccgtcttacgtttcggacggtagggactagggtagagactacgaacgtagtgtacggctagcacgtgtcg

SEQ ID NO: 211847 - DNA, 831 bp, Homo sapiens
  misc_feature: GYAE6OF01BZ3XP.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtagaaacgcctcgtacacgttgattacggaaactacctacttagaattggattcagacaaggacggccgaaggcccaaagtccgtaccgaaacgggtccgtaaccctttaaagttttaacgttaaacgggttttaccgtaaaacccggggtacctttccggttaccgggggttaccccaaggtaaaccgtaaggtaacgtttaccggaaacgggtccgggtaaccgtaagggttcgggttacgttcgggacccgtaacgttacggtaacttttaccgaaccgtaaccgttaacgtaacctaaacgttacgaacggaccgggtaaggggttagggaacgggtaccgttaagggtaaggggttaaggttttacgggggtttttaaggggtttttttaacttaaccggttggtacgttaacgtttacgggtaaacctttaaaaccggttaccctaacggttaacccggttccgggttacccgtttaccccggtttacgttaaccggttttcgggaacccggtaacgggggtaaccgtaacgggtaggtaacgtaacgttaaacggaaaccgtaagtcggtacggacgtacgactacgtacgttacg

SEQ ID NO: 211848 - DNA, 794 bp, Homo sapiens
  misc_feature: GYAE6OF01BBYJE.43.86.H09.1.454.CMB.1.raw
tcagtgtgagtagtcacgaccggtgctcgatttagtgctatagacttgggtttggggactgatcaggactcctcagttcaccttctcacaatgagctccctgctcagctccgtggggctgctaatgctctgggtcccaggatccgggtggggatgttgtgatgactcagtctccactctccctgcccgtcacccgttggcacgcccgcctccatcctcctgctaggtctagtacgaacgtcctcgtacacgttagactaggaaaccaccgttaacgttgaactttggaacttcgagacgaaggacggccgaacggacctaattccgtaaccgaacggtaccgtaacctttaaattttaacgtaacgggttttaccgtaaaccgggtacttccggttacggggtacccaaggtaccgtaagttacgttacgagggtaccggtcgtaagggttcgggttacgtcgggtaacctacggtttagttacgtttacccgaactaacgtacgtaaaccgtaacttaccggaacggtaccgggtaagggggtacgggtaacgggtacggtaggggtaagggttaggttttacggggttttttaggggtttttaaacttacggtttcgtacgttaacgtacggttaacctaaaccgtttccgtaaaccgtaccgtttccggtacccttttacccggttaccgttacggtttaccgggaccggtacgggtaaaccggtaagggtcggtaaggacgttaaaccgaaacggtacgtcggtacgtacgtacgaacctacgtcgttcg

SEQ ID NO: 211849 - DNA, 555 bp, Homo sapiens
  misc_feature: GYAE6OF01DHWQ7.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctactgaattggattcagcagagccaggccaatctccaagcgactaatttataaggtttcaacgggctcgtgggtcccagacagatcagcgcagtggtctggcactgtactttcacactgaacaatcagcgagggtggaggcgtaggagtagttggtttaggttttaattactgctagtacgactaacttcaactacgtcgcccttccgttacgtacgttttcgggaccgtaacggggtaccgaagggtggaagagtaaacgaaacgtaacgtggtacggtcagcctacctagttccg

SEQ ID NO: 211850 - DNA, 565 bp, Homo sapiens
  misc_feature: GYAE6OF01AC8AM.43.86.H09.1.454.CMB.1.raw
  modified_base (385)..(385): a, c, t, g, unknown or other
  misc_feature (385)..(385): n is a, c, g, or t
  modified_base (560)..(560): a, c, t, g, unknown or other
  misc_feature (560)..(560): n is a, c, g, or t
tcagtgtgagtagtcacgaccggtgctcgatttagtgctatagacttgggtttgggggactgatcaggactcctcaattcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggccgccttaatttagtaaggttttctaacccgggactcgtcggggtcccagacagtattcaggcggcaggtgggtctggcactgntttaccactactgacaatcgagcgagggtggaggcgtaggagggtagtttgggtttgggttttattcgtgctatcgtactaacttcacgtacgtcgtcccttccgttctacgtttcggccgtacggggaccgaagggtggagtactacaaacggtagtgtcggctagcctacgtnttccg

SEQ ID NO: 211851 - DNA, 631 bp, Homo sapiens
  misc_feature: GYAE6OF01CJEQC.43.86.H09.1.454.CMB.1.raw
  modified_base (389)..(389): a, c, t, g, unknown or other
  misc_feature (389)..(389): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccgggtggggatgttgtgatgactcagtctccactctccctcgcccgtcacccgttgggcagccggcctccatctcctgcaggtctagtgaaacgcctcgtacacgttgataggaaacacctacttgaattggattcagcagaggcctaaggccaatcctaccgaaaggccgtaccttaaattttagtaacggtttctaaacccggggtcttcgtcggggtacccaagaccgaagacttcaggcggntaggtggtctggcactgtactttcactactagacaatcagcgagggtggaggcgtggaggtagttggtttagggttttactacgtgtactagttacgtaactaaacttcaacgtaccgttcggtccctttaccgttcttaccgtttcgggaccgtacggggtaaccgaagggtacgggtaagtacgtaacgtaaaaccggtaacgttgggtacggtacctacggtaccaaccgtcgttaccg

SEQ ID NO: 211852 - DNA, 612 bp, Homo sapiens
  misc_feature: GYAE6OF01EOWEY.43.86.H09.1.454.CMB.1.raw
  modified_base (435)..(435): a, c, t, g, unknown or other
  misc_feature (435)..(435): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccgttgggcagcccggcctccatctcctgcaggtctagtagaaacgcctcgtactacgttgagtaggaaacacctacttagaattggattcagcagacggccaggccaatctaccgaaggccgtaccttaaattttattaaggtttacctaaaccgggtactcgtcggggtacccagacagtattcgagcggcaggtgggtctggactacgtgtactttcactactagacaatcagcgtagggnggaggcgtaggtaggtagttggtttagggtttttattacgtgtacgtatacgacctaaacttacgaacctacgttacggtccttaccgttcgtacgttttcggaccgtacggggtaactaaggggtgtaggactaacgaaacggtacgtacggtcggactagacctacctcgtaccg

SEQ ID NO: 211853 - DNA, 623 bp, Homo sapiens
  misc_feature: GYAE6OF01C5UQA.43.86.H09.1.454.CMB.1.raw
  modified_base (237)..(237): a, c, t, g, unknown or other
  misc_feature (237)..(237): n is a, c, g, or t
  modified_base (613)..(613): a, c, t, g, unknown or other
  misc_feature (613)..(613): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccgggtggggatgttgtgatgactcagtctccactcctccctgcccgtcacccgttgggcacgccgcctccatcctcctgcaggtctagtgaancctcgacagttgatacggaacacctactgaattggattcagcagacggccaggccaatcctaccgaaggcgtaccttaatttagtaacggttttaccgtaaccgggacttcggtacggggtacccagacagtattcgaggcggctaggtcgggtctcggactacgtgtactttcacctactacgtaacaactcgacggtcggagggtacggacggtacgtggacggttagtttgggtttaggttttacttacgtgtctagttcgtaactaacttccacgtacgttcgtcccttccgttactaccgttttcggaccgtaacggggtacgtagggtaggacgtaacgtacgaaacgtacgttggcggtactacgaccncgtagttccg

SEQ ID NO: 211854 - DNA, 747 bp, Homo sapiens
  misc_feature: GYAE6OF01DG21R.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgcgtcccaggatccgggtggggatgttgtgatgactcagtctccactcctccctgccccgtcacccgttgggcacggcccggcctccatcctcctgctaggtctagtagaaacgtcctacgtacacggttagaagtacggaaaacctacctaagttacgaagtttggattacgagcaggacggccaggaccaatcctaccgaaggcgtaccttaatttagtaacggtttcaaccgggtctcggtcgggtccaagtacagtactcgacggcggataggtcggtctggtacacgttagtactttaccactaaccgttacgaacctaagtccgaaggtacggtaagggggttagggaacgggtccggttagggagggttaaggttttgggttttacgggttttttaacgtttacgttcggtacgttaagttaaccggtaaccgtttaaaccgtttaccgtaccgttaacccggttccggttacccccgttttccggttttaacccgtttaccggttttaccgggaccggttaacgggggaacccgtaaaggggtacggtaacgtaacgtaaccgtaaaacggtacgttcgggtacggtcgttacggacccgtacgttacg

SEQ ID NO: 211855 - DNA, 572 bp, Homo sapiens
  misc_feature: GYAE6OF01BY994.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtgggatgttgtgatgactcagtctccactcctccctgcccgtcacccttgggcagcccggcctccatcctcctgcaggtctagtgaaacgcctgtacacgttgatggaaacacctacttgaattggattcagcagaggccaggccaaatcctccgaaggcgtccttaaatttagtaaggtttacctaaccgggtactcgtcggggtacccagacagattcgagcggcagtgggtctggcatgactttcactactgacaatcagcgtagggtggaggtcgtcggaggtagttggtttagggttttattacgttagctagtgactaaacttacgactacgttcgtccttccgttctacgttttcgacggtacgggaccaacgggtggagataccgaacgtacgttacgtcggtcagcacgtcttaccg

SEQ ID NO: 211856 - DNA, 731 bp, Homo sapiens
  misc_feature: GYAE6OF01BUXQX.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccgggtggggatgttgtgatgactcagtctccactcctccctgcccgtcacccgttgggcacgcccggcctccatctcctgcaggtctagtagaacgtcctacgtacacgttgataggaaacctaccttacttagaattggattcagacgagacggccaaggaccctaatcccgtaccgaaggtcctacctttaaattttacgtaacggtttaccgtaaccgggtacttccggtacgggtacccagaacagtacttacgacggtcggacgtagggttcgggtactcgggactacgttgtaactttacgaccgtaacgtacgaactaataccgaggtacggaggggtaggacggcgtaggtaggttagtttgggtttacgggtttttactacggttcgtactagtacgtaaccttaaacgttccaaccgttaccgttccggttacccctttccggttaccttaccgggtttaccgggaccgggtaacggggtaaacccgtaaggggttacggtaacggtaacgtaaccggtaaaaccggttacgttcgggtaccggtaccgttaacggaccctacccgtaagtttcccgg

SEQ ID NO: 211857 - DNA, 675 bp, Homo sapiens
  misc_feature: GYAE6OF01BHT6P.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctcgtgggtcccaggagtccgggtggggatgttgtgatgactcagtctccactctccctcgcccgtcacccgttgggcacgcccggcctccatcctcctgcaggtctagtgaaacgcctcgtacacgttgataggaaactacctacttagtaattagggtattacacgacgacggacggaccgacggaccgtaactccgtaccgaacggaccgtacctttaatttaacgttaacggtttaccgtaaccgggtactacggtacgggtaccgacgaacgacgtacgtcgtaggaccggcgtaggtcgggttcgcggtactacgttagttacttactacgacgtacgaacgtaacgtcgaggtacggtagggtagggtacggtacgtaggtagggtagttttagggtttagggttttataccgtgactagtacgtaactaacttcgacgtactcggttccttccttacgttacgttccggtacggacgggtacgtaacgggtagaaggtactaacggaaacggtcgttaggtcggactagcctaactgtacg

SEQ ID NO: 211858 - DNA, 696 bp, Homo sapiens
  misc_feature: GYAE6OF01CDU5R.43.86.H09.1.454.CMB.1.raw
  modified_base (167)..(167): a, c, t, g, unknown or other
  misc_feature (167)..(167): n is a, c, g, or t
  modified_base (183)..(183): a, c, t, g, unknown or other
  misc_feature (183)..(183): n is a, c, g, or t
  modified_base (320)..(320): a, c, t, g, unknown or other
  misc_feature (320)..(320): n is a, c, g, or t
  modified_base (370)..(370): a, c, t, g, unknown or other
  misc_feature (370)..(370): n is a, c, g, or t
tcagtgtgagtagtcacgaccggtgctcgatttagtgctatagacttgggtttggggctgggagacgagcccagcactggaagtcgccggttgtttccattcggtgatcagtcactgaactacgagagggacctcaccgatggagtttgggctgagctgggtttccncgttgctcttttaagnggtgtccagtgtcaggtgcagctggtggagtcgtgggggacgacgtggtccaaggccgtgggaatccctgaccactctcctgtgcacgcctctggattccaaccttcaattaattatggctatgcacgtgggtcccnccgaggcctccgtggccgaagggggctgggacggtgggtcgctacgttanatcatctgaagtgggaagtaaggaaagtacgtacgcaaggtacccttcggtaggtaacgggccgtacgttaccaccgtaacttccgtaccggaacggggtaactaaacgtttaaaccgaaacggccgtacctaaccgttcgtacggttaaactccgttacggaacctaaacgtacgaaaccgaccggtacccgtacgggaccctaacccggttaggaaaccgggacggtaaccgggtactttaacgttttaacgttaacttcgggttacggacggtacgtaagggtaccggtaggggttacggggggtagttaccgttaacccggg

SEQ ID NO: 211859 - DNA, 560 bp, Homo sapiens
  misc_feature: GYAE6OF01BKROR.43.86.H09.1.454.CMB.1.raw
  modified_base (358)..(358): a, c, t, g, unknown or other
  misc_feature (358)..(358): n is a, c, g, or t
  modified_base (372)..(372): a, c, t, g, unknown or other
  misc_feature (372)..(372): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctaccaaggcgacctaatttataaggtttcaaccggactcgtggggtccagacagattcaggcgnaggtggtcgtgacntgtatttcacatgacaatcagcgaggtggagctggaggtagttggtttaggttttatacgtgctatcgaactaacttcactacgtcggtcccttccgttcttacgtttggaccgtagggaccgtaaacggtggaacgacgtacgaaaacggacgttcggttacggcttacggacctaacctgttaccg

SEQ ID NO: 211860 - DNA, 644 bp, Homo sapiens
  misc_feature: GYAE6OF01CA0TC.43.86.H09.1.454.CMB.1.raw
  modified_base (406)..(406): a, c, t, g, unknown or other
  misc_feature (406)..(406): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccgggtggggatgttgtgatgactcagtcctccactcctccctgcccgtcacccttgggcagccgcctccatctcctgcaggtctagtacgaaagtcctcgtacacgttgaatacggaaacaccttacttagaattggacttcagacgagacggaccacggaccaactcctaccgaaacggccgtacctttaatttaagtaacggtttaccgtaaaccgggacttcgtacggggtacccaggtaactagacttcgaagccggngtaggtcgggtacgtggactacgtgtacgtttacacgtactagaactaagtcgaagcgtaagggtggaggtcgtaggagggtagttaggttttagggttttattacgtgtactagtcgtactaacgttcaaccgtacgttacgtcccgtttcgttacttaccggtttacggaccgtacgggaacgtaagggtacgaacgtataacgaacgtaacgtcggtcgcgtacgctactgttcg

SEQ ID NO: 211861 - DNA, 661 bp, Homo sapiens
  misc_feature: GYAE6OF01CWB2E.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccgggtggggatgttgtgatgactcagtctccactcctccctcgcccgtcacccttgggcagccggcctccatctcctgcaggtctagtgaaacgcctcgtacacgttgatacggaaacacctactgtaattggattcagacaggacggccaaggccaaatcctaccgaaggccgtaccttaaattttagtaacggtttaccgtaaccgggtacttcgtacggggtcccagaactagtacttcgagcggacgtaggtcgggtctaggcctagtcgtatttccactactagaactaatcgaggacgagggtaggaggtcgtaggaggtagttggtttagggttttaattacgtgtacgtagttcggtaactaaacttacgtaccgtaacgttccgggtaccctttcccggttacttaccggttttcgggaacccggtacggggtaacccgtaagggtacggtaagtaacgtaaccgaaaacgtaagtcggttacggtcctagaccctacgtagtttaccg

SEQ ID NO: 211862 - DNA, 574 bp, Homo sapiens
  misc_feature: GYAE6OF01CH2HJ.43.86.H09.1.454.CMB.1.raw
  modified_base (568)..(568): a, c, t, g, unknown or other
  misc_feature (568)..(568): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccgggtggggatgttgtgatgactcagtctccactctccctgcccgtcacccttgggcagccggcctccatctcctgcaggtctagtgaaacgcctcgtacacgttgatggaaacacctacttgaattggattcagcagaggccaggccaatctccaaggcgcctaatttataaggtttactaaccgggactcgtggggtcccagacagattcagcggcaggtgggtctggcactgatttcacactgacaatcagcgagggtggaggcgtaggagggtagttggttttagggttttattacgtgactagtgactaacttcaccgtacgtcggtcccttccgttacctacgttttcgggaccgtacggggtaccgtaagggtcggagacgtacgaaaacgtacgtggtacggactggacctaccgtnttaccg

SEQ ID NO: 211863 - DNA, 759 bp, Homo sapiens
  misc_feature: GYAE6OF01CT49P.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctccgtggggctgctaatgctcgtcgggtcccagggactccgggtggggattggttgtgatgactcagtctccactcctccctgcccgtcacccgttggcacgccgcctcatctcctgcagtctagtagaacgtcctacgtacagttcgaatacggaaactacctacttagtaattggtatacagacgagacggctacgaccgtaatccgtccgaacggtaccgtacctttaaagttttaagttaacgggtttaccgtaaccgggtaacgtccggttacggggtaccctaaggaacctagtacgttaccgaggccggtcgtaggttcgggtcacgggtcctacgttagtacttttaccaactacgtacgtaactaaacgtcgtaacggacggtaaggggtacgggtaacgggtacgttagggtaacgggttaggtttacgggtttttacgggtttaacgttttaacgtcggtaacttacggttacggtaaacctaaaccgtttaccgaacccgttacgttaccggttccctttacccgtttccgtttaccggtttacgggtaaccggtacggggttaaacccggaggtaccgggtaaaggtaacctacgtaaacggtaacgtcgtacggtctacgactaccgtcgttaccg

SEQ ID NO: 211864 - DNA, 596 bp, Homo sapiens
  misc_feature: GYAE6OF01CMFSE.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctgggggctgctaatgctctgggtcccaggatccgggtggggatgttgtgatgactcagtctccactctccctgcccgtcacccttgggcagccggcctcatctcctgcaggtctagtagaaagcctcgtacacgttgatggaaacacctacttgaattggattcagcagaggccaggccaatctccaaggcgcctaatttataaggtttctaaccgggactcgtggggtcccagacagattcagcggcaggtgggtctgggcaactgactttcactactagtaacaataccgagaccgtaaggggtggagggtacgtggtagggtagttggttttagggttttaacttacgttgactagtgtaactaaacttacactaccgtggtcccttccgttctacgttttcggaccgtacggggtaccgtaagggttcggaagtactacgaaaacggtaacgtagggtacgcgtagacaccgtattaccg

SEQ ID NO: 211865 - DNA, 968 bp, Homo sapiens
  misc_feature: GYAE6OF01C731O.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctccgtggggctgctaatgctcgtgggtcccaggacgtccgggtggggattgttgtgatgactcagtctccactcctccctcgcccgtcacccgttgggcacggcccggcctccatcctcctgcgaggtctaagtagaaacgtccgtcgtacacggttagaacgtaacggaaacctaccttaacgttagtaaagtttggtaacttccgaaggcgaaggacggaccgaacgggaccctaaagtcccgtaaccgaaacgggtccgttaaccgtttaaagtttttaacgttaaacgggttttaacccgtaaacccgggggtacttaccgggtaccgggggttaaccccaaaggtaaccgtaggttaacctttccggaacgggtccgggtacgtaaggggttcggggttaccgtacggggacctaacgttaggtaacttttaccgaacgttaacgtacgtaaaccgtaaacgttaccgaacgggacgggtaagggggtacgggtaacgggtagggttaacgggtaacgggtttaaggttttaacggggtttttttaacggggtttttaaacttttaccggtttacggttaaccgtttaacggttaccggttaaacccgtttaaaaaccgtttacccgaaacccgtttaaccgggttcccgggtttaccccttttaccccgggttttaccgttttaacccgggtttttaccgggaaccccggggttaaaacgggggttaaacccggtaaaagggggttaacggtaaacgggttaaaccgttaaaacccggtaaaaaccgggttaaacggtttcgggtaaccgggttacccgtaacggtaaccccgtaaccgttccgtttacccgg

SEQ ID NO: 211866 - DNA, 689 bp, Homo sapiens
  misc_feature: GYAE6OF01DQ49F.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccgggtggggatgttgtgatgactcagtcctccactcctccctcgcccgtcacccgttgggcaggcccggcctccatctcctgcaggtctagtgaaacgcctacgtacacgttgataggaaactacctattagaattggattcagcagagccaggccaatctaccgaaggccgtaccttaaatttacgtaacggtttaccgtaaaccgggactcggtcggggtacccagactaggattcgaggcggacaggtggtcgtggactacgtgtactttacactactagaacaatacgacgtacggaaggggtaggaggtcgtaggtagggttagtttgggttttagggttttattacgttcgtacgtagttacgtaacctaaacttaccgtaacctaccggttacggttcccctttacccggtttaccgttacggtttttaccgggacccgggtaaacggggtaaccgtaaaggggtacggtaaaggtaacggtaaccgaaacggtaaccgttacggtacgggtacgtacggacctaaccgtagttacccg

SEQ ID NO: 211867 - DNA, 619 bp, Homo sapiens
  misc_feature: GYAE6OF01DNNO2.43.86.H09.1.454.CMB.1.raw
  modified_base (378)..(378): a, c, t, g, unknown or other
  misc_feature (378)..(378): n is a, c, g, or t
  modified_base (605)..(605): a, c, t, g, unknown or other
  misc_feature (605)..(605): n is a, c, g, or t
tcagtgtgagtagtcacgaccggtgctcgatttagtgctatagacttgggtttggggactgatcaggactcctcagttcaccttctcacaatgagctccctgctcagctcctggggctgctaatgctctgggtcccaggatccggtggggatgttgtgatgactcagtctccactctccctgcccgtcacccttgggcagccggcctccatctcctgcaggtctagtgaaacgcctcgtacacgttgatacggaaacacctacttgaattggtattcagcagacggccaggccaatctccgaaggcgtaccttaattttagtaacggttttacgtaaccgggacttcgtcggggtacccagacagtacttcgagcggngaggtggtctcggctactggtactttcacctagtagaactaactacgagacggagggttgggaacggtgtaggagggttagttggttttagggtttattacgtgtacagtgaactaacttcaatccgtcggtcccttccgtttctacgttttcggccggaacggggtaaccgtaaggggtcggtaacgtaacggtaacaaaaccgggtacgttacggtacgggtacngacaccgtgttacg

SEQ ID NO: 211868 - DNA, 539 bp, Homo sapiens
  misc_feature: GYAE6OF01B8SDA.43.86.H09.1.454.CMB.1.raw
  modified_base (355)..(355): a, c, t, g, unknown or other
  misc_feature (355)..(355): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaagcgactaatttataaggttctaacgggactctggggtcccagacagtatcagcggnagtggtctggcactgatttcacactgacaatcgagacgagggtggaggcgtgagggattggttagggttttatacgtgcagtgactaaacttcactacgtcggtccttccgttctacgtttcggacctaggggaccaagggtcggagacgtacaaacggtataggtacgctagcaccgattccg

SEQ ID NO: 211869 - DNA, 625 bp, Homo sapiens
  misc_feature: GYAE6OF01B7FDU.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctaccgaaggccgtaccttaaattttagtaacggtttactaaccgggacttcgtacggggtcccagaccagacttcgaggcggacgtaggttcgggtctgggactacgttagtacttttcaacctacgtagaactaatacgagtacgtaggggtggaggtcgtaggagggtagtttggtttagggtttttattacgtgtactagtcgtactaacttcgactacgtcgtaccttccgttacttacgtttcggaccgtacggggtaaccgtaagggtcggaagtaacgtacgaaaccggtacgttaggtacggctacgaccctaccgtagttccg

SEQ ID NO: 211870 - DNA, 863 bp, Homo sapiens
  misc_feature: GYAE6OF01EOXJY.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctccgtggggctgctaatgctcgtgggtcccaggatccgggtggggatggttgtgatgactcagtcctccactcctccctgcccgtcacccgttgggcacgccggcctccatcctcctgctaggttctagtagaaacgtcctacgtacgtacgttgaatacggaaacctaccttacgttagaagttggattcgagacgaaggacggaccgacggaccaaacgttccgtaaccgaacggccgttaacctttaaagttttaacgttaacggttttaccgaaaccgggtcgttcggtacggggtacccaagtaaccgtagtacttacgaacgggtcggacgtacggttcgggtcgtcgggtacctacgttaggttaaccttttaccaaaccgttaaccgttacggaaaccttaaacgtaccgtaacgggtaccgggtaagggggtacgggtaacgggtcgttaaggggtaagggtttaaggtttttacgggggtttttaacgggttttttaacgtttaaccggttcggtaaccgttaacgttaaccggtaaaccctttaaaacccgtttaccgtaacccgttaacccggtttccgggtcccccttttacccggtttaccgtttacccgggttttaccgggaaccccggggtaaacggggtaaaccccggtaaggggtaccggtaaaggtaaccggtaaaccgtaaacggtacgttacggtacggtaccgttacgaccctaaccgttacgtttacccgg

SEQ ID NO: 211871 - DNA, 567 bp, Homo sapiens
  misc_feature: GYAE6OF01DN4I1.43.86.H09.1.454.CMB.1.raw
  modified_base (289)..(289): a, c, t, g, unknown or other
  misc_feature (289)..(289): n is a, c, g, or t
  modified_base (369)..(369): a, c, t, g, unknown or other
  misc_feature (369)..(369): n is a, c, g, or t
  modified_base (542)..(542): a, c, t, g, unknown or other
  misc_feature (542)..(542): n is a, c, g, or t
  modified_base (562)..(562): a, c, t, g, unknown or other
  misc_feature (562)..(562): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccgcctcatcctcctgcaggtctagtagaaagcctcgtacacgttgataggaacacctactagaattggattcagcagagcagccaanctcaaggcactatttatagttacaaccggatcgtcggggtaccagacagattcgagcggcaggtcgggtactcggctacngtatttcgaactactagaacaactcgagcgtagggtggaaggctggaggagttggtttagggttttattactgactagtgtaactaaacttccacgtacgtcggtccttccgttctacgttttaccgggaccgacggggtaaccagggtaggaagtataaccgaaacggtacnggtacgactagacctacgtntaccg

SEQ ID NO: 211872 - DNA, 592 bp, Homo sapiens
  misc_feature: GYAE6OF01CHYGI.43.86.H09.1.454.CMB.1.raw
  modified_base (295)..(295): a, c, t, g, unknown or other
  misc_feature (295)..(295): n is a, c, g, or t
  modified_base (363)..(363): a, c, t, g, unknown or other
  misc_feature (363)..(363): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttggcagccgcctccatctcctgcaggtctagtcgaaagcctcgtacacgttgataggaaacacctacttgaattggattcagcagacggccaggccaatcnccaaaggccgacctaatttataaggtttcctaaaccgggactcgtgggtcccagacagattcagcggnaggtggtctggcagtgatttcactactgaacaatcagcgagggtggaaggtcgtaggaggtagttggtttaggttttagttacgtgtacattacgacgtaaacttcgaacctacgttacggtccttaccgttccgtaacgttttcggaccgtaggggtaaccgaggtacggaagtaacgtacgaaaacgtaacgttacggtacggtactacggtacaccgtagttaccg

SEQ ID NO: 211873 - DNA, 1036 bp, Homo sapiens
  misc_feature: GYAE6OF01EFWOR.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctcgtgggtcccaggatccgggtggggatgttgtgatgactcagtcctccacctcctccctcgccccgtccacccgttggggccacggcccggccctccatcctcctgctaggtctaggtacgaaacgccttacgtactacgttagacgtaacggaaacctaccttacgttagtaagttggactttacgaacgacgaacggacggacccgtaacgggaccctaaacgtcccgtacccgaaacgggtacccgtaacccttttaaaagtttttaacggttaaacgggtttttacccgtaaacccggggtaccgttaccggttaccgggggtacccctaaaggtaaaccgtaacggttaaccgtttaccggaacgggtacccggggtaccgtaacgggggttcggggtttacccggtacggggtacccgttaaccggttttacggttaaccgtttttacccgaaaccgttaaccgttaacgggtaaacccttaaacggttaccggaacgggtacggggttaacgggggtaacgggtaacggggtaccgttaaggggtaacggggtttaaggtttttacggggttttttacgggttttttaaacgtttaccggttacggttaacccgttaaggtttaacggtaaaccctttaaacccggtttaaccgtaacccgtttaccccggttaccgggtttacccccttttacccggttttacccggttttaaacccggtttttcccggggaaccccggggttaaaccggggggtaaacccggtaaaacggggggtttacgggtaaaaccggttaaacccgggttaaaacccgtaaaacccggggttaaaccgttacccgggttaccgggttacccggtaacccggttaccccgttaaaccggtaccgttttaacccggg

SEQ ID NO: 211874 - DNA, 617 bp, Homo sapiens
  misc_feature: GYAE6OF01BQBKG.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaacgcctcgtacacgttgataggaaacacctacttgaattggattcagcagaggccaggccaatctaccgaaggccgtccttaaatttagtaacggtttccgtaaccgggacttcgtcggggtcccagacagtacttcgaggcggctaggtcgggtctgggcctacgtgtactttcgactactgaactaatcaggcgagggtggaggctaggaggtagtttggtttgggttttatacgtgtcagtgactaacttcactacgtcggtcccttccgttacgttacgtttcgggaccgtaacggggtaacccgtaagggtacggaagtacgttaaccgaaaacggtaacgttcgggtacggaccttacgggacctaaccgtagttcccg

SEQ ID NO: 211875 - DNA, 799 bp, Homo sapiens
  misc_feature: GYAE6OF01BF502.43.86.H09.1.454.CMB.1.raw
  modified_base (220)..(220): a, c, t, g, unknown or other
  misc_feature (220)..(220): n is a, c, g, or t
tcagtgtgagtagtcacgaccggtgctcgatttagtgctatagacttggggtttgggggactgatcaggactcctcagttcaccttctcacaatgaggctccctgctcagctccgtggggctgctaatgctcgtcgggtcccaggacgtccgggtggggattggttgtgatgactcagtctccactcctcctcgcccgtcaccgttggcacgccgcctcntctcgtggcgggtactagtacggaacgtcctacgtactagttggtagaacgtaacggtaaacctaccttagttagtaagttagtactacgacgacgaacggccgaccgacgacctactccgtaaccggaacgtaccttaacgtttaaagttttacgttaacggtttaaccgggtaaccgtaccgttccgggtaccgggtaaccaagtacgtaacgtacgtacgacggggtcgtacggtcgggttcggtacggtacgtacctacgttaggttaaccttacgaacctacgaacggaactaacggttcggaacgggagggggttaagggcggtaacggtgttaagggttaggtttacgttttttggggtttaacgtttacctggactacgttacggtaactaaacccggtttaactccggtaacccggttcggttcccgtttcccgtttaacggtacccgttttaacggggacccgggtaccgggtaaacggggtacgtaacggggactaagtaaaccggtaaccgtaccgggttaagttccgggacttaaccgtacaaacccgttcgtttccttaaccggg

SEQ ID NO: 211876 - DNA, 858 bp, Homo sapiens
  misc_feature: GYAE6OF01DDB6K.43.86.H09.1.454.CMB.1.raw
tcagtgtgagtagtcacgaccggtgctcgatttagtgctatagacttggggtttgggggactgatcaggactcctcagttcaccttctcacaatgaggctccctgctcagctcctggggctgctaatgctctgggtccaggagtccggtgggatgttgtgatgactcagtctccactctccctgcccgtcacccgttgggcacggccggcctccattcctcctgcgtaggtctagtacgaaacgtccgttacgtacgtacgttgaagtacggaaaccaccgttacgttagtaaagtttggtaatttccgaagacgaaggacggaccctaacgggacctaaacgttaccgttaccggaaacggtccggtaaccttaaagttttaacgtttaacggtttaaccggtaaccgggtactaccggttacggggtacccacgtaactacggtacttaccggaacggtccggagtaacgggttacggggtacctcggggtacctacgtttaggtaaccttttaccgaaccttaaccggttacggaaactaaaccgttacggacggtaacgggttacggggtcggtaaacgggtccgtttaacggggaagggtttacggtttaagggggttttttaacgggttttttaaccgtaaccggtttggtacccgtttaaggttaccgggttaaaacctaaacccgtttacgaacccgtttacccggttcccgggttaccttttcccgtaaccggttttccggttaacgggtacccggtaacgggggtaaaccctaggggtacgaagtaacccgtaacgggaaaacgtaccgttagggtaccggttcgactaccgtaacgtcgttaacccg

SEQ ID NO: 211877 - DNA, 947 bp, Homo sapiens
  misc_feature: GYAE6OF01BVA7A.43.86.H09.1.454.CMB.1.raw
tcagtgtgagtagtcacgaccggtgctcgatttagtgctatagacttgggtttgggggactgatcaggactcctcagttcaccttctcacaatgaggctcctgctcagctcctggggctgctaatgctcgtgggtcccaggagtccgggtggggattgttgtgatgactcagtcctccactcctccctcgcccgtccacccgttgggcacgcccggcctccactcctcctgcgtaggtctaggtacgaaacgtcctacgtaactacgttagaacgtacggaaacctaccttaacgttagaaattcggtacttacgacggacaggacggaccgaacggaccctaaagttccgtaccgaaacgggtccgttaacctttaaagttttaacggttaaacgggttttacccggtaaacccggggtaccttccgggttaccggggttacccaaggtaaccgtaacggttaaccgtttaccggaacgggtcccgggtacgtaacggggtttcgggtaccgtcggggaaccttacggttaggttaacctttaccaacgtaacgtaacgtaaccgtaaacgtccggaacggtacgggtaacggggtacgggtaacggtacgttaaggggtaacgggtttaagggttttcgggtttttaacggggtttttaacttaaccggttacggttaaccgtaacgtttaaccggtaaacccgtttaaaacccgtttacccgtaacccggttaacccgggtttaccggttacccccgttttacccggtttaccggttttaacccggggttttaaccgggaaccccgggggttaaaccgggggtaaacccggtaacgggggttaaacgggttaaaccgtaaacggttaaacccggtaaaacgggttaaaccggttcgggtaaccggtacgtaccgtacccgttaacccgttacgtttttacccgg

SEQ ID NO: 211878 - DNA, 685 bp, Homo sapiens
  misc_feature: GYAE6OF01BD0UG.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccgggtggggatgttgtgatgactcagtctccactctccctgcccgtcacccttgggcagccggcctccatctcctgcaggtctagtgaacgcctcgtacacgttgatggaaacaccgtacttgaattggattcagcagacggccaggaccaaatcctaccgaacggcgtaccttaaattttacgtaacgggttttaccgtaaaccggggtacttcggtacggggtacccaggacgtaagtacttcgaggccggacgtagggttgggtcgtgggcctacgttaggtactttccgaacacttacgaactaactacgacggcgtaggggtagggacggacgttaggaggtagtttagggtttagggttttagttacgtagtctagttacgaactaacttaccgaaccgtaccgtacgggttcccttaccggtttaccttaccggttttacggacccggtaacggggtaaccgtaaggggtacggtaagtaacgtaaaccgaaacggtaacgtacggtacggactacggacctacgtacgttccg

SEQ ID NO: 211879 - DNA, 609 bp, Homo sapiens
  misc_feature: GYAE6OF01BS7D1.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctaccgaaggcgtacctaatttagtaaggtttctaaccgggactcgtggggtcccagacagtattcaggccggcaggtcgggtctggcacgtgactttcactactgacaatcagcgagggtaggagcgtgaggtattggtttagggttttattacgtgactagtagactaaacttcaacgtacgtcggtacccttccgttacttacggttttacggaccggtaacgggggtaacccgtaaggggtacgggtaagtaacgttaccgaaaaccggtaacgttacgggtacggacctagaccctaacctagttacccgg

SEQ ID NO: 211880 - DNA, 819 bp, Homo sapiens
  misc_feature: GYAE6OF01AYC4J.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcacgcccggcctccatcctcctgcaggtctagtagaaacgcctcgtaactacgttagataggaaacctaccttacttagtaattggtattcgagcgagacggaccaggaccaagtccgtaccgaaacggccgtaacctttaaagttttaacgttaacgggttttaccgtaaacccggggtacctttaccggtacgggggttaccccaaaggtaaccgtaacggtacgttttaccgacggtaccgggtaccgtaaggggtttccggggttacggttacggggtacccgtaacgtttcggttaactttttacccgaaccgttaaccgttacgaactaaacgtaccgtaacggacgggtaggggtagggtacgggtacgtagggtaacgggttagtttggggtttttagggtttttaacttacgttacgtactaagttacggtaacctaaacgtttccgaaccgttaccggttccggttacccctttaccggttaccgttaccggttttaccgggaacccggtacggggtaaccgtaaggggttacgggaacgttaacggtaaaccgtaaaccggtacgttacgggtacggtaccggtacgtacccaaccgttcgtttacccgg

SEQ ID NO: 211881 - DNA, 859 bp, Homo sapiens
  misc_feature: GYAE6OF01EQ1QY.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagcctccgtggggctgctaatgctcgtcgggtcccagggactccgggtggggattgttgtgatgactcgtagtcctccactactccctcgccccgtcacccgttggccacggcccggtccctctacttccgtccgtgcgtaggtctaggtacgaacgtcctacgtacgtacgttagacgtacggaaacctaccttacgttagtaacttggtacttacgagacgaggacggtacccgacggaacctactacccgtaccggaaacgggtcccgttaactttaaattttaacggttacggttttacccggtaacccgggacgtttaccggtacggggtacccaagtacgtaagtccgttacgacgggtaccggtacggtacgggttcgggtacgtcggtacttacggtacgttacttttaccgaacttaccggttacgaaaccgtaacgttaccggaaggtaccggggtaaggggtagggacccgggttagtacggggtaagggtttagggttttaggggttttttacggttttaacgtaccggtggtttaaccgtacggtaccgtaaacccggtttaaaccttcccggaaacccttcccgggtttaacgtttcccccgtttaaccgtttacgggttttaccttaccgggggtaaacccgggtacgggtaaaccgggttaggtacgggtaaacgtaaccgttaaaaccggaacttaccgggcggtacgttaccgaacgtccctaagttaccgttcg

SEQ ID NO: 211882 - DNA, 673 bp, Homo sapiens
  misc_feature: GYAE6OF01EE2F4.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcgaggtctagtagaaacgcctcgtactacgttgagtaggaaacctaaccttaacttagtaattggtattacgagcaggacggccgaggaccaatcctaccgaacggccgtacctttaaattttaacgttaacggtttaccgtaaccgggtactccggtcggggtacccaagactagtacttacgacggcggacgtaggtcgggtcgtcgggtacctacgttcgtaactttcaacctacgtacgaacctaataccgaggacggtaaggggtgggacggtcgtaggagggtagtttgggttttaggttttattacgtgtactagtcgtaactaacttcgtaactcgtacgtcccgttacgttaccttcggtttacgggaccgtacggggaacgtaagggtcgtaggtaactaacggtaaaacgtcgttacggtcggacgtacgacctacgtgttccg

SEQ ID NO: 211883 - DNA, 745 bp, Homo sapiens
  misc_feature: GYAE6OF01DCX9F.43.86.H09.1.454.CMB.1.raw
  modified_base (246)..(246): a, c, t, g, unknown or other
  misc_feature (246)..(246): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccgttgggcacgccggcctccatctcctgccaggtctagtgaaacgcctcgtacncgtcgataggaaacacctactgtaatggtattcagcagaggccaggccaatctaccgaaggccgtaccttaattttagtaacggttttacgtaacccgggactacgtcggggtacccagaccagtacttcgacgcggcaggttcgggtctcgggctacgtaggtacttttacgaacgtacgtacgaactaataccgtacggaccggtaaagggggttcgggaagggccgtgggtaaggggttaagtttggggttttttagggggtttttaacttttacggttaggtacctaaggtttacggtaacctaaaacccgttttacccgtaaacctaacccggttccgggtaccccgttttacccggtttaccgtttaacccgttttttacggggacccgggtaaacgggggtaccgaaaacggggttcggtaaaggtacgtaacggtaaaaaccggtaaccgttgggttacggtcgttacgtacccgtacctagtttacccgg

SEQ ID NO: 211884 - DNA, 713 bp, Homo sapiens
  misc_feature: GYAE6OF01EM8HV.43.86.H09.1.454.CMB.1.raw
tcagtgtgagtagtcacgaccggtgctcgatttagtgctatagacttgggtttgggggactgatcaggactccttcacgttcaccttctcacaatgaggctccctgctcagctcctggggctgctaatgctctgggtcccaggatccgggtggggatgttgtgatgactcagtctccactcctccctgcccgtcacccgttgggcacgcccggcctccatctcctgcgaggtctagtagaacgtcctacgtacacgttgatacggaaaccaccttattgaattcggtattcagcgagacggccacggaccaatcctaccgaaggtccgtaccttaatttacgttaacggtttaccgtaaccggggcttacggtacgggtacccagactagtactcgagcggctaggtcggtctggactacgtgtaactttccaacgtactagaactaatcgaacggacggagggtaggacggtacgtaggtaaggttacgtttaggttttacgggttttacgttacggtcggtactaggttacgtaaccgttaaaccgttacccgtaaccgtaccggttccggttacccgttacccgtttaccttacccggtttacgggacccggtaaacggggtacccggtaaacgggttacggtaacggtaactaaccggtaaaccggtaccgttaggtccggtactacggaccctacgtacgttacccgg

SEQ ID NO: 211885 - DNA, 778 bp, Homo sapiens
  misc_feature: GYAE6OF01ES4LI.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactcctccctgcccgtcacccttgggcagccggcctccatctcctgcaggtctagtgaaacgcctacgtacacgttgataggaaacaccttacttagaattggattcagcgagacggccaggccaactccgtaccaacggccgtaccttaaattttaagttaacgggtttacctaaaccggggtacttaccgtcggggtaccccaagacaagtactttacgaaggtccggacgtaaggttcgggtacgtcgggtacctaccgttaggtacttttaccgaaccgtacttacgaacctaaactccgaagggtacggtaagggggtagggaacgggtcgttaacgggtaacgggttagtttagggttttacgggttttttaacttacgttacggtacctagttacgtaacctaaaccgtttaccgtaaccgtaccgttaccgggttaccccgtttacccgtttaccgttaaccgtttttacgggacccggtaacgggggtaaccccggtaaaggggttcggtaacggtaacgttaaccggaaaaccggtaaccggttacgggttacggtacccgttaaccggtacccgtaacccgtacgtttacccgg

SEQ ID NO: 211886 - DNA, 719 bp, Homo sapiens
  misc_feature: GYAE6OF01D4ZGY.43.86.H09.1.454.CMB.1.raw
  modified_base (179)..(179): a, c, t, g, unknown or other
  misc_feature (179)..(179): n is a, c, g, or t
  modified_base (223)..(223): a, c, t, g, unknown or other
  misc_feature (223)..(223): n is a, c, g, or t
  modified_base (382)..(382): a, c, t, g, unknown or other
  misc_feature (382)..(382): n is a, c, g, or t
  modified_base (428)..(428): a, c, t, g, unknown or other
  misc_feature (428)..(428): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagcttgggttttcctcgttgcttcttttaagnggtgtccagtgtcaggtgcagcgtgggtggagtcggtggggganacggtcggtccagccgtagggaactccctgacactctcctgtgcagcctcgtggtattccacctttacaaattaattatggcctagtcgctacggtgggtcccgcgaggtcctccgtggacggaaggggtctagggaggttggggtgacctaactttanacgttacatcgtagagtaaggaaagtaagtaaacgtacgtaccganaacggtaaccgtccggtaaggaacgggtaccgtacgttaccaacctacgtaccgtaccggaacggtaacctaaacgtaaccgaacgccgtacctaccgttcttacgtacttacgtaacgaactaaagtacccgaaactaccgtaccgtacgaccgtaacccgtagggaaacggtacggtaaccggttacgtttaaacgttttaacgttacggttacgggtacgtacggtaaacgggtaacgggtaacgggttaaggggtttacggggggtaactttaccggttaacccggg

SEQ ID NO: 211887 - DNA, 584 bp, Homo sapiens
  misc_feature: GYAE6OF01DA00Z.43.86.H09.1.454.CMB.1.raw
  modified_base (239)..(239): a, c, t, g, unknown or other
  misc_feature (239)..(239): n is a, c, g, or t
  modified_base (572)..(572): a, c, t, g, unknown or other
  misc_feature (572)..(572): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccgggtggggattgttgtgatgactcagtctccactctccctgcccgtcacccttgggcacgccggcctcgatcctcctgcaggtctagtgaaacncctcgtacacgttgaattggaaacaccttacttgaattggattcagcagagccaggccaatctaccgagcgtcctaatttataaggtttctaacggactcgtcggggtacccagaccaggtattcagccggcaggttgggtctggcacgtgtattttcacgactagacatcgagacgaggtggagtacgtggaggtattcgggtttaggttttagttacgtgtctagtgtaacgtaaccttcgaactacgtcggtaccttccgttccgttacgtttcggtaccgagggtacccaaagggtgtaagtacgtacgaaaacgtactagtcgactanccactcgttacg

SEQ ID NO: 211888 - DNA, 864 bp, Homo sapiens
  misc_feature: GYAE6OF01CSAH7.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctccgtggggctgctaatgctcgtgggtcccaggatccgggtggggattggttgtgatgactcagtctccactcctccctcgcccgtcacccgttgggcacgccgcctccatctcctgctaggtctagtagaaacgtcctcgtacacggttgaagtacggaaactaccttagttagtaagttggtacttcgagacgaaggacggaccgacggtacccaaacgttccgtaaccgaagggtcccttaacccgttttaaaagtttttaaacggttaaaccgggtttttaacccgtaaaacccggggtaccgtttacccgggttaccgggggttaacccccaaggtaaccgtaaacggttacgtttaccggaacgggtccggtacgtaacgggttcgggtccgtagggaccttacgtttacggttactttaccgaaccttaccgtaagaacctaacgttacggaacggtacgggtaagggggttacggacgggttaccgttagggtaaagggtttaggttttacggggttttaagggtttttaacttacggtacgtaacgtaacgtttacgtaaaccgtttaaaccttccgtaaaccgttacccgggtttaccgtaccccgtttttacccggttacgtttaaccgggttttaccgggaacccgggtaacggggtaaccgtaacggggtacggtaaacgtaccgttaaacgaaaccggttaacgttggtaaccggtctaccggtaccaccgttgtttcccg

SEQ ID NO: 211889 - DNA, 928 bp, Homo sapiens
  misc_feature: GYAE6OF01A0N4L.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcacgccggcctccatctcctgacaggtctagtagaaacgccctagtactacgttagagtaggaaacctacctacgttagtaattggattcgagcgagacggccaggaccaagtcctaccgaacggccgtaccttaaattttagttaacggttacctaaccgggtactcgtacgggtaccaaggtaccgagtacgtacgaagccggtacgtaaggttcgggtcgtagggacctaacggttagttactttacgaaccctaagttaccgtaaacgtaactacggtaacggtacggggtaaacgggggttacggggaacggttaccggggttaaggggtaaacggggttttaacggtttttaggggtttttttaaacgggggtttttttaaaccttttaaccgggtttacggttaacccgttaacggtttaaccgggttaaacccttaaaaccgttttccccggtaaaccgttaacccggtttacccgggggtttacccctttttaacccccggggttttaaccgttttaacccggggttttttaacccgggggaaacccggggttaaccggggggttaaaaacccccggtaaaggggggttttaaccgggtaaacccgggtttaaaccggttaaaaccccggtaaaaaaccgggtttaaacccgtttcgggggtaaccccgttacccgggttagtaaccccccggttaaaacccgtcggttttaaacccccgg

SEQ ID NO: 211890 - DNA, 845 bp, Homo sapiens
  misc_feature: GYAE6OF01CGD8Y.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccgggtggggatgttgtgatgactcagtctccactctccctgcccgtcacccgttggcagccggcctcatcctcctgcaggtctagtagaaacgcctcgtacacgttagactaggaaactaccttacttagtaattggattcagcaaggacggccaggacctaatccgtaccgaaggtccgtacctttaaagttttaacgttaacgggtttacctaaacccggggtacttccggtacggggttaccccaagtaaccgagtaacgttcgaacggccggtacgaaggttcggggtactagggaccgtacttacggtacttttacccaacgtaacgtacgaactaaactccgaaggccggtaagggggtacgggtacgggtaccgttagggtaacgggttaggttttaggggtttttaacggggttttttaacgttaacggttaggtacgttaacgttacggtaaaccttaaaaccgtttccgtaacccgttaaccggtttaccgggttaccccgtttacccggtttaccgtttaacccggtttttaccggggacccgggttaaacggggggtaaacccggtaaacgggggtttaaacgggtaaacgttaaaccggttaaacccggtaaaaacccggttaaacgggttacgggttaaccgggacccgtttaacggaaccccgttaaccccgtaacgttttacccgg

SEQ ID NO: 211891 - DNA, 696 bp, Homo sapiens
  misc_feature: GYAE6OF01CB1H4.43.86.H09.1.454.CMB.1.raw
tcagtgtgagtagtcacgaccggtgctcgatttagtgctatagacttgggtttggggactgatcaggactcctcagttcaccttctcacaatgagcctccctgctcagctccgtggggctgctaatgctcgtcgggtcccaggacgtccgggtggggattggttgtgatcgactcgagtcctccactcctcccgtcgcccgtctacccgttgggccacggcccggtcctccatcctccgtgcgtaggtctaggtagaaacgtcctacgtacgtacgttgaagtacggaaacctaccttagttagaagttggattcgacgcgacggacggccgaacggacctaactccgtacgaacggtcctaacttaaagttttaacgtaacggtttaccgaaccgggtacgttcggtacgggtacccagtacacgtactcgaacggcgtacgtaggtcggtctaggacctagttagtactttacacgtacgtacgaactactacgacggtacggtagggtcggaaggtcgtaggtaagggttgtttagggtttaggttttactacgtcgataacgtcgtaacctaacttcgaacgtccgttcgtccttacccgttcgttaccggtttcggaccggtaacggggtaccgtaagggtacgtagtacgtacgacggtaacgtacgtgggtcgacgtcgacgtacttcg

SEQ ID NO: 211892 - DNA, 663 bp, Homo sapiens
  misc_feature: GYAE6OF01D9MB7.43.86.H09.1.454.CMB.1.raw
tcagtgtgagtagtcacgaccggtgctcgatttagtgctatagacttgggtttgggggactgatcaggactcctcagttcaccttctcaccaatgaggctccctgctcagctcctgggctgctaatgctctggtccaggatccggtgggatgttgtgatgactcagtctccactcctcccgtgcccgtcacccgttgggcctacgcccggcctccatcctccgtgcgaggtctagtagaacgtcctacgtactacgttgaactacggaaactaccttacgttaggaagttggtacttcgagcgaggacggccacggacctaatccgtacccgaacggtccgtaaccttaaatttaacgttaacggttttaccgaaccggtacgggttcgtacgggtacccagaccgagtattcgaggcggataggtcggtctggctacgtgtacttacactactcgactatcgagtacgagggtgaggtcgtaggagtagtttaggtttacgtttatacgtgtactagtacgaacctaacttccgacgtacgttcgtccccgttaccgttacgttaccggtttcggaccggtacgggaaccgtaacgggtacggtaacggtacgtaaccgaaacgtacgtacggtacgtacgtacgacccgtactcgttaccg

SEQ ID NO: 211893 - DNA, 694 bp, Homo sapiens
  misc_feature: GYAE6OF01DIKAW.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccgggtggggatgttgtgatgactcagtctccactctccctgcccgtcacccgttgggcacggccgcctccatctcctgcaggtctagtagaaacgcctcgtacacgttgaatacggaaacacctacttagaatttggattcagcaggacggcctaggaccaaactctacccgaaacgggcgtaccttaaagttttagtaaacggttttacgtaaccgggacttcgtacggggtcccaagactagtagttcaagggccggtacgagggttcgggtcgtagggctacgtgtatttaccgactactacgaacaatcgaacggtacgtaggggtaggacggactggtaagggttagtttcgggttttaggtttttacttaacgtcgtacgtaagtacgtaacctaacttacctaaccgtacgttcggtacccgtttcccgtttaccgtacggttttcggacccggtaaagggggtaaccgtaaggggttacgaacggtaaggtaaaccctaaaacgggtacgtacggttcggacttcggacaccgttagtaccg

SEQ ID NO: 211894 - DNA, 641 bp, Homo sapiens
  misc_feature: GYAE6OF01BZ8EH.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgccttaatttataaggtttcctaaccgggacttcgtcggggtcccagacagattcagcggcagtgggtctggcactgtatttcacactgacaatcagcgagggtggaggtcgtaggaggtagttgggtttaggtttttagttacgtggtactagtagtacctaaactttcaacgtacgttccggtaccctttaccggtttcctaaccgtttttcgggaccgtaacgggggtaacccgtaaaggggtacgggtaacggtaacggttacccggtaaaaaccggtaaaccgttacgggtaccggggtaccttacggacccgtaaacccgtacgtttaacccgg

SEQ ID NO: 211895 - DNA, 753 bp, Homo sapiens
  misc_feature: GYAE6OF01B4YU3.43.86.H09.1.454.CMB.1.raw
  modified_base (747)..(747): a, c, t, g, unknown or other
  misc_feature (747)..(747): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctggggtccccaggatccggtggggattggttgtgatgactcagttcctccactcctccctcgccccgtcacccgttgggcacgcccggcctccatcctcctgcgaggttctaagtagaaacgccctacgtactacgttgaagtacggaaaaccaccttacttagtaagttggtactttcaggcaaggacggacccaacgggaccaaactccgtaccgaacgggtaccgtaccgtttaaagttttaacgttaaacgggttttaccgtaaacccggggtaccgttcgttacgggggtaccccaaggtaaccgaacgtaacgtttaccgacggtaccggacgtacgggtcggggttcgtacgggtcctaccgttggttaacttttaccgaaccttaccgtaacggtaactaaacgttaccgaaggtcggtaaaggggttaggggaacgggtccgtaagggtaagggttacgtttagggtttttacgggtttttaattacgttcgtacgtagtacgtaactaacttacacgtacgtcgtccttcgttacgttcgttcggaccgtacgggaccgtaggtacggaagtacgtacgaaacgtacgttagtcggtctagcctacgngttccg

SEQ ID NO: 211896 - DNA, 841 bp, Homo sapiens
  misc_feature: GYAE6OF01C0FA4.43.86.H09.1.454.CMB.1.raw
tcagtgtgagtagtcacgaccggtgctcgatttagtgctatagacgtttggggtttggggactgatcaggactcctcagttcaccttctcacaatgaggctccctgctcagctcctggggctgctaatgctctgggtcccaggactccgggtgggatgttggtgatgactcagtctccactctccctcgcccgtcacccgttggcacgccggcctccactcctcctgcctaggtctagtacgaacgtcctcgtacacgttgaatggaacacctacgttgaacgttggtattcgagtcgaagacggccaggaccaatctaccgaaggtccgaccttaatttagtaaggtttaccgtaaccgggtacttcggtacggggtacccaaggtacctagtacttacgaacggcggtcgtaaggttcggggtcttacggggccttaacgttacggtaacgtttttaccgaacctacgtacgaaacctaacgttaaccgaacggacggtaacggggtttacgggaacgggtaccggttagggtaacgggtaacggtttacgggtttttaacggggttttaaacttttaaccggtttacggtacccgttaacgtaccgttaaccgtaaacccgtttaccgtaacccgttaaacgttcccgggttacccgttttaccccggttttaccgtaaccggttttttaaccgggacccggtaaacgggggggtaacccctaaacgggggttaccggaaagggttaaaccgttaaacccgaaaaaccgggttaaacccggttcgttacgggtaacccgttaccggaacccggtaaccccgttacggtttaaccccgg

SEQ ID NO: 211897 - DNA, 792 bp, Homo sapiens
  misc_feature: GYAE6OF01AQFCW.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccgcctccatctcctgcaggtctagtagaacgcctcgtacacgttgatggaaacacctacttgaattggattcagcaggacggccacgggccaatccgtaccgaaacggtccgtaccttaaatttttaacgttaaacgggttttaccgtaaaccccgggggtacttaccggttcggggggttaccccaaggtaccgtaacggtacgtttaccggaaacgggttccgggaaccgttaagggggtttcggggttaccgttacggggacccgttaccgtttagggttaactttttacccggaaccttaaccgttacggtaacctaacgtaccgtacgggaccgtagggggtacgggacgggtaccgtagggtagggttaggtttagggttttagggtttttaacgttacgttcggtacgtacgtacgtaaccttaaaccttcgtaaccgtacgttaccggttcccgttccgtttaccgttacggttttacggccgttaaaccgggggtaaccgtaacggggttcggtaaacggtacgttaaccggtaaacggttaacgtcggtaacgggtctaccggctaacccgtcttaccgg

SEQ ID NO: 211898 - DNA, 580 bp, Homo sapiens
  misc_feature: GYAE6OF01BNOEI.43.86.H09.1.454.CMB.1.raw
  modified_base (189)..(189): a, c, t, g, unknown or other
  misc_feature (189)..(189): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgccctnacccttggcagccggcctccatcctccgtgcaggtctagtgaaacgcctcgtactacgttgataggaaacactacttgaatggatcagcagagcaggctatctcagcgcttaatttagtaagttccgtaaccgggactcgtcggggtaccaggacagtattacgnggcggacngggttcggtcgttggcctacgtgtatttacacactgaactaatcagcgagggtggagcgtgtaggtagttggtttaggttttacttacgtgtcagttagactaactacactacgttagtcccttccgttctaccgttttggaccggacggggaaccgtaaggtcggtaagtactaacgaaaccgtaagacggttgacgttagacctaccgtagttccc

SEQ ID NO: 211899 - DNA, 731 bp, Homo sapiens
  misc_feature: GYAE6OF01A7K2F.43.86.H09.1.454.CMB.1.raw
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggactccgggtggggattgttgtgatgactcagtctccactcctccctcgcccgtctaccctgggcacgccggcctcnctctcngctagtctagtagaacgcctacgtacacgttagagtacggaaactaccgttacttagtaagttggtacttacgagtacgaggacggaccgacggtaccaacttccgaccgaacggtaccgtacctttaaagttttaacgtttaacggtttaccgtaaaccgggtaccgttacggtaccggggtacccacgaccgtaagtaccgttacgacgggcggtcgtaagggttccgggtagtacggacttaacgttcggttaacctttaccgaactactaggaactaagtccgaagggtacgtagggtaacggcggtacgttagggtaacggtttaggttttcgggttttacgggtttttaactaacgtggtactaagttcgtaaactactacaaccgtccgttaccgtccgtttaccgttataccggtttcggaccggtaacggtaacgtacgggaggtaaccgagtaaaccgtaacggtaacgtcggttacgacgtatacctacgttcttacg

SEQ ID NO: 211900 - DNA, 750 bp, Homo sapiens
  misc_feature: GYAE6OF01CA7JO.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccgggtggggatgttgtgatgactcagtctccactctccctgcccgtcacccgttgggcagcccggcctccatctcctgcaggtctagtagaaacgcctcgtacacgttgatacggaaaccaccttacttgaattggattcagcagacggccgaggacctaatccgtaccgaaacgggtccgtaccttttaaaagttttaacgttaaacgggtttttacccgtaaacccggggtacctttcccggtacgggggttaccccaaggaaccgtaaggtacttacgacgggccggtacgtagggttacggggttcctcgggactaccgttgtaacttttaccgaacctacgtacgaactaaacgtcgaaggaccgaaggtaacggttgggaacgggtcgttagggaagggtttagttaggtttttaaggggtttttataacggttgtacctagttacgtaacctaaaccgttcaaccgtaccgttccgggttacccttaccgtttaccgttaccggtttcgggacccggtaaggggtaaccgagggttacggaaacgtacgtaaccgtaaacggtaacgttcggtacggccttacggaccctaacgttaccg

SEQ ID NO: 211901 - DNA, 858 bp, Homo sapiens
  misc_feature: GYAE6OF01DEKB4.43.86.H09.1.454.CMB.1.raw
tcagtgtgagtagtcacgaccggtgctcgatttagtgctatagacttgggtttggggactgatcaggactcctcagttcaccttctcacaatgaggcctccctgctcagctccgtggggctgctaatgctcgtgggtcccaggatccgggtggggattgttgtgatgactcgagtcctcccaccttcctccccgtcgccccgtcctaccccgttgggccacggccccggcccttccacttcctccgtggacgtacggtcttagtacggaaaccgtcccttaccggtaacgtacggtttagaacgttaacgggaaaacctaccctttacgtttaggtaaagtttcgggtatttacgaagtaccgaaggacggaccccgacgggaccccaaacgtcccgtaccggaacggccgtacctttaaagtttttaacgttaacgggttttacccgtaaaccgggtaccgttccggtccggggtacccaggaccgtagtacttacgacggccggacgtacgggttcgggtcttgggacctacgttagttaccttttaccgaacgtacttaacgaacctaacgtaccgaacgggtacgggtaacggggtgggaacgggtcgtaagggtaacgggttaggttttagggtttttaacgggtttttaacgtttaccgttagtacgtaacgttaccgtaaacctttaaccgttaccgtaaccgtaccggtttccggtaccccgtttacccggtttaccgttacggttttaccgggaacggtaaccggggtaaccgtaaggggtaacggtaagtaaccgtaacggtaaaccgtacggttggtaccgtcgaacgtaccctacgtcgttaccgg

SEQ ID NO: 211902 - DNA, 622 bp, Homo sapiens
  misc_feature: GYAE6OF01CHD1K.43.86.H09.1.454.CMB.1.raw
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgataggaaacacctacttgaattggattcagcagaggccaggccaatctccaaggcgctaattttagtaaggtttccaacgggacttctgggtacccagacaagacttcagcggcaaggtgggtcncgggtnacgtgatttcacactgacaatcagacagggtggaggctagaggtagttgtttagggttttacttactgctagtgacaaacgttcaacctacgtacggtccttacccgttacctaacgtttttcgggacccgtaaacgggggtaacccggtaaaaggggtagggaaaggtaacgttaaaccggaaaaccggtaaaacgttcgggttaacggaccgtttaggaccctaacccgtaaaggtttcccg

SEQ ID NO: 211903 - DNA, 966 bp, Homo sapiens
  misc_feature: GYAE6OF01CBPQ6.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctcgtgggtcccaggactccgggtggggattgttgtgatgactcagtctccactctccctcgcccgtccacccgttgggcacgcccggcctccatcctcctgcgtaggtctaggtagaaacgtcctcgtacacgttgataggaaacctaccttacttagtaagttggattcgagcgaggacggccgtacggacctaactccgtaccgaacgggtaccgtaacctttaaagtttttaacgttaaacgggtttttacccggtaaaacccggggtaaccgtttccgggttaccggggggttaccccaaaggtaaccgtaacggttaacgttacccggaacggggtcccgggtaacgtaacggggtttcggggttaccgtcggggtaccttaaccggtttacgttaacctttttacccgaaaccgttaccgttaacggtaaacctaaacggttccggaacgggtacgggttaacggggggtagggaacgggttccggttaaggggtaaggggtttaggtttttacggggttttttagggtttttaaacctttaccggttacggttaacgttaacgtttacgggtaaaccctttaaaccgtttacccgaaccggtttacccggttacccggtttacccccgttttaacccgggtttaccgttttaaccccggggtttttaccggggaacccggggttaaaccggggggttaaaccccggttaaaggggggttaccggtaaacgggttaaccgtttaaaacccgggtaaaaccggttaccgggttacgggttaccgggttaacccgttacccggtaaccccgtaaccgtttaccggtttaccccgg

SEQ ID NO: 211904 - DNA, 749 bp, Homo sapiens
  misc_feature: GYAE6OF01EBWXN.43.86.H09.1.454.CMB.1.raw
  modified_base (105)..(105): a, c, t, g, unknown or other
  misc_feature (105)..(105): n is a, c, g, or t
  modified_base (179)..(179): a, c, t, g, unknown or other
  misc_feature (179)..(179): n is a, c, g, or t
  modified_base (220)..(220): a, c, t, g, unknown or other
  misc_feature (220)..(220): n is a, c, g, or t
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
tcagtgtgagtagtcacgaccggtgctcgatttagtgctatagacttgggtttggggctgggagacgagcccagcactggaagtcgccggtgtttccattcggtnatcagcactgaacacagaggactcaccatggagtttgggctgagcttgggttttcctcgttgcttcttttaagnggtgtccagtgtcaggtgcagctggtggagtcgtggggganacgtggtccagccgtgggaactccctgacactctcctgtcgcagtccctgtaggtacttaccaccctttaanaaattaattagnggacattgccacggtcggggtcccaccgaggtcctccgtgggacgtaaggggctagggaggtggggtagctaagttatatcgaatcgtagtaagttaggaacgtaagaaacgtactacggacgtacgtaccgtcggtaaggaacgggtacccgtaagttaccaaacccgtacgttacccgtaaccggaacgggtaacctaaacgttaaccgaaaccggtacccgtaccgtaaccgttaccggttacgttaacgtacgtaacggaacctaaacgttaacggtaaacctaccggtacccgttaacgaaccgtaacccggtaggaacgggtaacggtaaccggttacgtttaaacgtttaacgtttacggttacggtacggtacggaaacgggtaacggtaacggggtacggggtttaacggggggtaccttcggtttaaaccccggg

SEQ ID NO: 211905 - DNA, 727 bp, Homo sapiens
  misc_feature: GYAE6OF01D3GOA.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccgggtggggatgttgtgatgactcagtctccactctccctgcccgtcacccgttgggcacgcccggcctccattcctcctgctaggtctagtagaaacgcccttacgtactacgttgaatacggaaacctacctacttgaattggtattcgagcaggacggccgacggacctaactccgtaccgaaacgggccgtaaccctttaaagttttaacgttaaaccgggttttaccgtaaaccgggtaccgttaccggtacgggggtacccaaggtaacgacgtagttacgacggcggtcgtaggttcgggtcgtcggactacgtgtactttcaactactagaactaagtacgaggacgggtagggtaggacggtcgtaggtaggttagtttgggttttagggtttttacttacgttcgtacgttagtacgtaaccgttaacttcgtaaccgtaccgttccggtcccgtttacgttccgttaacggtttacgggaccggtaacggggaccggtaagggtacggtaaggtaacgtaaacggaaaccgtacgttcgggtacgtccgtagtacccgtacgtacgttacccg

SEQ ID NO: 211906 - DNA, 884 bp, Homo sapiens
  misc_feature: GYAE6OF01B3FRI.43.86.H09.1.454.CMB.1.raw
  modified_base (224)..(224): a, c, t, g, unknown or other
  misc_feature (224)..(224): n is a, c, g, or t
tcagtgtgagtagtcacgaccggtgctcgatttagtgctatagacttgggtttggggactgatcaggactcctcagttcaccttctcacaatgaggcctccctgctcagctccgtggggctgctaatgctcgtcggtcccaggtagtccgggtgggattgttgtgatgactctacgtcctccaccttccctcccgtccgtcccgtccgtacccggttgggaccncggcccggtccctacctctcctccgtgacgtaggttacgtaggtaacgaaaccgtccgttacgtacgtacggttagtaacgtaacggaaaacctaccgtttaagttaggtaacgttaggtacttacggaagaccgaacggacggaccgtacggtaacccctaacgtacccgtaaccgaacgggtaccttaaccgttttaaaaggttttaacggttaaaacgggtttacccgtaaacccgggtcttacgggttaccggggaacccaaggtacctaacggttacgttacggacggtacggtaccggtacgggttaccggtcgtacgggtacctaccgttaggttactttaccgaacgtacgtacgaactaacgtacgacggtagggtagggacgtaggtacgtgggtaggttaggttttagggtttacgttttacgtacgtcgttacgtacgtaacgtaaccgttaaccgttaccgaaccgttccggttcccgttacccggttttaccgttaccggtttaacccgggtttaccggggaaacccgggttaacgggttaaacccgggtaaggttaacgggtaacttaaccggtaaaccggtaaacccgggttagttaccgggttacggaccgttaccggtaacccttagtttaccggtttaccg

SEQ ID NO: 211907 - DNA, 755 bp, Homo sapiens
  misc_feature: GYAE6OF01BTSY1.43.86.H09.1.454.CMB.1.raw
  modified_base (222)..(222): a, c, t, g, unknown or other
  misc_feature (222)..(222): n is a, c, g, or t
tcagtgtgagtagtcacgaccggtgctcgatttagtgctatagacttgggtttgggggactgatcaggactcctcagttcaccttctcacaatgaggctccctgctcagctccgtggggctgctaatgctctcgggtcccaggactccgggtggggatgttgtgatgactcagtcctcctactcctccctcgtcccgtctacccgttggcacgcccgcctcnctctctgcgtagtactagtacgaacgtcctacgtactacgttagataacggaacctaccttattagattggtacttacgagtacgagacggccacggtacctaacgtccgaccggaacggtaccttaccgtttaaagtttacgttaaacggtttccgtaaacccgggtcttaccgggtaccgggtaacccaaggtaccgtagtaacgttacgacgggtcgtacgtacgggtaggttccgacggtaccgttaaccgttcgttaactacgaaccgttagtaacgtactaccggaggaccggtaggggtaggtacgcgtaggacggttaagtttgggttttacggtttaattaccgttagcttaagtacctaagttaacctacgtaccgttaaccgttccgttacccgttacgttcctacggttaccggtacggtaaccgggtacggtaaacggtaggtaagtaaacccgtacggttaaaacccgtaggttacggtccgtacggtacgtaacccacgttaaccgttcgttaacccg

SEQ ID NO: 211908 - DNA, 788 bp, Homo sapiens
  misc_feature: GYAE6OF01C9LQ4.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctcgtgggtcccaggatccgggtggggattgttgtgatgactcagtcctccaccttcctcccctcgtcccgtccacccgttgggccacggcccgcctccatcctcctgcgtagtctagtacgaaacgtcctacgtaccgtacgttgaagtaacggaaacctaccttacgttagtaagttggattacgagcgaaggacggacctaggaccctaactccgtaccggaacggtccgtaacctttaaagttttaacgttaacggtttaacccgtaaacccgggtaccgttaccggtaccggggtacccaagtaacctagtaactttccgaagggcccggtagtacgggttcggtccgttcggacctacgtagttacgtttacaacgtacgtactaactaacgtacgacggtacgggtaggggtacgggacggtacggtaaggggtaacgggtttaggtttacgggttttaggttttaacgttacgttggtactacgttaacggtaacctaaacttcccgaaccgttaccgtaccggttccctttacccggttaccgttcggtttacccgggacgtaaccgggggtaaccgtaaggggtacgtaacggttaacgtaaaccgtaaacggttacgtcggttacggtcctacgaccttacgtcgttaccg

SEQ ID NO: 211909 - DNA, 741 bp, Homo sapiens
  misc_feature: GYAE6OF01DMUX3.43.86.H09.1.454.CMB.1.raw
tcagtgtgagtagtcacgaccggtgctcgatttagtgctatagacttgggtttggggactgatcaggactcctcagttcaccttctcacaatgaggcctccctgctcagcctccgtggggctgctaatgctcgtcgggtcccaggagtccgggtggggatgttgtgatgactcagtcctccactcctccctcgcccgtcctacccgttggcacgcccgcctccatcctctgctaggtctagtagaaacgtccttacgtactacgttagatacggaaaacctaccttacgttagaagttggtattacgagacgaaggtacggccgaacggacctaacgtccgtaaccgaacggtccgttaaccgtttaaattttaacggttaaaccggttttaccgtaaacccgggtacttccggtaccggggtacccaagtaaccgtacgtacttacggaacggccgggtacgtagggttcgggtcgtcggctaacgtgttactttaccacgtactacgaactaactcgaagacgggagggtggaggtacgtaggtaggttaggtttaggtttaggttttactcggtgactagtacgtaactaacttacgacttaccgttcggtaccctttcgttacgttaccggtttcggaccgggtacgggtaaaccgtaaggggttacggaagttaaaccggtaacgtaaaacggtacgttcgggtaccgtaccgtacgacctaacccgtgttacccg

SEQ ID NO: 211910 - DNA, 716 bp, Homo sapiens
  misc_feature: GYAE6OF01DINW1.43.86.H09.1.454.CMB.1.raw
  modified_base (330)..(330): a, c, t, g, unknown or other
  misc_feature (330)..(330): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttggctgagctgggttttcctcgttgcttcttttaagaggtgtccagtgtcaggtgcagctggtggaggtcgtgggggagacggtggtccgagcccgtagggaacgtccctgacctactctcctgtcgcacgtcctcgtggacttccaaccttacaaattaacttagtggacatgcctacgtcgggtcccnccgaggcctccgtggacgaagggtcgtagggaggtgggtcgactacttagtatcgtatcgtagtagtagggtaagtaaggaaagttacgtaacggctaacggtaccgtaccggtaggaacggtaccgtaacgttaccgaacctactaccgtaccgtaacgggaactaacgttaacgaaacgccgtttttaccaccttacgtacgttactacgtacgtaacgtaaacgtacgtaacgaccgtacccgtacgtacccgtaaccggtaacggtaacgggtaccggtaaccggtacgtttaacgttttaactttacggttaggtacggtacggtaacggtaaccggtaaacgggttaggggttaagggggtaccgttcggttaaacccgg

SEQ ID NO: 211911 - DNA, 585 bp, Homo sapiens
  misc_feature: GYAE6OF01C5RRZ.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgataggaacacctactgaattggattcagcagacggccaggccaactctccaaaggcgtacctaatttagtaacggtttactaaccgggactcgtacggggtacccagacagattacaagcggcagtggctgcactgatttcactatgacactcagacgagggtaggaggactaggaggtattggtttagggttttacttaacttggactagtagaccgtaaacttcacgtacgtcggtcccttaccgttcgtacgttttcggaccgtaacggggtaccaagggtcggagtataaccgtaaaaccgtacgtacgtcggactagacccacgtcttaccg

SEQ ID NO: 211912 - DNA, 782 bp, Homo sapiens
  misc_feature: GYAE6OF01CRBG1.43.86.H09.1.454.CMB.1.raw
  modified_base (174)..(174): a, c, t, g, unknown or other
  misc_feature (174)..(174): n is a, c, g, or t
tcagtgtgagtagtcacgaccggtgctcgatttagtgctatagacttggggtttggggctgggagacgagcccagcactggaagtcgccggtgtttccattcggtgatcagcactgaacacagaggactcacatggagttggctgagcttgggtttcctcgtgcttctttaagngtgtccagtgtcgaggtgcagctgggtggagtcggtgggggagtaccggtggtaccaggccgtaggggtaacgtccctgaacctctccgtcgtgtcgactacgtccgttcgtacggactttaccacctttactaaaagttaactttagcggtactagtcgtaccgtacggtcgggtccccgacgtacggtcccttaccggacggacggtaacgggggtcgttaggggtacgggtcggggttacggaacttaaccggtttaataccgtacgtagttacgtagggtaaagtaacggggtaaagtaacggtaaaacgtaccgtacgtaaccgaacggtaaccgtaccgggtaaggaaccggtaccgtaacgttcccaaccgtaacgtcccgtaacggaacggtaaactaacgttaacgaacggtcccgtataccgttctaggtacctaggtaactaaccgtaaagtaccgaacctaccggtcttaacccggacgtaaccggttaaggaccggtaaaccggttagttaaccgtttaaagtttacgtacgttacgggtacgaacggtaaggtacggttaggtaaggggtttcgggaacgttcgttaacccggg

SEQ ID NO: 211913 - DNA, 933 bp, Homo sapiens
  misc_feature: GYAE6OF01COD90.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctccgtggggctgctaatgctctgggtcccaggatccgggtggggattgttgtgatgactcagtctccactcctccctcgcccgtcacccgttgggccacgcccggcctccatcctcctgcaggtctagtagaaacgcctcgtactacgttgatacggaaacctacttacgttgaacgttggtacttcgagtcgaaggacggacccaagggacccaaacgttacctacccgaaacgggtcccggtacccttttaaaagtttttaacggttaaaacgggtttttaccccgttaaaacccgggggtacccttacccgggttaccgggggttacccccaaagggtaaccgaacggtaacctttaccggacggggtaccgggtacgaacggggtttcggggtccgttacgggggaccttaacgttacggttaacgttttacccaaacgttaccgttacgaaccttaaacgtaccgaacggaccgggtaagggggttacgggacgggtacggttacgggtaagggtttaggtttagggttttacggggttttttaaacgttacgtttacggtacttaagttaccggtaaccgttaaaccgtttccgtaacccggtaccgttaccgggttaccccgtttaccccggttttacccggttaacccgttttttaccggggaccccgggttaaaccggggggtaaaccccgggttaaagggggttaccggggttaaaccggtaaaccggtttaaaccggtaaaaacccgggtaaacgtttaccggggtacggttacccggttaagggaacccccttacgtaaccgttttacccgg

SEQ ID NO: 211914 - DNA, 864 bp, Homo sapiens
  misc_feature: GYAE6OF01D3JN7.43.86.H09.1.454.CMB.1.raw
tcagtgtgagtagtcacgaccggtgctcgatttagtgctatagacgtttgggtttggggactgatcaggactcctcagttcaccttctcacaatgaggcctccctgctcagctccgtgggctgctaatgctcgtcgggtccaggagtccggtgggattgttgtgatgactcagttcctccactccgtccctgcccgtctacccgttgggcacggcccggtcctaccattcctccgtcgacgtaggtaccgtaggtaacgaaacggtcctacgttacacggttagaacgttacggaaaaccttacccttagttagtaacgtttcggtaacttcgaagacgaaggaccggtacccgaacggtaccctaacttcccgtaaccggaaagggtcccgttaaccttttaaagtttttaaacggttaacggttttacccgtaaaccgggtcttacgggtacgggtacccaagtaccgtagtacgttacgacgggtcggtacggtggttacgggtctacggtactacgttacggttacttaccgaaccgtacgttaacggaacctaaacggttacctaacggggtacgggttaaaggggtcggggaaccgggttacggttaacgggttaaggggtttaacggtttttaggggttttaacggttttttaacggttaccttacggttacttacggttaacgtaacccttaaacgttaccgtaaccgttaaccggtccggtttaccccgttacgttacgtttaccgggttaccggacgggttaaccggggtaacgtaacggggttcggaaggtaccgttaaaccgaaacggtacgttcggtacggcgttaacggccctaaacgtccgtttaaccg

SEQ ID NO: 211915 - DNA, 916 bp, Homo sapiens
  misc_feature: GYAE6OF01AT554.43.86.H09.1.454.CMB.1.raw
  modified_base (181)..(181): a, c, t, g, unknown or other
  misc_feature (181)..(181): n is a, c, g, or t
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
tcagtgtgagtagtcacgaccggtgctcgatttagtgctatagacgttagggtttgggactgatcaggactcctcagttcaccttctcacaatggaggcctccctgctcgagcctccgtggggctgactaatgctcgtggtccaggctcgggtgggatggttgtgatgactcagtcctacnctctccctcgcccgtcaccgttggcncgcccgtcctacntcctctgcgtagtctagtacgaactccgtacgtactagttgacgtaacggtaactaccttagttagtaagttcgtacttcgaacgcgaacggacgaccgaacggaacctaagtccgtacccgaaaggtcccgttaaccttttaaaagtttaaccggttaacggtttaccccggtaaaacgggtccgttccgggtaccggttacccgaagtaacgtagttaccgttacggacggccggtacgtcgggttacgggtctaaccgggtacctaaacggttcgttaaaccttttccgaaaccgttaccggtaactaaacccggtttaagaaccgggttacgggaaacggggtagggggttaccggggtaacccgggtacggttaaagggtttaccgggtttttaaggggtttttaaccgggggttttttaaagttttacccgttaacccggtagtttaccggttaaacccggttaacgttaaaaccctttaaccggtaccccgtttaacgggttccccgtttaccccgggtttaacccggttttaccctttaccggggtttaccgggaccccgggttaaacccggggtaaaagggacggggtttaacggtaacggtaacccttaaacgggtaaacgtacccggtttcgggtaccgtacggtaccccttaaaccgggcctttaaaccgtggttttacccccg

SEQ ID NO: 211916 - DNA, 631 bp, Homo sapiens
  misc_feature: GYAE6OF01EQAB6.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaacgcctcgtacacgttgatggaaacacctacttgaattggattcagcagaggccaggccaatctaccgaaggcgaccttaatttataaggttttctaaccgggtactcgtcggggtcccagacagattcagcggcaggtgggtctggcactgtactttcacactagacaatcagcgagggtggaggcgtggaggtagttggtttagggttttattacgtgctagtcgactaaacgttccaactaacgttcggtcccttcccgtttacttaccgttttcgggacccgtaacgggggaacccgtaaaggggttacgggaacggtaacgttaaccgtaaaaccggtaaccgttacgggttacgggtacccgtacggtacccgtaaacccgtacgtttacccgg

SEQ ID NO: 211917 - DNA, 616 bp, Homo sapiens
  misc_feature: GYAE6OF01AYTQP.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaacgcctcgtacacgttgatggaaacacctacttgaattggattcagcagaggccaggccaatcctaccaaaggcgtaccttaaattttaagtaacggttttctaaaccgggactcgtggggtcccagacagtattcagcggcaggtgggtctgggcacgtgtactttcaactacgtagaactaagtacacgcgaagggtggaggtacgtaggagggtagttggtttagggtttttaattactagtctaagttcgtactaaacttcaccgtacgttacggtcccttaccggttcttacgtttcgggacccgtaggggaaccgtaagggtcgggaagtaacgtaccgaaaacggtaacgtggtacggctacgctaaccgtattaccg

SEQ ID NO: 211918 - DNA, 1025 bp, Homo sapiens
  misc_feature: GYAE6OF01AFUBS.43.86.H09.1.454.CMB.1.raw
tcagtgtgagtagtcacgaccggtgctcgatttagtgctatagacttgggtttggggacgtggatcaggactcctcagttcaccttctcacaatgaggctccctgctcagctcctgggctgctaatgctcgtcggtcccaggactccgggtggggattggttgtgatgactcagtctccactcctccctcggtcccctaccgtacccgttgggccacggcccggccctaccagttcctcctgacgtacggttcctaaggttacgaaacgtcccgttacgtaaccgtacggtttagaactacggtaaaaccctaccgtttaagtttagtaaacgtttgggaactttcgaacgtacgaggtaccggaccgacggtacccaacgttcctaccgaaacggcccgtacttttaaatttaacggttaacgttttacccgaaccgggaactttccggtacggggaccctaagaccgtaacggtcgttaaccgacggtaccggacgttacgggtttcgggtcgtacgggtacctaacggtttacgtacgtttacccgaacgtacccgtacgtaaaccgttacgtaccgacggtaacccgggtaagggggttacggtacgggtaaccggttaagggtaacgggtttacggggtttttacgggttttaaacggggttttttacgtttaaccgttacgggttaactaacgtttaaccgggttaaacctttaaacccggttttaccgtaacccgggttaaacccggttttcccgggtttacccgtttttaaccccgggtttaccgggttttaaaccccgggttttttacccgggaacccggggggtttaaaacccgggggttaaaaccccggggttaaacgggggttttaacccgggtaaaccgggtttaaaacccggttaaacccgggttaaaaccgggtttaaaaccccgggtttcggggttaaaccccgggtttaccggttaaacccccggggttacctttaaaaccccggggtttacgtttttaacccccggg

SEQ ID NO: 211919 - DNA, 951 bp, Homo sapiens
  misc_feature: GYAE6OF01CWXYA.43.86.H09.1.454.CMB.1.raw
  modified_base (939)..(939): a, c, t, g, unknown or other
  misc_feature (939)..(939): n is a, c, g, or t
tcagtgtgagtagtcacgaccggtgctcgatttagtgctatagacgttggggtttgggggactgatcaggactcctcagttcaccttctcacaatgaggcctccctgctcagctccgtggggctgactaatgctcgtcgggtccaggcgtcgggtggggtattggttggtgagtcgacctctacgtcctcctacctcccgtcccgtccggcccgtccgtacccggttggggacccacggcccgcctacctcttcctccgttaggccgtacggtacgttaaggacgaaccgtccttacggtaaccgtaggttagaacggtaacgtaaaccctaccgtttaagttaaggttaagttacggtaacttcgaaggaccggacggaccggaccgtacggaccctaacgttcccgaaccggtaacgggtaccgtttaactttaaaaggtttttaaccggtttaaaccgggtttaaccccggttaaaccggggtaccgtttaccgggttaccgggggtaacccctaaggtaccgtaaggtagttaccgggaagggtccggtacggtacgggttcgggtacggtacgtacgtaaccgtttggtaaacctttacgaacgtaaccgtacgaaactaacggttaccgagggggaaccggtaggggggtaggtaacggtacgggttaagggttaacggggtttaggttttacggggtttttaacgttttaacgtcggttaacgttcttaaacgggtacgttaaacccgttaaactacccgttaaccgttcccggttaaccgggttcccttttacccggtttaacgggttaccggtttaacccggggaaccggggtaaacgggtaccggtaaaagggggtcgtaaaccggttaaacggttaaaccggaggtttacccggaagggttccggttaacgacctaacgtttaaccgngtttaaccccgg

SEQ ID NO: 211920 - DNA, 717 bp, Homo sapiens
  misc_feature: GYAE6OF01BLBB1.43.86.H09.1.454.CMB.1.raw
  modified_base (713)..(713): a, c, t, g, unknown or other
  misc_feature (713)..(713): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcacgccggcctccatctcctgcaggtctagtgaaacgcctcgtacacgttagataggaaactacctacttgaattggattcagcaaggacggccacggaccaactccgtaccgaaagggtccgtacctttaaagttttacgttaaacgggttttaccgtaaacccgggtacttacggttcgggggtaccccaaggaaccgtaggtaacgtttcgaagggccggtacgtacgggttcgggttcgtcgggacctacgttagtaacttttaccgaactaacgtacgaactaacgtcgaacggtacgggaaggggttagggagggtcgtagggaagggtagtttgggttttagggtttttattaacgtgtacgtagtacgaaccgtaaacttcaaccgtacgtcggttccccgttccgttaccgtttacgtttccgggaccggtaaggggtaacccgaaggggtcggaagtaacgttaacggaaacgttacgtggtacggtactacggacctaccgtntccg

SEQ ID NO: 211921 - DNA, 853 bp, Homo sapiens
  misc_feature: GYAE6OF01A7U38.43.86.H09.1.454.CMB.1.raw
  modified_base (101)..(101): a, c, t, g, unknown or other
  misc_feature (101)..(101): n is a, c, g, or t
  modified_base (558)..(558): a, c, t, g, unknown or other
  misc_feature (558)..(558): n is a, c, g, or t
  modified_base (587)..(587): a, c, t, g, unknown or other
  misc_feature (587)..(587): n is a, c, g, or t
tcagtgtgagtagtcacgaccggtgctcgatttagtgctatagacttgggtttggggactgatcaggactcctcagttcaccttctcacaatgaggctccngctcagctcgtggggctgctaatgctcgtgggtcccagggcgtccgggtggggtattggttgtgattcgactcgtacgttcctccctacctccttccccgtcggtccccgttcctacccggttggggaccaccggccccggtccctcctacttcctccgtgcgtaggtcctaggtacgaaacgtccttacgtacgtacgttagaagtacgaaacctacttagttaggagtttacggtacttccggagtcgacggtaccggacccgaacggtacctaacgttacccgtaccggaaacggttcccgttaaaccttttaaagttttaaccggttaacgggttttaccccgaaacgggttcctttccgggtaccgggtacccaagtaccgtagtaacttcggacggtcggtacggtaggttccggtatcgggacctacgtttagtacttccaactacgtanaacgtactcggaacggcgggtaacggggngaacgggtacgttaggggtaagtttagggttttcgggttttaaaggttttactacggttcgggtacctagttaccggtaaacttaaaccggttaccgtacgttaaccggttcccgtttaaccgtttacccggttaccgtttacgggttacccgggaaccggggttaaacggaaacccgggttgtaacgggaaacccgttaacggtaaacgttaaaccggttcggttcgggaactacccggtaaacttaccctaaccggttcggttc

SEQ ID NO: 211922 - DNA, 754 bp, Homo sapiens
  misc_feature: GYAE6OF01DE2H3.43.86.H09.1.454.CMB.1.raw
tcagtgtgagtagtcacgaccggtgctcgatttagtgctatagacttgggtttggggactgatcaggactcctcagttcaccttctcacaatgagctccctgctcagctcctggggctgctaatgctctgggtcccaggactccggtgggattgttgtgatgactcagtcctccactcctccctcgcccgtccacccgttgggcacgccggcctccatcctcctgcaggtctagtagaaacgcctcgtacacgttcgatacggaaacctaccttaacttgaattggattcagcagacggcccgagaccaactctaccgaacggccgtaacctaattttaacgttaggtttaccgtaaccgggtactcggtacgggtcccaggacagtactacgaggcgtcgtagggttcgggtcttcgggactacgttaggttaactttacaaccgtacgtacgaaccgttaatccgaagggtaccggaagggggtttcggggaacgggtacggttagggtaaggttaggttttacggggtttttagggttttaactttacgttacgggtcttaagttacgtaaaccgttaaacctttaaccgaccggttaacgttcccgggttacccccgtttaccgttttacccgtttacgggttttccgggacccgggttaaccggggtacgtaacggggttagaacggttaactaaccggtaaaacggtagttcggtacggttaccttacggacctaacgtcgtttaccg

SEQ ID NO: 211923 - DNA, 878 bp, Homo sapiens
  misc_feature: GYAE6OF01BEZY5.43.86.H09.1.454.CMB.1.raw
  modified_base (157)..(157): a, c, t, g, unknown or other
  misc_feature (157)..(157): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtgggatgttgngatgactcagtctccactctccctcgcccgtcacccttgggcaggcccgcctcatctcctgcaggtctagtagaaacgcctcgtacacggttgactaggaaaccaccttaacgttagaaagtttgggtatttacgacgtacgaacggacggacccgaacgggacccaaacgttaccgtacccggaaacgggtcccgtaccctttaaaatttttaacgttaaaccgggtttttaccggttaaaaccccgggggtaccttcccgggttacggggggttaccccctaacggaacctaacggttaacttaccggacggggtaccgggtaccgtaacgggggtttcgggttccggttacgggaccgttaaccgtttcgggtaaacctttttaccgaaccggtaaccttaacgggtaaactaaacgttaccgaacgggtaccgggtaacgggggttacgggaacgggtaccggttaagggtaagggggttaaccttttggggtttttaacggggttttttaacgttaccggtacgggtacttacgttaacgtaaccttaaaaccgttcccgtaaaccgttaccgttaccgggttacccgtttcccgtttaccggttaccgttttaccggggaacccggtaccggggtaaccgttaaagggtccggttaacgtacgtaaaccggtaacggtaacggttgtaccgggtactaccgaccgtctagttccg

SEQ ID NO: 211924 - DNA, 604 bp, Homo sapiens
  misc_feature: GYAE6OF01BZGPU.43.86.H09.1.454.CMB.1.raw
  modified_base (597)..(597): a, c, t, g, unknown or other
  misc_feature (597)..(597): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcagtctagtgaaagcctcgtacacgttgatggaaacacctacttgaattggattcagcaggacggccaggcccaatcctaccgaaacggccgtacccttaaagttttagtaacgggttttacctaaacccggggacttcgtacgggggtacccagtacagtattcaggcggcaggttgggtctggcacgtgtactttcacacgtagaactaatcagcgaggggtggacggtgtggaggtagtttgggtttagggttttacttacgtgtctatagactaacttcgactacgtcgtcccttcgttcttacgtttcggaccgtagggacccgtagggtcggagacgtacgaaacggtacgtggtacggtctaggcctacgtnttaccgg

SEQ ID NO: 211925 - DNA, 550 bp, Homo sapiens
  misc_feature: GYAE6OF01D4YOK.43.86.H09.1.454.CMB.1.raw
  modified_base (356)..(356): a, c, t, g, unknown or other
  misc_feature (356)..(356): n is a, c, g, or t
  modified_base (547)..(547): a, c, t, g, unknown or other
  misc_feature (547)..(547): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcacgccggcctccatctcctgcaggtctagtgaaagcctcgtacacgttgataggaaacacctacttgtattggattcagcagaggccaggccaatctcaaggcgactaatttataaggtttcaacgggtctcgtcggggtccagacagattcagcgnagtggtctggcactgattcacactgactaatcgagcgagggtggaggtcgtagaggtaagttggtttagggttttattacgtgactagtacgactaacttcacgtactcggtaccttcgttctacgtttggaccgtacgggaccgtaagggtcggaagtactcgaaacggtatggtgactacggctaacgntcg

SEQ ID NO: 211926 - DNA, 692 bp, Homo sapiens
  misc_feature: GYAE6OF01AJGJ8.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactcctccctgccccgtcacccgttgggcacgccgcctcatcctcctgctaggtctaggtacgaaacgcctcgtacacgttgaagtacggaaaccaccttacgtagaagttggacttcgagcaggacgacctaggcctaacgctacgaacggtccgtactttaaatttaagttaacggttaccgtaacccgggacgttcggtacgggtaccacggtacacgtatacaggcggactagggtcggtcgtcggctagttagtactttcacgtacgtagaacatcgtaaggcggtaggggtacggacgggtcgtaagggtaggttaggttttacgggttttaggttttactacgtggtaactaacgtacgtaacctaaaccttcgaacccgttacggttacccgttccgtttaccgttaccgttacgggtttaccggaacgggtaacccgggtaggtaacggtaggaacgtacgaaaccgtaaacgtagtacgggtacgtaccgtagtcctaaccgtgttacg

SEQ ID NO: 211927 - DNA, 761 bp, Homo sapiens
  misc_feature: GYAE6OF01BFRS2.43.86.H09.1.454.CMB.1.raw
  modified_base (167)..(167): a, c, t, g, unknown or other
  misc_feature (167)..(167): n is a, c, g, or t
  modified_base (525)..(525): a, c, t, g, unknown or other
  misc_feature (525)..(525): n is a, c, g, or t
  modified_base (733)..(733): a, c, t, g, unknown or other
  misc_feature (733)..(733): n is a, c, g, or t
  modified_base (755)..(755): a, c, t, g, unknown or other
  misc_feature (755)..(755): n is a, c, g, or t
tcagtgtgagtagtcacgaccggtgctcgatttagtgctatagacttgggtttggggactgatcaggactcctcagttcaccttctcacaatgaggctccctgctcagctcctgggctgctaatgctctcgggtcccaggagtccggtggggatgttgtgatgactnagtcctccactcctccctcgcccgtcaccgttggcacgccgcctccatcctcctgcgtaggttctagtacgaaacgtccctacggtactacgttggaagtacggaaacctaccgttacgttagtaagttggtaacttcaaggtcgaacggaggtcccgaacgggaccctaaaagtcccgttaaccgaaaccgggtaccgttaaccctttaaatttttaaacggttaaaacgggttttacccccggtaaaacccggggttaccgttaccgggtttaccgggggtaacccctaaggtaaaccgtaaacggttactttaacccggaaggtacccggtacggtaacgggttcggggttaccncgggtacctaaccgtttggtaaccgttttaccaacgttaaccgtacggaaccttaacgtaccgaacggtaccggtaggggtcgaaggttcgtaaggacggttaggtttggtttaacggttttattaccgtgtacgtaatcgtaataacttcacgtactccgtccgttacttagtacgttcgaccgtcgggaactaggtcgagacgtanaaaccgtgtgtcgactagaccngtctcg

SEQ ID NO: 211928 - DNA, 861 bp, Homo sapiens
  misc_feature: GYAE6OF01AE8RR.43.86.H09.1.454.CMB.1.raw
  modified_base (472)..(472): a, c, t, g, unknown or other
  misc_feature (472)..(472): n is a, c, g, or t
tcagtgtgagtagtcacgaccggtgctcgatttagtgctatagacttgggtttggggctgggagacgagcccagcactggaagtcgccggtgtttccattcggtgatcagcactgaacacgagaggactcaccagtgggtagtttgggctggagtcgtttcggggtttttccctcgtttagtcctttacgtttttaaggacgggttcgtccgtaaggttcggtccgtaagggttcgacgtaggtccggttggggtacgggtacgggttcgggtagggggggtaacgtaccgggttcgggtccgaacggtcccggttaaggggtaacccgttccccgtagaaccctaccgttcccgttccgtggtccgtaccgacgtcccgttcgttacggtaaccctttcctaaccctttaataaaagtttaaatttcggacggtcctaagtccggtccgttaaccgggttccgggaccccnccggtaggtcccttaccggggtgggaaccgggtaagggggtcggtaggggttacgggttgggggtaccgtacctttaaacggttataccgttactaccgttaggtaaggtaacggtaaagggtaaaggtaaacgtaaacggttacctacggaacgtaccggtaccggtaacgggtacggaacgtaccgttactaccgtaccgttacgtacccgtaacggtaaagtaaactacgtaaccgacggtccacttacctagtattaaccgtacgtacgaagtaacgacgtaccgtacgacgtaccacgacggaggacgacgttagtcgttttagtacttaggtggtacgtacggagggtacgtagggttggggtagtccgtacgttacccgggg

SEQ ID NO: 211929 - DNA, 678 bp, Homo sapiens
  misc_feature: GYAE6OF01BCQT6.43.86.H09.1.454.CMB.1.raw
  modified_base (223)..(223): a, c, t, g, unknown or other
  misc_feature (223)..(223): n is a, c, g, or t
  modified_base (413)..(413): a, c, t, g, unknown or other
  misc_feature (413)..(413): n is a, c, g, or t
  modified_base (465)..(465): a, c, t, g, unknown or other
  misc_feature (465)..(465): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctcgtgggtcccaggatccgggtggggatgttgtgatgactcagtcctccactcctccctgccccgtctacccgttggggccacgcccggcctccntctcctgctaggtctagtagaacgtcctcgtacgtacgttagatacggaaactaccttagttagtaagttggacttcgagacgaggacggaccgtacggaccaatcccgtaacgaacgggtcctactttaaagtttaacggttaacggtttaccgtaaccgggtacgttcggtacgggtacccagaaccngtacgtcgacggcggcgtacggttggtctcggctagtgtacttcactacgtnacgaatcgaggcggtaagggtggacggtcgtaggtaaggtggtttagggttttaggtttaactcgtagtactagttacgtaactaacgttcaacgttccgtacgttccgtttccggttacttacggtttacggaccggtaaccgggacgtagggtcgaagtaactaacggaaccgttacgtggtaccggtctaccgtacgtaccgtgttaccg

SEQ ID NO: 211930 - DNA, 772 bp, Homo sapiens
  misc_feature: GYAE6OF01BPXPD.43.86.H09.1.454.CMB.1.raw
  modified_base (544)..(544): a, c, t, g, unknown or other
  misc_feature (544)..(544): n is a, c, g, or t
tcagtgtgagtagtcacgaccggtgctcgatttagtgctatagacttgggtttggggactgatcaggactcctcagttcaccttctcacaatgaggctccctgctcagctccgtggggctgctaatgctcgtcgggtcccaggtacgtccgggtggggtattgttgtagatgactctagtcctcctactcctcccgtcgtccccgtcctacccgttggcacgcccggcctccacttcctccgtgcgtacgtactagtacgaacgtccgtacgtaacgtacgttagaacgtaacgaaacctacttagttagtaagttgtatcagcgacggcgaccgacgacctaactccgtaaccgacggtccgttaacctttaaagtttacggttaaccggttaccgtaaccggtcgttaccggtacggacccgaagtacgtagtcgtacgacggtccggtacgtacgggttcgggtctacggtaccttaacgttcgttaacctttaccgaaccgtacgtaagaacctaacgtcggaagggacgggtaacgggngggtaacgtcggtaagggttagggtttagtttttaggttttagggttttaactcggtacgtaacttacgtacgtaaaccttaacctcgtaccgtaccggtttccgttacccgtttccggttacgttaccgggtacgggaccgggtaacgggttaaaccgtagggtaaccgtaagtaaaccggtaacgtaaacgtgtcggtctaccgacgtaccctagttcgttacccg

SEQ ID NO: 211931 - DNA, 866 bp, Homo sapiens
  misc_feature: GYAE6OF01CBG0M.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctcgtgggtcccaggactccgggtggggatggttgtgatgactcagtctccactcctccctgcccgtctacccgttggcacggcccggcctccactcctcctgctaggtctagtacgaaacgtcctacgtacacgttagaacgtacggaaaacctaccgttacgttaggtaaagtttggtactttacgaaggtacgaacgggaccgggacccgacgggacccctaaacgttccccgtaccgaaacgggtcccgtaacccttttaaagtttttaacggttaaacgggttttacccgtaaacccggggtaccttccggttaccgggggttaccccaaggtaaccgtagttacttacgacgggaccggtacgtaacggggttcgggttaccgtacgggtaccctacgtttcggtacttttaccgaaccgtaacgttacggaaacctaacgtccgaacgggtacgggtaggggttacgggaacgggtcgtagggtacgggttagtttacggggtttttaggttttaacgttacgtcgtacgttaacgtacggtaacccttaaccttaccgtaaccgttaccggttaccggttacccgtttacccgtttaccgtttaaccgggttttaccgggacccgggtaaccggggtaaacccggtaggggttacgaaacgggtaacgttaacccggtaaaacggtaccggttcggtaccggtactaccggtacctaaccgtagtttcccgg

SEQ ID NO: 211932 - DNA, 666 bp, Homo sapiens
  misc_feature: GYAE6OF01AW84E.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctgggctgctaatgctctgggtcccaggatccggtggggatgttgtgatgactcagtctccactcctccctgcccgtcacccgttggggcacggcccggcctccactcctccgtgctaggtctagtgaaacgtcctcgtacacggttgatacggaaacctccttaacttagaattggattcgagcgaggacggccacggaccaatccgaccgaaggcctacctttaagtttacgtaacggttttaccgtaaccgggtcttccggtacgggtacccaaggtacgaagtacttcgacggtcggacgtaggtcgggtctgggacctacgttgtactttccgaactacgtacgaactagtaccgaggcggtaggggtagaggtcgtaggtagggtacgtttgggtttagttttaactcgttgtacgttacgtacgaaccttaacgtcgtacgtaacgttccggttaccttccggttacttaacggttcggacggtaacgggaccgtaaggtcgagtaacgtacgtaaacgtgttcgtacgtcacgactacgtgttaccg

SEQ ID NO: 211933 - DNA, 834 bp, Homo sapiens
  misc_feature: GYAE6OF01B5B6T.43.86.H09.1.454.CMB.1.raw
  modified_base (199)..(199): a, c, t, g, unknown or other
  misc_feature (199)..(199): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgcgtcccaggatccggtggggatgttgtgatgactcagtctccactcctcctcgcccgtcaccgtggcncggccgcctctactcctccgtgcgtacggtctagtacgaacgtccgtacgtacgtacgttagaacgtaacggaaacctaccttacgtagtaagttggtacttacgagcgaacggacggaccgacggtacctaacgttccgaacggaacgggtccgttaaccttttaaagttttaaacggttttaaccggtttaccggtaaacccgggtaccgttccgggtacccgggggtaccaacggtaacgtagtacgttacgacggtcggtacgtaggggttcgggtacgtacggaccttagttacgttaccttaccgaactacgtacgtaacctacgtaccgaggtacgggtaggggtacgggacggtcggtagggtaacggtttaggttttagggtttttacgggttttaacgttacggtggtaacgttagttaaccggtaaccttaaaccgttaccgtaaccgtaccggtttacccggttaccccgttttaccggttaccggtttacccgtttaccggggaccggggttaaaccggggtaaaccggttaacggggttaaggtaaccggtaaaccgttaaacccggtaaaaccgttacgggttcggtaccgggtacctaccgtacccgtaaccgttaccg

SEQ ID NO: 211934 - DNA, 810 bp, Homo sapiens
  misc_feature: GYAE6OF01CGSY6.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctccgtggggctgctaatgctcgtcggtcccaggatccggtgggattgttgtgatgactcagtctcctactctccctcgcccgtcaccgtggcacgccgcctcatctctgcgtaggtctagtacgaaacgtcctcgtaacgtacgtttagaacgttaacggaaaacctaccgttaacgtttagtaaagtttcggttattaccgaagcgaaggaccgacgacgacccgtaaactccgtaccgaacggtccgtaccttaaagtttacgtaacggttttccgaaccggtactcggtcggtacccgagaccgtagtacgttcgacggcggtacgttacgggtgggtacctcgggaccgttaccgtagttaacctttacgactaccgtaacgtacgtaaacgttccgacggtacggtaacgggggtaggtacgggtacgtaagggtacgggttaggttttacgggttttacgggtttttaacgttaacgttcgtaaccgttagtagtaacccttaaaccgttccgtaacgtaccggttcccgttacccgtttccggttttaccgttaccggttttaccgggacccggttaaccggggtaaaccgttaacggggttaacggtaacggttaaacgttaaaccggtaaaacccggttaacggttaacgggttccgggaacgttcggtaaaccctcgtacgttttacccgg

SEQ ID NO: 211935 - DNA, 782 bp, Homo sapiens
  misc_feature: GYAE6OF01D9R4A.43.86.H09.1.454.CMB.1.raw
  modified_base (226)..(226): a, c, t, g, unknown or other
  misc_feature (226)..(226): n is a, c, g, or t
  modified_base (360)..(360): a, c, t, g, unknown or other
  misc_feature (360)..(360): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagtcttgggttttcctcgttgcttcttttaaggaggtgtccagtgtcgaggtgcagctgggtggagtcggtaggggganacggtcggtccaggtccgtaggggaacttccccgtgacctaccttctccgtgtcgccacgtcccttcgtggtactttccaaccctttacaaattaactttagtggactagtcggctaaccggttcggggtcccnccggtacggcccttaccggtcgggacggaaggggtcgtaggggaggttggggtcgactaacgttatacgtctagtcgtaggagttaagggtaaacgtaaaggtaaaccttacgaacgacgtaacgtaccgttaccggtaacgggtaacgggtacccgtacgttaccgaacccgttaacgtacccgtaccggtaaacgggtaactaaacgtttaaccgaaacggtaccgtacctaccgttacgtacgttaacgtcgtaacgtaacctaacgtacgtaaaccgacgacccgtaacgtaccgtaaccgtaacgggacggtaaacggtaccgtacgttttaacgtttaacgttacgtacggtacggaccgtaaggtaaccgggtaacggttagggttacgggggtaccgttaccggttaaaccggg

SEQ ID NO: 211936 - DNA, 770 bp, Homo sapiens
  misc_feature: GYAE6OF01C7G4I.43.86.H09.1.454.CMB.1.raw
  modified_base (763)..(763): a, c, t, g, unknown or other
  misc_feature (763)..(763): n is a, c, g, or t
tcagtgtgagtagtcacgaccggtgctcgatttagtgctatagacttgggtttggggactgatcaggactcctcagttcaccttctcacaatgaggctcctgctcagctccgtggggctgctaatgctcgtcgggtcccaggtacgtccgggtggggattggttgtgtatgactcagttcctccacttcctccctcgcccgtcctaccgttggccacggcccgtcctaccacttcctccgtgacgtacggttctaacggtacggaaaccgtccgttacgtaacgtacggttagaacgtaacgaaacctaccgtttaagttaggtaagttacggtacttacgacgacgaacggacggccaacggtaacctaactcccgtaacggaacggtcccgtttaacctttaaagttttaccgttaaccgggtttaaccgtaaccgggttcgtaccgggttaccggggacccaaaggtactaagtacgtacgacggaccggtacgtagggttcgggtacctggtacctagttcgttaccttagaccgttacgacaacgtaacgtccgaacgggtagggtaacggggtacggtacggtacgggttaggtaacgggtttacggtttagggttttacggttttacgtacgtcggtacgttagaccgtaactaacgtccgtacgtaccgtccgttaccttcggtttactacggttacgcggtaaccggagtacggaggtacaaacgtcgtaaacgtgtacggtcgacgtcacgtntcgttcg

SEQ ID NO: 211937 - DNA, 791 bp, Homo sapiens
  misc_feature: GYAE6OF01EJ067.43.86.H09.1.454.CMB.1.raw
  modified_base (233)..(233): a, c, t, g, unknown or other
  misc_feature (233)..(233): n is a, c, g, or t
  modified_base (508)..(508): a, c, t, g, unknown or other
  misc_feature (508)..(508): n is a, c, g, or t
tcagtgtgagtagtcacgaccggtgctcgatttagtgctatagacttgggtttgggggactgatcaggactcctcagttcaccttctcacaatgaggcctccctgctcagctccgtggggctgctaatgctcgtggtcccaggactccgggtggggattgttgtgatgactcagtcctccactcctccctgcctcgtacctaccgttgggccacggcccgcctcctatcctcngcgtagtctagtagaacgtcctacgtactacgttgagtacgaaacctcttagttagtaagttgtacttcgagcgaggacggtaccgacggtaacctaacgtcccgtaaccgacgggttaccttaacctttaaagttttaacggtttaaaccgggttttaccggtaaacccgggtccgttaccgggtaccgggtacccaagaacgtacgttacgtacgaggcggacgttagggttaccgtgacgaccgttatcgttaactttcgaacgtacgttanaacctagacgtacggacgggtaggggtaggtacggtacggtagggtaacgggttggttttaggttttagggttttaactacgtacgtctttaacggaacttaacccttaacgttaccgaaccgttccggttcccgggtacccttttccggttaaccgtttaacccgggtttccgggaaaccggggttaaccggggttaacgtaaacggggttagaaaaccggtaacgttaaacccgaaccggtttaagttccgggtgtacccctagtaacccggtacttaccg

SEQ ID NO: 211938 - DNA, 858 bp, Homo sapiens
  misc_feature: GYAE6OF01DZIYV.43.86.H09.1.454.CMB.1.raw
tcagtgtgagtagtcacgaccggtgctcgatttagtgctatagacttgggtttgggactgatcaggactcctcagttcaccttctcacaatgaggctccctgctcagctcctggggctgctaatgctcgtgggtcccaggatccgggtggggattgttgtgatgacctcagtacctccactcctcccctgcccgtcacccgttgggcacgcccggcctccatcctccgtgccaggtctagtagaaacgcctcgtacacgttgaagtacggaaactaccctagttagaagttggtacttccgagcaggacggaccaggaccaactcctacgaacggtccgtaaccgtttaaagttttaacgtaacgggttttaccgtaaacccggggtacttaccggtaccggggtacccaaggaaccgtacgtacgttcgaacgggcccggtagtacgggttcgggttcctcgggtacctaaccgttggtttaaccttttacaaaccccgtagttaaccgtaaaccgtaaacgttaccgaacggtaccggggtaaaggggtagggtaacgggtacggtacggggtaagggtttaaaggtttttgggtttttaagggtttttttaaccgttacggtttacggttactaacgttacggtaaacccgtttaaacttacccgtaaccgttacccgtttaccgggttaccccgttttacccgtttaccggttaacccggtttttaccgggaacccgggtaaccgggggtaaaccgtaacggggttaacggtaacggtaaccggttaaacggaaaaaccgttacggttacggtacgggttaccctacggttaaccctacccgttacgtttcccg

SEQ ID NO: 211939 - DNA, 798 bp, Homo sapiens
  misc_feature: GYAE6OF01CKEL8.43.86.H09.1.454.CMB.1.raw
tcagtgtgagtagtcacgaccggtgctcgatttagtgctatagacttggggtttggggactgatcaggactcctcagttcaccttctcacaatgaggctccctgctcagctccgtggggctgctaatgctcgtcgggtcccaggacgtccgggtggggattggttgtgatgactcacgtcctccaccgttcctcccctccggtcccgtacctacccggttgggaccacggcccggtccctaccgtacttcctccgtgcgtaggttctagtacgaacgtcctacgtaactcggtacgagtaccggtaaacctacttacgttagtaagttggtactcagacgaggacggaccgacggacaacgtccgaccggaacggtccttaacctttaaagtttaacgttacggtttaaccgtaccgggtacttcgggtaccggtaccaagacgtagtactcgacgggtcggagtacggtcggtacgtacgcttaacgtcggttaacttccgaacgtactacgtaactagtccgaacgggcggtaaacggggtggaacgtacgggttaggacgggttttacggtttaagggtttttacggtttaacttaaccgtgtaacgttaacgtacgttaaacccgttaccgttaccgaccgtttaccggtccgttttcccgttaaccggtttgttacccggggttaacgggaacccgggtacggggtaaacgttaaggggttaaccgaagtaaacggttaaccggaaaccgttgggttcggtaaccgtcctacggaacccttaacgtcgttccg

SEQ ID NO: 211940 - DNA, 745 bp, Homo sapiens
  misc_feature: GYAE6OF01BJQ1W.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctccgtggggctgctaatgctctgggtcccaggatccgggtggggatgttgtagatgactcagtctccactcctccctcgtcccgttaccgtggcacgccggcctccatctcctgcaggtctagtagaacgtcctacgtacacggttgacgtacggaaacctccttaacgttgtaagttcggtattcgagacgaggacggaccgaggacctatccgtaccgaacggtaccgtaccgtttaagtttaagtacggttttaaccgaaaccgggtcctacgtccgggtaaccctagaaccgagtacgtccgaggtaccggtacgtacgggttcggttccggacgtacctacggttacgttaacgttacccgaaccgtactacgaacctacgtccggtacgggaggttacgggggaggtacggcgttaagggaacggtttggtttacggtttttagggttttaaacttcgtcggtaacttacgtaacgtaccgtaaccttacgaaccttccgggttaccgttcccctttacgttaccttaccggtttacggaccgggtaggaaacccgtgggggtaacgacgtaacgtaaacggtaaaggccgttcggtaggtaccctagaccctacgttccgttagttccg

SEQ ID NO: 211941 - DNA, 842 bp, Homo sapiens
  misc_feature: GYAE6OF01BY0DK.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctcgtcgggtcccaggatccgggtggggattgttgtgatgactcagtcctccacttcctccctgccccgtccacccgttgggcacgcccggcctccatcctccgtgcgtaggtctagtagaacgcctacgtacacgttgataacggaaacctaccttacgttagaactttggtacttcgagacgaggtaccggaccacggacctaacgtcccgtaaccgaaacgggtcccttaaccgtttaaaattttaacggtaaaccgggttttacccgtaaacccggggtacctttccgggtaccggggttaaccccagggtaaccaagttacgttccgagggtccggtaacgtcggggttacgggtctacggggaccttaaccgtgttaacctttaccgaaacttccgtacgaaacctaagtccgaacggtacggttacggggtagggtaccggtacgggttagggtaagggtttacgtttttaggggttttaccgggttttttaattacccggtacggtttacgtaacgtttaccaacggttttaaaccctaccgtaaccgttcccggtttaccggtacccctttaccggttacgttttaacggttccccggggaacgggtaacccggggtaaaccggttaagggtacgggttaagtaaacccgtaaacggtaaaccggtaacgttcggtacggcccgttacgtaccctacgtctttccgg

SEQ ID NO: 211942 - DNA, 767 bp, Homo sapiens
  misc_feature: GYAE6OF01B8LIZ.43.86.H09.1.454.CMB.1.raw
tcagtgtgagtagtcacgaccggtgctcgatttagtgctatagacttgggtttggggactgatcaggactcctcagttcaccttctcacaatgagctccctgctcagctccgtggggctgctaatgctctgccgtcccaggatccgggtgggggattgttgtgatgactcagtcctccactcctccctcgcccgtcacccgttgggaccacgcccggcctccactcctccgtgcgtaggtctaggtcgaaacgtcctacgtacgtacgttagacgtacggaaacctaccttacgtttagaacgtttgtacttcgagacgaggacggccgaacggcctaatccgaccgtaacggcctaactttaaattttaacggttaacggttttacccggaaccgggtaccgttcgggtaccgggtacccaagtaacgtagtacttcggacgcggtacgtacgggttcggtacgtcggtactacgtacgtactttcgaactacgtacgaactaacgtcgacggtacgggtagggtcgggaagtcggtagtacgggtttaggtttacgggttttacggttttaactttacggagttaacgtcgtaaccggtaacctttaaacgtccctaccggttacgtttccccggttaccgtttacccgtttaccgttacgggtttaccggaccgggtaaccgggtacggtaacgggtacggaaacggttacaacgggtaaacccgttaggtccggttacggacgtaccgtacctacccgttacg

SEQ ID NO: 211943 - DNA, 896 bp, Homo sapiens
  misc_feature: GYAE6OF01C7GBN.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctcgtcgggtcccaggatccgggtggggattgttgtgatgactcagtcctccactcctccctcgcccgtccacccgttggcacgcccggcctccactcctccgtgcgtaggtctagtacgaacgtcctacgtacacgttgaagtaacggaaacctaccttaacgttagtaattggtaacttacgagtacgaaggacgggacccaacgggaccctaaacgttccgtacccgaaacgggtccctaaccgtttaaagtttttaacggttaaacggttttacccgtaaacccggggtaaccgtttccggtaccgggggtaccccaaggtaacctaacggttacgtttaccgggacggtacccgggtacgtacgggtttcggggtcgttaccgggtaccgttacggttacggtactttttacccgaaaccgttaccgttaacgtaaccctaaacgttaccgggacggtacccggggtaagggggttacgggtaacggggtaccggttaggggtaacgggtttaggttttacggggtttttaagggtttttaacgttacgttacggtacttacgttaacgtaaaccttaaccgttaccgtaaccgtacccggtttaccggttacccgtttacccggtttaccgttaccggttttacccgggaccggggtaaaccggggtaccgttaaggggtacggaacggttaacgtaaacccggttaaaacggtacgttccgggttaacggtccggttagaacccgtacgttaccgtttaccgg

SEQ ID NO: 211944 - DNA, 645 bp, Homo sapiens
  misc_feature: GYAE6OF01BAH6R.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtagaaacgcctacgtacacgttgaatggaaaccaccttacttgaagttggattcgagcaggaggccaggccaatccgtaccgaacggccgtaccttaaagttttacgtaacgggttttaccgtaaccggggtacttcggtacggggtacccaggacagtacttcgaggcggtctagggtgggtctagggctacgttgtactttacgactactacgacaactcgaaggcgaggggtgggacgtacgtaggtaggtagtttggtttagggttttacgttacgtgactagtacgtacgtaacttacgacgtacgtcggtcccttaccgttctacggtttcggaccggtacggggtaaccgtaagggtacggagtaacgtacgaaaccggtacgtcggtcgacgtgacctaccgtgttaccg

SEQ ID NO: 211945 - DNA, 733 bp, Homo sapiens
  misc_feature: GYAE6OF01EFNRV.43.86.H09.1.454.CMB.1.raw
  modified_base (147)..(147): a, c, t, g, unknown or other
  misc_feature (147)..(147): n is a, c, g, or t
  modified_base (218)..(218): a, c, t, g, unknown or other
  misc_feature (218)..(218): n is a, c, g, or t
  modified_base (443)..(443): a, c, t, g, unknown or other
  misc_feature (443)..(443): n is a, c, g, or t
  modified_base (700)..(700): a, c, t, g, unknown or other
  misc_feature (700)..(700): n is a, c, g, or t
tcagtgtgagtagtcacgaccggtgctcgatttagtgctatagactttgggtttggggactgatcaggactcctcagtttcaccttctcacaatgaggcctccctgctcagcctccgtgggctgctaatgctcgtcgggtcccaggntccgggtgggattgttgtgatgactcgagtcctcctaccttcctcccgtcgcccgtcctacccgttgggcncgcccgcctcacgtcctcgtgcgacggttctagtacgaaaccgtcctacgtactacgttagaagtacggtaaaccctaccttaagttagtaagtttcggacttacgagacggaagacggaccacggacctaacgtcccgtaaccgaacggccttaaccgttttaaagttttaacgtaacgttttaccgtaaccggtcttacggtccgggaccagactagtctcgngtcgactggtcgtacgtgaccgtatcgtactttcgaacgtagtacgaacgtactaccgagtcgggtaaggggtcgtagggtacgttaggaggtttacggtttggtttttacggtttacttacggtagtacgtagtaacctaaccttaaccgttaccgtacgttccgttaccgttcccgttaccgtttaccgtttacggttacgggtacccgacgggtaaccgtaaggtacgtaacgtacgttaccgaaacggttacncgggttacgacgtacgtacgtccgttgttaccg

SEQ ID NO: 211946 - DNA, 756 bp, Homo sapiens
  misc_feature: GYAE6OF01AJKAI.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaacgcctcgtacacgttgagtaggaaacaccttactagtaattggattcagcagacggccacggaccaatccgtaccaaggccgtaccttaaattttaacgttaacggttttaccgtaaacccggggtaccttccggtcggggtacccaaggtacaacgtattccgaggttcggacgtaggtcgggtctacggacctacgttacgtactttacaaccgtacgtacggtaactaacgtacgaacggtacggtaaggggtagggaacgggtccgtaaggtaacgggttaggtttagggttttagggtttttaacttacgttacggtattaacgttcggtaaacctaaaccgtttaccgaacgttaaccgttccggttaccctttacccggtttaccttaccgggttttaccggacccgggtaaacggggtaaccggtaacggggttaacggaccggttaacgtaaccggtaaaaccggttacgtacggggttacgaccgttacggaccctaaccgtacgtttacccgg

SEQ ID NO: 211947 - DNA, 869 bp, Homo sapiens
  misc_feature: GYAE6OF01EJ9KC.43.86.H09.1.454.CMB.1.raw
  modified_base (238)..(238): a, c, t, g, unknown or other
  misc_feature (238)..(238): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggacgtccgggtggggattgttgtgatgactcacgtcctccacctctccccgttcgcccgttccacccgttgggccacggcccgtccctccattccgtcnggactacggtccttaaggccccgttaacgtaaccgtaccgtacgttacgtacgttaaggaaactaaccgttaactaaccttcgtaagttacgttaggtacgacaggaccgacggaccgaaacgtacgaccctaacggtaccaagttttaaccgtaacggtttcccttttaaaacgggttaaccggtttaaccttaccgggggttaccccggtacggaaaccgtacgggtaacctacgtaacggtaacggtacggtacggtacgggtacggtccggttcggtaaccggtttacgacgttactaacggttacttacgtaaccgtaactacgtaacgacacgggtacgggtacggtacgggtaggttacgggtcggaaaaggttttgggtttaacggtttaagttttacggttaccggtttaagtactacgtaaccgtacgttaacctaaccgttaacgtttacccgtaccttaacccggtttcggtttaccgtttacccggttaaccgggttaccggttaccggggtaaaccggtaaaccggggtacgtacggtaaacgggtaccgtaacgggttaccggaaccgttacgtacccggaacgttacccttacgttaccgtaacccgtttaaccg

SEQ ID NO: 211948 - DNA, 803 bp, Homo sapiens
  misc_feature: GYAE6OF01EGZFA.43.86.H09.1.454.CMB.1.raw
  modified_base (170)..(170): a, c, t, g, unknown or other
  misc_feature (170)..(170): n is a, c, g, or t
  modified_base (222)..(222): a, c, t, g, unknown or other
  misc_feature (222)..(222): n is a, c, g, or t
tcagtgtgagtagtcacgaccggtgctcgatttagtgctatagacttgggtttggggactgatcaggactcctcagtttcaccttctcacaatgaggctccctgctcagctcctggggctgctaatgctctgccgtcccaggatccgggtggggattgttgtgatgactnatcctccactcctcctcgcccgtcacccgttggcacgcccgcctcatctccngacaggtctagtagaacgtccttacgtactacggtttagaacgtaacggaaaccttaccttacgttagtaagtttgggacttacagcgaagggaccgacccgaaggaccctaaacggttcctaccgaaggtcccgttaacctttaaacgttttaacggttaacggtttacccggtaaccgggtaccttaccggggttaccgggtaccccaagaacgtagttacttcggacggtacgggcgtacgggttggtccgtcgggtaccctaagtttcgttaactttcccgaaacgtaccgtacgaaacctaacgtacgaaccggggcgggttaagggggtacggtacgggtacggtaagggttaacgggtttaggtttttacgggttttttaaggtttttaacgtacgtttaggactacgtttacgtaaacccttaaaccgtcgtaccgttaaccgtcccggtttacccgttccgtttcggttaaccggtttccgggaccgggtaaacgggtaaccgtacggggttagaaacggttgaaacccggaacggttaggttcggacgtaccgtaacggcctaacgtttcg

SEQ ID NO: 211949 - DNA, 671 bp, Homo sapiens
  misc_feature: GYAE6OF01EI4ZJ.43.86.H09.1.454.CMB.1.raw
  modified_base (143)..(143): a, c, t, g, unknown or other
  misc_feature (143)..(143): n is a, c, g, or t
  modified_base (151)..(151): a, c, t, g, unknown or other
  misc_feature (151)..(151): n is a, c, g, or t
  modified_base (519)..(519): a, c, t, g, unknown or other
  misc_feature (519)..(519): n is a, c, g, or t
tcagtgtgagtagtcacgaccggtgctcgatttagtgctatagacttgggtttgggggactgatcaggactcctcagttcaccttctcacaatgaggctccctgctcagtctccgtgggctgctaatgctcgtgggtccaggngtccgggngggatgttgtgactgtactcagtctccactcctcctgacccgtctaccgtggccagtccggacctcattcgcctgactaggtcttaagaggaaactcctacgtaactacgttgaacgtaacggaaacctaccgtaacgttagtaacgttaggtaacctgaacgacgaaggacggaccgaacgtacctaaagtccgtaaccgaaggtccttaaccttaaagtttacgttaaccggtttacgaacccgggttactccgttacggggacccaagtacctaggtaattcgacggtacgcgtaggttcggctaggacctagtgtaacgttcaagacgtacgtaacagtacgaggacggtaggggtgaacggtntaagggtagttacggttgttttacggtttaattcgagacttcgaagaaccgttaaactccgaacgtacgtcgtaccttaccgtacgtcgttacggacgtaggaccgtaaggtgaagttaacaacgaagtacgtgtacgcttagctactgttc

SEQ ID NO: 211950 - DNA, 861 bp, Homo sapiens
  misc_feature: GYAE6OF01CTK47.43.86.H09.1.454.CMB.1.raw
  modified_base (489)..(489): a, c, t, g, unknown or other
  misc_feature (489)..(489): n is a, c, g, or t
  modified_base (847)..(847): a, c, t, g, unknown or other
  misc_feature (847)..(847): n is a, c, g, or t
tcagtgtgagtagtcacgaccggtgctcgatttagtgctatagacgttgggtttgggggactgatcaggactcctcagttcaccttctcacaagtgagcctccctgctcagctccgtggggctgctaatgcctcgtcgggtcccaggagtccgggtggggtattgttgaggatgactcacgtcctcctacctcctcccgtcggcccgtccgtacccgttggggcacgggccccggcctaccctattccgttaccgtgtacgtacgggttctaacggtacggaaaccgtcccgttacggtaaccgtcggtttaggaaacgtaaccggtaaaacccttaccgtttaacgttacggtaagtttcggtacttcgaagtcgaacggacggaccccgaaggtacccctaacgtccgtaccgaacggtccgtaacccgtttaagttttaacgttaacgggtttacccgtaacccgggtacgtcggtccgggaaccngaacgtacgtacgtcggacgccggagtacggtcgggtcgtgctacgttcgtactttacgaactaccgtagaacctaacgttccgagggcggtagggtacgggagttggtacggtaacgggttagttttacggggttttaaggtttttacgttaccttaacgggtaacgtaacgtttacgaacctttaaaccgttaccgtaaccgttaccgttaccgggttacccttttaccccgggttactttaacgggtttaccccggggaacggttaaaccggggtaaccgggttaagggaccgggtaaagttaaacggtaacccgtaaacggtaggtttccggaacggtacctggtaacccccgnttccgtttaaccgg

SEQ ID NO: 211951 - DNA, 689 bp, Homo sapiens
  misc_feature: GYAE6OF01A58AF.43.86.H09.1.454.CMB.1.raw
  modified_base (141)..(141): a, c, t, g, unknown or other
  misc_feature (141)..(141): n is a, c, g, or t
  modified_base (157)..(157): a, c, t, g, unknown or other
  misc_feature (157)..(157): n is a, c, g, or t
  modified_base (159)..(159): a, c, t, g, unknown or other
  misc_feature (159)..(159): n is a, c, g, or t
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (402)..(402): a, c, t, g, unknown or other
  misc_feature (402)..(402): n is a, c, g, or t
tcagtgtgagtagtcacgaccggtgctcgatttagtgctatagacttgggtttggggactgatcaggactcctcagttcaccttctcacaatgaggctcctgctcagctcctggggctgctaatgctcgtgggtcccaggntcgggtgggatgttgngntgactcagtcctcctactcctccctcgcccgtcaccgttggcncgccgcctctactctcgngcgtaggtctagtacgaacgtccgtacgtacgtaccgtagacgtaacggaaaccctaccttagtagtaacgttgtacttcgagtcgacggacggaccgacgacctaactccgtaccggaaggtccgtaacttaaagtttaacgttacggttaaccgaaccggtcgtcgggtacggcgaagtnacggtactcggagtcggagtcgggtggtactcggactacgttgtaccttacactacgtacgaacctagtacgacgggtcggtaaggggtaggtacggtcggtagggtaacggttaggttttacgggttttacggttttactacgtcggttacacgttacgaaccttaaaccgtccaacgttccggtccttccggttccttaccggtgttaccgggacgacggtacggtaggtgtaacaccggttaaagaaacggtccgttagggacgcttacggaccttagtgttcg

SEQ ID NO: 211952 - DNA, 585 bp, Homo sapiens
  misc_feature: GYAE6OF01CVXF9.43.86.H09.1.454.CMB.1.raw
  modified_base (272)..(273): a, c, t, g, unknown or other
  misc_feature (272)..(273): n is a, c, g, or t
  modified_base (566)..(566): a, c, t, g, unknown or other
  misc_feature (566)..(566): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttggcagccggcctcatctcctgcaggtctagtgaaagcctacgtacacgttgataggaacactactgaattgattcannagaggccaggccaatctcaaggcgacctaatttataaggtttactaaccgggtactcgtcggggtcccagacagtacttcgagcggacgagttgggcttggctagtcgtatttcgaacacgtacgtaacaatacaaggacgaggggtaggacggactgggagtagtgttttacgggttttattacgtgctatcgaactaacgttacactactcggtaccgtccgttcgtaacgtttcggaccgtagggaccgaacgggtggaagtagtaccaaaacggtactaggtacggtancggacctaccgtattaccg

SEQ ID NO: 211953 - DNA, 899 bp, Homo sapiens
  misc_feature: GYAE6OF01D9FBW.43.86.H09.1.454.CMB.1.raw
  modified_base (174)..(174): a, c, t, g, unknown or other
  misc_feature (174)..(174): n is a, c, g, or t
tcagtgtgagtagtcacgaccggtgctcgatttagtgctatagacttgggtttggggactgatcaggactcctcagttcaccttctcacaatgagcctcctgctcagcctccgtgggctgactaagtgtccttcggtcgggtcccgaggtccgtcggggtagggtattgtttgngatcgtactctactcctaccctcttcccgtcccgtccgtcccgtaccctccggttcggaccgtaccggcccccgtcctcctacgtcccttacgacgtcgtacgttagtaacgtaacggtaaccctccgttacgtacgtacgtagaaccggtaactaaccccgttaacttagttaagttacggtagttacctagacgacggtaacggaccgtaaccgtaccggtaacctaacgttacccggaccggaaccggttaccttaacgttttaaaggtttaaccgtttaacggttacccggtaaccggtacgtacccggggttaaccggacaggaaacgtgtaccgtaggacgttcggacgtcgggtacggtcgacgtaccgtattcgtagttaaccacgttaacacggtactacgagggagtacgggtaagggtacggagtacgggtaggttaggttaggtttttacggttttacggtttacgtacgtagttaacggttacctaagtaaccgttaacctcggtaaccgtttcccgtttaccggttacccgtttaccgttaacccgggtttacgggtaaccccgggtaaaggcccccggggggtttaaaaaggtttaaccgaacggggtttaaaaccgtaaaaccggttaaacgtaaaacgggtacggtttacgggtaaacccccttacgggtaaacccccttacgtttaacccggttccgggttttaccc

SEQ ID NO: 211954 - DNA, 930 bp, Homo sapiens
  misc_feature: GYAE6OF01CYGMJ.43.86.H09.1.454.CMB.1.raw
  modified_base (248)..(248): a, c, t, g, unknown or other
  misc_feature (248)..(248): n is a, c, g, or t
  modified_base (829)..(829): a, c, t, g, unknown or other
  misc_feature (829)..(829): n is a, c, g, or t
tcagtgtgagtagtcacgaccggtgctcgatttagtgctatagacttgggtttgggggactgatcaggactcctcagttcaccttctcacaatgaggctccctgctcagctccgtgggctgctaatgctcgtacgggtcccaaggtacgtccgggtgggattggtgtagatcgtactcgagtcctaccacgtccctccgtacggccccgttcacccgttggacctacggcccgtcctactcgtctccngaccgtagtctaaggacgtaacgtcctacgtacctaggttacgaagtaaccggaaacctaccgttagtaggttaaacgttggacttacgaagacgaacggtacggacctaacggacccgtaagtccctaacggaacggttccgtaaacctttaaagttttaacgtaaccgggttaaccgtaaccgggtacttcccgggtacgggttacccaaggttaacctacggtacgttacccgaggtaccggtacggttaacgggttcggtccggttaactaccgggttaaacttaccggttaaacgtttaaccggaaacccgtttaacggtaaccgtaaacccggtaacggtttaccccggaaaaggggtcccggggttaaagggggtcccgttaaacgggtaccggttagggttaaaccgggtttaggttttaccgggttttaaacgggtttaaactccggtagtaccgttaaccgtacgtaaacccgtttaaccttaacgaccgggttcgggttaccttaccccgtttaacggtcgtttaaccgggtaccgggaaaaccggggttaccgtaacgggttaaacggnggttaaccccgttaaacggtaaaaaccgggttacccggtaagtttcggggtttaaccgtaccccttaaggggacccttaaacgggttccgtttaacccggg

SEQ ID NO: 211955 - DNA, 926 bp, Homo sapiens
  misc_feature: GYAE6OF01CEZ0P.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctccgtggggctgactaatgctcgtcgggtcccagggacgtccgggtggggattggttgtgtatgactcagttcctccctactcctcccgtcgtccccgtccgtacccgttcggggccaccggcccgaccctcctacttcctccgtgaccgtacggttacgtaacggtacggaaaaccgtcccttacggtaaccgtacggtttacgaacgtaacggtaaaaacccttaaccgtttaaccgtttaggtaaacgttcgggtaacttacaagggccgaagggaaccggtacccgtaacggaccctaacgttcccggtaaccgtaacgggtccgttaaccttttaaacgttttaacgttaacgggttttaacccggtaaacccggggtaccgttaccggtaccgggggtaaccctaagtaaccgtacgtaccgttaccggaacgggtccggtaaccggtggggtccgggttcgtacggggtaccttaaccgttcggttaactttacccgaactaaccgtacgtaaccgtaacgtaccgtacggacgggtacggggtagggtcgggtacggtacgggttaagggttaggttttagggttttaacgggttttacgttacgttcggttaacgtaacgttaacgtaacgttaaaccgttacgacccggtttaaccgtccgttcccggtttaccggtttacccgttaacgggtttccgggaaccgggttaccggggtaaacggtaacggggtacggttaacgtaaccggttaaccgggtaaacgtacggttacggtcgtacgtaccgtacgtaccgtgtttacccgg

SEQ ID NO: 211956 - DNA, 854 bp, Homo sapiens
  misc_feature: GYAE6OF01AZBVI.43.86.H09.1.454.CMB.1.raw
tcagtgtgagtagtcacgaccggtgctcgatttagtgctatagactttgggtttggggactgatcaggactcctcagttcaccttctcacaatgaggcctccctgctcagctccgtggggctgctaatgctcgtcggtcccaggtcgtccgggtgggtattggttgtgatgacctcgtacgttccctccctaccttcctccccgtccgtccccgttacccgtacccggttcggggacccgtccggcccccggtccccttccctacgttccccgttcccgtcggtaaccggttacggttaacgtaaggttaacggtaaacccgttcccgttaacggttaaccgttacggttaggtaaaccgttaacggaaaacccttaccgtttacgttaggtaagttaggtactacgaggacgacggaccgaccggtaacgacctaacgtacccgacggacgtaccttaactttaagttaggttaaccgttacgtacggtactcggtaccggaccaggactagtacgtcgtacgggcgtacggtacgggttcggtactcggacgttacgttacgttactacctaacgtaccgtagtaaactaccggacggtaggggtacggggtagggttaacggaccgggttagggttaacgggtaggttttacggtttttacgggtttttaagggtaacttcccggagttaactagtaaccccgtttaaccaacgttacccggacgtttcccggttaccgttcccgtttacgttaacgttccggtacgggaacccggtaggtacgggtagtaacgaaccgtaactaaaggccttaggcccggttaacctcgtaacccttcccggttagtccg

SEQ ID NO: 211957 - DNA, 951 bp, Homo sapiens
  misc_feature: GYAE6OF01BCWEH.43.86.H09.1.454.CMB.1.raw
tcagtgtgagtagtcacgaccggtgctcgatttagtgctatagacttgggtttggggctgggagacgagcccagcactggaagtcgccggtgtttccattcggtgatcagcactgaacacagaggactccaccatgggagtttgggctgagtcttggggttttcctcggttgcttctttttaaggaggtgtccaggttgtacgagggtgctagtcgtgggtagggtacgttcgggtaggggggactacggttcgggtcccaaggtcccgttagggggaacgttccccgtaggtaacctaccttcccgttccgttggtcgtccgtacgtcccttcgtcgggtaacctttccggtaaccctttacaaatttaaacgtttagtacgggtacctatacggccgtaaccggttccggggttaccccgccgtaacggggtccctaccgggtcgggtaccggtaaacggggggtccggttaggggtaaggggtttcgggggtacgggtacccggttaacctttaagttaccgtaccgttacggtttccgtagggtaaggtaacgggtaaagttaaacggtaaacgtaccgtaaccgggtaccaacggtacccgttacccgggtaacgggtaacgggtacccgtaacgtttacccgaacccttaacgttccccgttaaccggaaccggggtaaccttaaacgtaccggtaacgtaccgtaccgtacttaccgtacgttaacttacggtagtaacccgtaaaggtaccgaaaccgtaccggttaccgtaaccggtaacccgtacggtaacgggaacgggtaaccggtaaccggtttaacgttttaaccgtttttacggttaaccgtttcgggaccggtaaagggaaacgggttaccggtaacggggtttaggggggttaaccgggggtaaccggtttaacccgggtttaaaccccggggg

SEQ ID NO: 211958 - DNA, 912 bp, Homo sapiens
  misc_feature: GYAE6OF01BW2SF.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggagtccgggtggggatgttgtgatgactcacgtcctccaccttcctccctcgtccccgtcctaccccgttggggccgacggcccggcccctccctacttcctccgttcgcgtaggttctaaggtacgaaacgtccctacgtaccgtacgttgaacgtacggtaaacctaccgttacttagtaacgtttaggttacttacgagaccgaacggaccggtacccgacggacccgtaaccgttccgtaacccgtaacgggtacccggttaaccgttttaaaagttttttaacgggtttaaaaccgggtttttacccgggttaaacccggggtaccgtttaccccggggttcgggggttaacccccaagtaacccgtaaggtacgtttaccgaagggtccggtaccggttacggggtttccggggtaccgttcggggaaccctttacggtcgtttaaaccgtttccgaaccttaaccgttacggaaaccttaaacgttcggtaacgggacgggttaagggggtaggggtaaccgggttcggtaagggttaggggtttacggtttttagggtttttacggttttttacgttacgttacgttacgttacgttacgtaaccttaaaccgttccgaacgtttaccggttaccgttccccgtttaccgtttacgtttaccccggttttcgggacccgggtaacgggtaccgggttaaggacgggtaactaacggtaaccgaaaccggttagtacggtcgaccgtacgccgtaccgtgttcccg

SEQ ID NO: 211959 - DNA, 688 bp, Homo sapiens
  misc_feature: GYAE6OF01EB2ZL.43.86.H09.1.454.CMB.1.raw
  modified_base (663)..(663): a, c, t, g, unknown or other
  misc_feature (663)..(663): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctcgtgggtcccaggagtccggtgggatgttgtgatgactcagtctccactcctccctgcccgtcacccgttggcacggcccgcctccatcctcctgacaggtctagtgaaacgcctacgtacacgttgatacggaaacctaccttacgttagaagttggattacgagcgaaggacggcccgaggaccctaaacgttcccgtaacccggaaacgggtccgtaacctttaaagtttttaacggtttaacggttttaccgtaaaccggggtaccttcggttaccggggttaccccaaggtaaccagtacgttccgaaggccggacgtacgggttcgggtactcgggtactaacgtttcgtactttccgaacctacgttacgaactaacgtacgaggtacggtagggtcggaggtcgtaggagggttagtttggttttagggttttatcgtgatagtcgaacctaactcgacgtcgtcgtccttcgttctacggttcggacggacgggtaacgtagggtacgagtaactacgaacgtgngttcgactggaccaccgtgttaccg

SEQ ID NO: 211960 - DNA, 891 bp, Homo sapiens
  misc_feature: GYAE6OF01C9WK3.43.86.H09.1.454.CMB.1.raw
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
  modified_base (267)..(267): a, c, t, g, unknown or other
  misc_feature (267)..(267): n is a, c, g, or t
  modified_base (394)..(394): a, c, t, g, unknown or other
  misc_feature (394)..(394): n is a, c, g, or t
  modified_base (449)..(449): a, c, t, g, unknown or other
  misc_feature (449)..(449): n is a, c, g, or t
tcagtgtgagtagtcacgaccggtgctcgatttagtgctatagactttgggtttggggctgggagacgagcccagcactggaagtcgccggttgtttccattcggtgatcagcactgaaccacgaggacggactcacgagtgggtaggtttcgggctggacggtcgttcggggttttttccctggtttcgtacctttacgttttaaaggnggttcgtaccgaggttgtcgagggttnccgaggtcgttgggtcgggacggttcgggnggggggtaacgtacgttcgggttaccgacggtcccgggtaggggtaacctacccgtgaacctccttccgtccgtgttccggacctacggtcccttcgtacggtaaccttttccctaaccgtttaaanaaagttttagttagcgggactaacgttcggtaccgtaaccggttcggggaccccncggtaacggtcccgtccgggtagggaaccgggacggggttgtgggggtacggttcggggtcgtaacttaacgttactttacgacgttatcggtaaggtaaggtaaaggtaaagttaacgaaacgtttcgaacggaactaccggtacggttacgggacggtaaaccgggtccttacgtaccgaaccgttcgtaccgaacgggtaaacggtaacccttaacggtaagaacccggtaccgtcccgtaacttttcgtaacggtacctagtaacggtaaaccgtaaggtaccgtaaacgccgtaaaccggttccgaacccgacggttaaggggaaaccggtccggttaaactttcgttttaaaaccgttgtttagggacgtacggtaaggtacccggggaagttaacggggtttagggggtaggtaccgtcccggtttaaaccgggg

SEQ ID NO: 211961 - DNA, 707 bp, Homo sapiens
  misc_feature: GYAE6OF01EIH90.43.86.H09.1.454.CMB.1.raw
  modified_base (153)..(153): a, c, t, g, unknown or other
  misc_feature (153)..(153): n is a, c, g, or t
  modified_base (167)..(167): a, c, t, g, unknown or other
  misc_feature (167)..(167): n is a, c, g, or t
  modified_base (183)..(183): a, c, t, g, unknown or other
  misc_feature (183)..(183): n is a, c, g, or t
  modified_base (701)..(701): a, c, t, g, unknown or other
  misc_feature (701)..(701): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggntgttgtgatgactnagtctccactctcccngacccgtcacccgttgggcacgccggcctccattctcctgctaggtctagtagaaacgcctcgtactacggttgacttaggaaaacctccttaagttggtaacgttggacttacagacctaaggacggtccaaggccaactccgtaccgaaagggtcctacctttaaaagtttaacgtaaacggggttttcctaaaccggggctttaccggtggggttaccccaagtaccgaagtacttacccgaaggccggtacgtagggttcgggtcctaggggtacaacgttcggtactttaaccaccgtaagttacgactaaagttccgagggaccggtaaggggtagggagggtcgtaacggtagggtagttagggttttaggttttaatacgtcgtacagtctaaccgtaaacttccgaactaccggtcgttaccctcccgtatacccggtttggccgtaacggggacctagggtacgtaacgacgttaacgaaccggtaatcgtacggtactagactacgngttccg

SEQ ID NO: 211962 - DNA, 677 bp, Homo sapiens
  misc_feature: GYAE6OF01APGBF.43.86.H09.1.454.CMB.1.raw
  modified_base (244)..(244): a, c, t, g, unknown or other
  misc_feature (244)..(244): n is a, c, g, or t
  modified_base (666)..(666): a, c, t, g, unknown or other
  misc_feature (666)..(666): n is a, c, g, or t
tcagtgtgagtagtcacgaccggtgctcgatttagtgctatagacttgggtttggggacctgatcaggactcctcagttcaccttctcacaatgaggctcctgctcagctctgggctgctaatgctctgcgtccaggatccggtaggggattcgttgtgatgactcagtctccactcctccctgcccgtacaccgttgggcacgccggtacctccaatcgtcctagctaggtctagtagaaacnccctgtactacgttgataggaacctccgtacttagactttggactttcgagtccgaaggacggacccgtacggtaccctaagttccacccggtaaaggtccggtaacctttaagttacgttaacgggttaacctaacccgggtacctcggtacgggtaccctaggaccaaggtacttcgaacgtccgaggtacggtcggtcggtcgtactacggttctactttccgacgtacgtaacggtaactaacttcggaacggtcggtacgggtacgggtagtccgtaagggtaaggtacgttgggtttacgtttgttaaccgtgtctagtcgtattaaccgctaaccgtataccgtccgttacctgttacctcggacgtaacggtacggtacggtagcgtaactcggtaaaccgtagtccgacgtancgagtcctacg

SEQ ID NO: 211963 - DNA, 915 bp, Homo sapiens
  misc_feature: GYAE6OF01DTJRT.43.86.H09.1.454.CMB.1.raw
tcagtgtgagtagtcacgaccggtgctcgatttagtgctatagacttgggtttgggggactgatcaggactcctcagttcaccttctcacaatgagctccctgctcagctccgtggggctgactaatgctcgtcgggtccaggtacgtccgggtgggattgttgtgatgactcacgtcctcctactcctccctcgtcccgtcgtaccgttggcacgcccgacctctactcctcgtgactaggtctaggtagaacgtccttacgtaacgtacgttagaagtaacggaaacctacttacggtagtaaacgttcggaacttcgaagtaccgaacggaccggtacccgaaggtacccctaaaacgttcccggtaaacccggaaacggggtacccttttaaaacctttaaaacggtttttaaaccgggtttaacccgggtttttaaccccggtaaaacccgggggtacccgttttaccggggtaaccccgggggttaacccaaacggttaaccggtaacgtttaaccgttaccgggtaaaccggggtccggggttaaacggttacgggggttttccggtaccggttacgggtaaccccttaacggttttaacggttaaaaccctttcccgaaaacccggttagttaaccgtaaacccgtaaacggtttacccgaacgggtacccggggtaggggttacggggacggtacggttacgggttaacggtttagggttttacgggttttacggttttaacgttacgtacgttacgtaagttacgtaacctttaactaccgtacgttaccgtccggttaccttacggttcgtacggttccggaacgggtaccggtaagtaacgggttacgaacgtagtaaccgtaaacggtcgtacggtcggtacacgtcctacggtcttaccgg

SEQ ID NO: 211964 - DNA, 852 bp, Homo sapiens
  misc_feature: GYAE6OF01EJBG2.43.86.H09.1.454.CMB.1.raw
  modified_base (207)..(207): a, c, t, g, unknown or other
  misc_feature (207)..(207): n is a, c, g, or t
  modified_base (224)..(224): a, c, t, g, unknown or other
  misc_feature (224)..(224): n is a, c, g, or t
  modified_base (229)..(229): a, c, t, g, unknown or other
  misc_feature (229)..(229): n is a, c, g, or t
tcagtgtgagtagtcacgaccggtgctcgatttagtgctatagactttggggtttggggctgggagacgagcccagcactggaagtcgccggtgtttccattcggtgatcggcactgaacacagaggactcaccagtggtagtttgggcagtgcgttcggttttccgttcgtggtctcttttagtaggtcgtctagtgtcaggtgcngcgtggtggacgtcggnggggngacgtcggtcgagccggtggacgttacctgacctctctcgtagcgctcgtccgttcgtcgttacgttacctaccctttaataattaattagtcggacctagtcgtaaccgtacggtccgggtcccggccgtaccggtccgtccggtacggggacggaaccggggttgtacggggtaggttggggtccttacgtaacgttattaacgtcccgttaatacgggttataacggtaaacgggttaactaaaagggtaacggttaccaaaccggttcgaaaccggtaccgttacccggggttagggaaccggtacccgtaacgttacccgaccgttaaccggtaacgtaccgggtaaacgtaaacgggtaaccttaccgtaagacccgtcgttaaccgttcccgttaattacggttacctaacgtaacgtaaccgtaacggtaacgtaccgtacccgtaacgacccccgttaaggaccggttaaaccggtcgggttaacccgttactttttaacgggttaaacccggtttgtttacccgggaaggttaccggggtaccttaagggggtaacccgggtttagggtacccggggtttaacggttaccggtaccccggttttacccggggg

SEQ ID NO: 211965 - DNA, 792 bp, Homo sapiens
  misc_feature: GYAE6OF01A04VF.43.86.H09.1.454.CMB.1.raw
  modified_base (220)..(220): a, c, t, g, unknown or other
  misc_feature (220)..(220): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctgggtggagtcgtggggganacggtggtccaggccgtggggaacgtccctgacctactctcctggtcgcagcctctggtacttccaccttcaaattaattagtggacattcggctacgtcggggtcccgaccgagggtccttcccgtaggggaccgtaaggggggtccttaggggtacggttgggggtacggaccttaacgtttaagtacttaccgtaatttccgtaaggtaaggttacgggtaaaaggtttaaggaaaaacggtttaccgtaaccggaccgaacgggttacccgttaccggggttaacgggaacggggtacccgtaacgtttacccgaaccctacgttacccgtaacccggtaaaggggtaacctaaacgttaaccgaaacggtccgtaccgtaccttacgttacgttacttacgtaacgtaacctaaagtaccgtaaaccgtacggtaccgtacgaacccgtaacgtagggaacgggtacggtaaccgttacgtttaacgttttaacgttacgttggtacggtacggaacggtacggtaacgggttaggggttacggggggttagtccggttaacccggg

SEQ ID NO: 211966 - DNA, 950 bp, Homo sapiens
  misc_feature: GYAE6OF01AH2EV.43.86.H09.1.454.CMB.1.raw
tcagtgtgagtagtcacgaccggtgctcgatttagtgctatagacttgggtttggggactgatcaggactcctcagttcaccttctcacaatgagctccctgctcagctccgtggggctgactaatgctcgtcgggtacccaggacgtccgggtgggattggttgtcgatcgactcacgtcctcctacctcctcccgtcgcccgtccgtacccggttgggccgacggcccggtccctaccgactccttccgtcgacgtacggttactacggtacggtaaacgtcccgttacgtaaccgtacggttagaaccggttaaccggaaaaccctacccgtttaaacttacgtaaacggttagggtactttaccgaacggtacgacggggaaccggacccgaacgggttacccctaacggttacccgacccggaaagggttaccccgtaaccgtttttaaacgttttaaacgggttttaaaccgggttttaacccggtaaaccccgggttacgtttaccggggttaccggggtaaccccgtaacggtaaaccggtaaggtttaaccgtccggaaaccggggtccggtaaccgggtttacggggttccgggggttacggtaacccggtacccgtttaaggttaccgtttaaacccgtttaccggtaacccttaaccgtacggtaaacctaaacggtaccgaaggtaacgggggtacggggtaagggtacgggtacggttacggggaagggttttacggttttacgggtttaagttttacgttacgtacgtacttaacgtacgtaacccgttaacttaccgtaccgtaccgttaccggttacccttacccggttacgttaccggttacgggtaccgggaccggtaacggacgggttaacggacgtaacgtaacgtaaacggtacgttcggtagaccgtacgacccttagtcgttaccg

SEQ ID NO: 211967 - DNA, 639 bp, Homo sapiens
  misc_feature: GYAE6OF01BQZ2I.43.86.H09.1.454.CMB.1.raw
  modified_base (231)..(231): a, c, t, g, unknown or other
  misc_feature (231)..(231): n is a, c, g, or t
  modified_base (261)..(261): a, c, t, g, unknown or other
  misc_feature (261)..(261): n is a, c, g, or t
  modified_base (423)..(423): a, c, t, g, unknown or other
  misc_feature (423)..(423): n is a, c, g, or t
  modified_base (505)..(505): a, c, t, g, unknown or other
  misc_feature (505)..(505): n is a, c, g, or t
  modified_base (517)..(517): a, c, t, g, unknown or other
  misc_feature (517)..(517): n is a, c, g, or t
tcagtgtgagtagtcacgaccggtgctcgatttagtgctatagacttgggtttggggactgatcaggactcctcagttcaccttctcacaatgaggctccctgctcagctccgtgggctgctaatgctcgtgggtcccaggagtccgggtgggattgttgtgatcgactcagtcctccactcctttcccgcgcccgtcctaccggttggccacggcccgcctcatcctcgngactgtctaagacgtaacgtcctagtacgngtgaacgtacgaaacctccgtagttgtaatgtactcgagcaggacgcgaagcctaagtccaccggaggtccttacttaatttaggtacgttacgtaccggcttcggtccggtacagacgtatacgtcgacggcgtgtacgggttcgccgtaggacctacgtnttacgttaccagtaccgtacgtaactacgacggtagaccgggtaggtcgagtcgtaggtagttgtttggtttacggtttacngtcgtatacgtntaacgtaactcgacgtcgtaccgtccttacgttaccgttacggttccggacggtacgggtcgtaaggtcggaaatacggaacgtacgtacgtcggtcgtaccgtagacctcgtacgtttccg

SEQ ID NO: 211968 - DNA, 802 bp, Homo sapiens
  misc_feature: GYAE6OF01AKPOU.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctcgtgggtcccaggtatccgggtggggatggttgtgatgactcagtcctccactcctccctcgcccgtccacccgttgggcacgccggtccctccactccgtcctggcgtacggttcgtagtacgaaacgtcctacggtacctacggtttagactaagggtaaaccctaccttacgttaggtaacttagggtacttcgacgtcgaagacggtaccgacggaccaacgttacctaccgaacggccgttaaccttaagttttaacgttaacgggtttaaccgtaacccgggtacgttacccggttacgggggtaccctacgggtaactaacgtacgtttaccgaacgggtccggtaccggtagggttaccggggtcggttacgggtacccgttaagttaccggttactttacccgtaaccgtaacgttaacgtaactaacgtccgtaacgggaccggtaagggggtcgggtacgggccgttaagggacgggttacggttttaggttttacgggttttagttacgtggtacagttacgggtaccttaaacgtccaagttccgtaccgtcccgttaccgttaccgttacggtttccggaccggtacgggaacggtacggtcggaagtaaccgtacgtaagtacgtaggccggttacgccgttactaaccgtgtttaccg

SEQ ID NO: 211969 - DNA, 780 bp, Homo sapiens
  misc_feature: GYAE6OF01C5EX8.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctcgtcgggtcccaggatccgggtggggatgttgtgatgactcagtcctccactcctccctgcccgtccaccgttgggcacgcccggcctccatcctcctagcctagttctagtacgaaacgtccctacgtactacgttgagtaggaaaccaccttacgttagtaagttggtattcgacggctaaggacggccaacggccctaacttaccgtacccgaagggtcccgtaacctttaagttttaacgtttaaacgggttttaccgtaaacccggggtacttccgggtacgggggtacccaagtacgtacgtacgttacgacggtccggtacgtaagggttcgggtacttacggacctacgttacttaacgtttaccgacctaccgtacggaaacctaacgttacgaacgggacgggtagggtacgggaggtaccgtgggtaagggttgttttagggtttttaggttttacgtttacgtacgtactacgtacgaaccttaaccgttcgtaaccgttacgtccgggttccctttacccggttattacccggttttccggaccgggtaaccggggtaaccgtaaagggtcggtaagtaacgtaaacggtaaaaccgtacggtcggttacggaccttagtccccgtaactcgttaccg

SEQ ID NO: 211970 - DNA, 956 bp, Homo sapiens
  misc_feature: GYAE6OF01AYNTO.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctcgtgggtcccaggagtccggtggggattgttgtgatgactcagtctccactcctccctcgcccgtctacccgttggccacggcccggcctccactcctccgtgcgacgttctagtacgaaacgtcctacgtacgtacggttgacgtacggaaaacctaccgtttaacgttaggtaaagtttgggtaacttaccgaacggaccgaagggaacggaccccgtaacggaacccctaagtccccgtaaccggaaacggtacccgttaaccttttaaaatttttaacgggtttaaaaccgggttttacccggtaaacccggggtcctttaccgggttaccgggggtacccctaaaggtaccgtaacgtacgtttacgacggggaccggtacggtacgggttccgggttcgtacgggtacccttaagtttcggttaaccttttacccgaaccttaaccggtacgaaacctaacggtaccgaacgggtacggggtaagggggttaggggaaacggttaacggtaagggttaaggggtttaacgtttttagggggtttttaacgggttttttaacttaccggttacggtctaaaccgtttaccggtaaaccttaaacccgtttaccaaacccggtttacccgtttacccgggttacccgttttacccggttaccggttttaccggtttaacccggggtacccgggttaaaaccgggggtaaccgggttaaaggggtaccggtaaacccgttaaccggtaaacccgtaaaacgggttaccggtttacgggtaccgttacccgttaacgtaacccctaacccggtttcgtttacccgg

SEQ ID NO: 211971 - DNA, 817 bp, Homo sapiens
  misc_feature: GYAE6OF01BGJDJ.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctcgtgggtcccaggatccggtgggattggttgtgatgactcagtcctccactcctccctgcccgtcacccgttggcacgcccggcctccatctccgtgctaggtcgtaagtagaaacgtcctacgtactacggttagaacgtacggtaaaaccaccgttaactttaggaaagtttagggaatttacgaagaccgaaggacggaccccgaagggtaacccctaaaagttcccgttaacccggaaacggtacccggttaaccctttaaaagttttaagttaaaacggtttttaccggtaaaacccggggtaccgtttccggtacggggttacccccaggtaaccgaagtacgtttcaacgggccggacgtagggttacgggtaccgtacgggtaccgtacgttggttaactttcccgaacctaacgttacgaaccgtaaacttacgaacggaccggtaaggggtacgggaagggtactagggtaacggtaagtttagggttttacgggtttttaatttaacgtcgtaacgtaagtacgtaacgtaaaaccttaccgaacgttaccgttcgtacccgttaccgtttaccgttaggttttaccggaccgggttaagggtaacccgtaagggtacggtaagtaacgtaacgtaaaacgtacgtaggtacgtacgtacgaactaccgtagttaccg

SEQ ID NO: 211972 - DNA, 758 bp, Homo sapiens
  misc_feature: GYAE6OF01B05IX.43.86.H09.1.454.CMB.1.raw
  modified_base (526)..(526): a, c, t, g, unknown or other
  misc_feature (526)..(526): n is a, c, g, or t
tcagtgtgagtagtcacgaccggtgctcgatttagtgctatagacttgggtttggggactgatcaggactcctcagttcaccttctcacaatgaggcctccctgctcagctcgtggggctgctaatgctcgtgggtcccaggagtccgggtggggattgttgtgatgactcagtcctccactctccctcgcccgtcacccgttgggccacgcccggcctccatcctccgtgccaaggttacctaggtacgaaacggtccttacgtaacgtacgttagaacgttacggaaaacctaccgttacgtttaggtaatttgggaactttacgagacgaaggaccggacctacgggacctaaactcctaccgaacggccgttaactttaaagtttttacggtaaacggttttaccgtaaaccggggtacttccggtacggggtaccccaaggtaccgaaggttacgttacgaacggtaccggagtagggttacggtcgttacgggacttacggtgtaactttcgacacgtanaactaatcgaacgtgaggggtaggacggtcgtaggtagggtagttacgttttagggtttattaacgtcgtataaccgtagaacctaaccgttaccaccgtaccgttaccgtaccgttcccgtttacgtaccgtttcgggaaccggtacgggtaacccggtaaggtcggtaagaacctaaccggtaaacggacggttaacggtacgggtcccgtagtacccaacgttcttacg

SEQ ID NO: 211973 - DNA, 940 bp, Homo sapiens
  misc_feature: GYAE6OF01BIH1J.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctcgtcgggtcccaggatccgggtggggatgttgtgatgactcagtctccactcctccctgcccgtcacccgttggcacgccggcctccatcctcctagcgtaggttctagtagaaacgtccctacgtaccgtacgttgaacgtaacggaaacctaaccttacgttaaggtaagttgggtaacttcgaacggaccgaagggaaccggacccgtaacgggaacccctaaacgttacccgttaacccggtaaacgggtaccccgttaaccgtttttaaaaacgtttttaacggttttaaaaccgggttttttaacccggtaaaccccggggttaccgtttacccgggttacccgggggggtaacccctaaacggtaaccggttaaacggttaccgtttacccggaaacggggtcccggggtaacggttaacggggtttcgggggtttaacccgttcggggtacccgttaaacggttttcgggttaaccgtttttaaacccaaacccgttaacgtttaaccgggaaaccttaaaccgtaccgggtaacggacggggttaacggggttacgggaaccgggtaggttacgggtaacgggttacggttttaggggtttttaacggttttttaacgtacgttacggtacgtaacgttacgtaacccttaaaccgtttccaaccggttccgttaccggtccctttaccgttaccgttacggtttaccgggacccggtacggggtaaccgtagggtcgtaagttaacgtaaccggtaaacgtaacgtcgggtacgtactaaggtaaccctacgtcggtttacc

SEQ ID NO: 211974 - DNA, 943 bp, Homo sapiens
  misc_feature: GYAE6OF01CC4YT.43.86.H09.1.454.CMB.1.raw
tcagtgtgagtagtcacgaccggtgctcgatttagtgctatagacttggggtttggggactgatcaggactcctcagttcaccttctcacaatgaggctccctgctcagcctccgtggggctgctaatgctcgtcgggtcccaggacgtccgggtgggtattggttgtagatcgactcacgttccctcctacctcctcccgtccggtccccgtacctacccggttcgggacccgacgggtccccggtccccttacctacttcccgttccgtacggaccggtacgggttacctaagggtaacggtaaaccgtcccgttaccggtacgtacggttagaacgtaacggaaacctaccgtttagttagtaagttcggtatacggagtacgaacgggcgacccgaaggtaccctacttaccggtaaccgaaacgggtccgtttaaaccttttaaagttttaacgggttaaccgtttaaccccggaaccgggtcgttaccgggtccgggtaacccaagtacctaagttacgttaccggacggtcggtaacggtcgggttcgggtacgtaccgggacttacggttacgtttaccttacccgaacgttaaccgaataaccgtaaacgtcccggtaaggtaccgggggtaggggtttacgggaccggttgtaagggtttaggtacgggttttttacgggttttacggtttttaagaaccgttggtaacgttaacgtaaccgttaaccgttaaacggtcccgtaacgttacccgggtttcccgttacccgttttaccccggttacgtttaaccggggtttaccgggaccgggtaaaccggggttaaacgaggggtttaaaccgaacgttaaacccgaaaacgggttaacccggtaccggttacggggtaccgtttacccgaggttaacccccgtaagtttcggtttaaccccg

SEQ ID NO: 211975 - DNA, 843 bp, Homo sapiens
  misc_feature: GYAE6OF01DULKF.43.86.H09.1.454.CMB.1.raw
  modified_base (184)..(184): a, c, t, g, unknown or other
  misc_feature (184)..(184): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttggctgagtcgttgggttttcctcgttgcttacgtttttaaagnggttgtccagttgtcgaggtgcagcgttggtggagtcggtgggggacacggtggtccaggtccgtgggaacgttccctagacctacgttctccgtggtcgactacgcccttcgtggtaactttccaacccttttagaaactttaaagttatggacctatcgacgtaccgtcggggtcccgacgacggtcctccggtggacggaacgggggtctaggggtaggttacgggtcggaccttaaagttttacgtacgttaccgtagttaccgttaggtaaacgtaacggggtaaaacgttaaacggaaaacgtttacgtaaaccggaacgttaaccgggtaaccggttccgggtaacggggtaacgggtaccccgttaaacgttacccgtaaccgttaacccgttaccgtaacccggtaaacggggaaaccttaaacgttaaccgggtaaacggcccgtacgtaaccgttcgttagttacctacgtacgtaacgtaaacgtacgtaaaccacgttaccctaacggaaccgtaccgtaagggaaccgggtaacggtaaccgttaacgttttaacttttaacgttacgttacgggtaacgtacggtaaacgggaagggttaacccgggtaaggggttacgggggtcttaaccgggttaacccggg

SEQ ID NO: 211976 - DNA, 846 bp, Homo sapiens
  misc_feature: GYAE6OF01BSEK2.43.86.H09.1.454.CMB.1.raw
  modified_base (109)..(109): a, c, t, g, unknown or other
  misc_feature (109)..(109): n is a, c, g, or t
  modified_base (201)..(201): a, c, t, g, unknown or other
  misc_feature (201)..(201): n is a, c, g, or t
tcagtgtgagtagtcacgaccggtgctcgatttagtgctatagactttggggtttggggctggggagacgagcccagcactggaagtcgccggttgtttccattcggtnatcagcactgaacacagaggactcactagtgggtagtttgggctggacgtcgtttcggggtttttcctcggttgtctttacgttttaaaggnggttcgtccaggttcgtacgagggttgactggtcggttggggtaggtaggtcggggtagggggactacgggttcggtaccgtacggcccggttaggggtacccgttccccgtaagacccttcttcccgtttcgttcggacgaccgtaccgttccgttacggtccggttaactttaccccttaacctttaaagtaatttaagttcggtcggtactaggtacggtccgtacgggttccgggcccgacgtacggtcccgttggacgggacgggtacggggtggacggggttagggtcggaccttaacttacgttatcgtactacgttcggtaaggtaaagggtaaacggttaaagtaaacgtaaccgtttacggacgtacggaaacggttccgttaacggggacggtaaccgtccgttatacccacgttacccgtacggtaacaacggttaacctaagaaccgtacgaccttcgtaacgtcttgtaacctagtaccgaaagttacaccgggtaactccggtacctaacggaccgtccgtaaaggggaccgttaaacgttcgttaaacgtttttcgtaggcgttaaaggtcggaaacgtacggtacggggtttaggtacggggtgggtttaacccctggttacccgggg

SEQ ID NO: 211977 - DNA, 855 bp, Homo sapiens
  misc_feature: GYAE6OF01BCDKH.43.86.H09.1.454.CMB.1.raw
  modified_base (115)..(115): a, c, t, g, unknown or other
  misc_feature (115)..(115): n is a, c, g, or t
tcagtgtgagtagtcacgaccggtgctcgatttagtgctatagacttggggtttggggactgatcaggactcctcagttcaccttctcacaatgaggctccctgctcagctccgnggggctgctaatgctcgtggtcccaggactccggtgggattgttgtgatgactcagtcctccacgtcctcccgtccgcccgtacctacccgttggccgtacgcccggtccctaccgtacttcctccgtcggacgtaacggttccgtaaggtacggtaaaccgtccctacgttaaccgacggttagaacggttaacgggtaaaccctacccgttaacgttagtaaacgtttggtacttaccgaggacgaacggtacggaccccgaacggtaccctaaagtcccgtaaccggtaaacggtcggttaacctttaaagttaacggttacggtttacccgtaaacgggccttcgggtacgggacctaaggacgtaacgtcgtacgacgggtcggtacgacgggttcggtacctagggacctttaagtcgttaaccgttacccggtaactacgtacggtaacctaacggttaccggacggttacccggggtaaggggtagggaaccgttggtaaccgggttaagggttggttttaacggggttttaacgtttaaccgttacgttaacgtacgtaaccggtttacgtaaaccccttaaaccgttgaaccgtttacccggtccgtttaaccgtttacccggtagtttaccccggttaacgggaccgtaaaggggtccggtaaaggtgggtaaccgaacgttacgaaaccgggtacgttacgtcggtcacgtaccctagttccttacgg

SEQ ID NO: 211978 - DNA, 835 bp, Homo sapiens
  misc_feature: GYAE6OF01CAMDD.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctcgggtcccaggatccggtggggatgttgtgatgactcagtcctccactctccctgcccgtcacccgttggcagccgcctcatcctctgcaggtctagagaacgcctacgtacacgttagagtacggaaacctacttattacgtaagttacggtattcgaagtaccgaaggtaacggcccaagggacctaattcctaccgaaacggcctacctttaaatttacgttaacggtttaccgaaccgggtctcggtacgggtacccaagtaaccagtacttcgacggcggtacgtacgggttgggtacttagggacctagttcggtaactttaccgaaccgtacgttaacgaacgtaacgtacgaacggtcgggtaagggggtacggtaacgggttcgtaagggttaacgggttacgggttttacgggtttttaagggttttttaacgtaacggtttacggtaacgttaacgttaacgggtaacccttaaacgtttacccgtaaccgttaacccggtttaccgggttaacccccgtttcccggttttaaccgtttaccggttttaccccggggtaaccgggtaaaccgggggtaaccccggtttaaaggggtaccgggtaaaggttaaacccgttaaacccgaaaaccggtttaaccgttcggggttaacgtaccggttacggaacccttaacggttaaccgtttaccgg

SEQ ID NO: 211979 - DNA, 510 bp, Homo sapiens
  misc_feature: GYAE6OF02IRAZ2.43.86.H09.1.454.CMB.1.raw
tcagtgtgagtagtcacgaccggtgctcgatttagtgctatagacttgggtttgggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaattataaggtttctaaccgggactctggggtcccagacagattcagcggcagtggtctggcactgatttcacactgacaatcagcagggtggaggctgaggatgttgggtttattactgcatgcaacttcacactgccttccgttctacgttttgccgtagggaccaagggtggagagtacaaacgaactgtggctgcaccatcg

SEQ ID NO: 211980 - DNA, 512 bp, Homo sapiens
  misc_feature: GYAE6OF02ILYJL.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaaccgggactctggggtcccagacagattcagcggcagtgggtctggcactgatttcacactgacaatcagcagggtggaggctgaggatgtttgggtttattactgcatgcaaacttcacactggccttccgttctacttttgccagggaccaaggtggagatacaaacgaactgtggctgcaccatcg

SEQ ID NO: 211981 - DNA, 500 bp, Homo sapiens
  misc_feature: GYAE6OF02HNMSC.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcaggtggaggctgaggatgttgggtttattactgcatgcaaacttcacactgcctcgttcactttgccagggaccaaggtggagatacaaagactgtggctgcacatc

SEQ ID NO: 211982 - DNA, 506 bp, Homo sapiens
  misc_feature: GYAE6OF02GZG58.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccggggactctggggtcccagacagattcagcggcagtgggtctgggcactgatttcacactgacaatcagcagggtggagctgaggatgttggtttatatgcatgcaacttcacactggcctccgttcacttttggccagggaccaaggtggagagtacaacgaactgtggctgcaccatcg

SEQ ID NO: 211983 - DNA, 574 bp, Homo sapiens
  misc_feature: GYAE6OF02I42I8.43.86.H09.1.454.CMB.1.raw
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
  modified_base (354)..(354): a, c, t, g, unknown or other
  misc_feature (354)..(354): n is a, c, g, or t
  modified_base (567)..(567): a, c, t, g, unknown or other
  misc_feature (567)..(567): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctcaagcncctaattanaaggtttcaaccggactcgtggggtcccagacagacttcagcggnagtggtctggcactgatttcacactgacaatcagcgaggtggaggctgaggtattggtttagggttttatactgctatgactaaacttccaacgacgttcggccttacccgttctaacgttttcgggaccgtaggggtaacccaagggttcggaacgtacgtaccgtaaaacgtaaccgttcggttaacggtccgttagtaccgtaacccgtnttacccg

SEQ ID NO: 211984 - DNA, 523 bp, Homo sapiens
  misc_feature: GYAE6OF02H2KWJ.43.86.H09.1.454.CMB.1.raw
  modified_base (256)..(256): a, c, t, g, unknown or other
  misc_feature (256)..(256): n is a, c, g, or t
  modified_base (445)..(445): a, c, t, g, unknown or other
  misc_feature (445)..(445): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacncctacttgaattggattcagcagaggccaggcccaatctccaaggcgcctaatttataaggtttctaaccgggactctggggtcccagacagattcagcggcagtgggtctggcactgattcacactgacaatcagcagggtggaggctggaggtatggtttggttttattacttgcatgacaaacttnactactggccttccgttcacttttggcctaggggaccaaggtggaagatcgaaacgacgtgtcggctgacacctatcg

SEQ ID NO: 211985 - DNA, 555 bp, Homo sapiens
  misc_feature: GYAE6OF02IVAQ5.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgacctaatttataaggtttctaaccgggactcgtggggtcccagacagattcagcggacaggtggtctggcactgatttcacactgacaatcagcgagggtggaggcgtggaggtagttggtttgggttttattacgtgactatgactaaaccttcaactacgttcggtcccttccgttccgtacgtttggaccgtacggggacgaagggtggaagtactaacgaacgtacgtggtcggctgaccacgtatccg

SEQ ID NO: 211986 - DNA, 503 bp, Homo sapiens
  misc_feature: GYAE6OF02FLAQ2.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgtttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgagatgttgggtttattactgcatgcaacttcacactggcctcgttcactttgccaggggaccaggtggagatcaacgactgtggctgcaccatcg

SEQ ID NO: 211987 - DNA, 521 bp, Homo sapiens
  misc_feature: GYAE6OF02GR5F7.43.86.H09.1.454.CMB.1.raw
tcagtgtgagtagtcacgaccggtgctcgatttagtgctatagacttgggtttggggactgatcaggactcctcagttcaccttactcacaatgaggctccctgctcagctcctggggctgctaatgctctgggtcccaggatccggtggggatgttgtgatgactcagtctccactctccctgcccgtcacccgttgggcagccggcctccatcgtcctgcaggtctagtgaaagcctcgtacacgttgatggaaacacctacttgaattggattcagcagaggccaggccaatctccaaggcgcctaatttataaggtttctaaccgggactcctggggtcccagacagattcagcggcagtggtctgggcactgatttcacactgacatcagcaggtgagctgaggattgttgggtttattcgtgcatgcaactcacacgtgccttcgttcacgtttcgccgaggggtaccaagggtcggacgtagtacgaaccgaacgtgtggcgtcgcaccgatcg

SEQ ID NO: 211988 - DNA, 510 bp, Homo sapiens
  misc_feature: GYAE6OF02HYCNY.43.86.H09.1.454.CMB.1.raw
  modified_base (483)..(483): a, c, t, g, unknown or other
  misc_feature (483)..(483): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtgaggctgagatgtggttttattactgcatgcaaacttcacactcggccttccgttctacttttggcctaggggaccaaggtgganagtcaaacgaactgtgctgcaccatcg

SEQ ID NO: 211989 - DNA, 504 bp, Homo sapiens
  misc_feature: GYAE6OF02IYVZ3.43.86.H09.1.454.CMB.1.raw
  modified_base (315)..(315): a, c, t, g, unknown or other
  misc_feature (315)..(315): n is a, c, g, or t
  modified_base (500)..(500): a, c, t, g, unknown or other
  misc_feature (500)..(500): n is a, c, g, or t
tcagtgtgagtagtcacgaccggtgctcgatttagtgctatagacgtttggggtttggggactagatcaggactcctccaggttcaccttctcacaagtgaggctccctgctcagcctcctgggctgctaactgctctgggtcccagggatccggttgggatcgttgtgatgactcagtctcactcgtcctgccgtcacccttgggcagccggcctccatctcctgcaggtctagtgaaagcctgtacacgttgatggaacacctacttgaattggattcagcacgagccaggccaatctcaaggcgctaattanaagttctaacgggatctgggtccagcagattcagcgcagtggtctggcactgatttcacatgacaatcagcgagggtgaggctgagtatgttgggtttattactgctattgctaacttcactactgccttcgttcaacgtttggcagggacaaggtggagatacaacgactcgcgtctgctacgntccg

SEQ ID NO: 211990 - DNA, 513 bp, Homo sapiens
  misc_feature: GYAE6OF02HQ4X1.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaaacacctacttgaattggattcagcagaggccaggccaaatctccaaggcgcctaatttataaggtttctaaccgggactctggggtcccagacagattcagcggcagtgggtctggcactgatttcacactgacaatcagcagggtggaggctgaggatggttgggttttattactgtcatgcaaacttcacactggccttccgttctacgtttgcctagggaccaaggtggagagtcaacgagtgtggctgcacatcg

SEQ ID NO: 211991 - DNA, 541 bp, Homo sapiens
  misc_feature: GYAE6OF02HS8SQ.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgctaatttataaggtttctaaccgggactctggggtcccagacagattcagcggcagtgggtctggcactgatttcactactgacaatcagcgagggtggaggcgtggaggtagttggtttagggttttattacgtgtctagtgactaaacttcactacgtcgccttccgttctacgttttcggccgtagggaccgaagggtggagagtacaacgtaacgtgtcggctgacaccatacg

SEQ ID NO: 211992 - DNA, 513 bp, Homo sapiens
  misc_feature: GYAE6OF02GM64X.43.86.H09.1.454.CMB.1.raw
  modified_base (499)..(499): a, c, t, g, unknown or other
  misc_feature (499)..(499): n is a, c, g, or t
  modified_base (510)..(510): a, c, t, g, unknown or other
  misc_feature (510)..(510): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtgagctgaggattgttggtttatactgcatgcaaacttcacactggccttccgttcacgttttggccctaggggaccaagggtggagagtacaacgactgnggtcctgcacntcg

SEQ ID NO: 211993 - DNA, 528 bp, Homo sapiens
  misc_feature: GYAE6OF02HMYUB.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtggtctgggcactgatttcacactgacaatcagcagggtggaggctgaggatgtttgggtttattactgcattgctaaacttcactactggccttccgttcacttttcggccgtaggggacctaagggtggagtagtacgaaacgactaggtcggcttgacaccattcg

SEQ ID NO: 211994 - DNA, 510 bp, Homo sapiens
  misc_feature: GYAE6OF02HBZP9.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctgggggtcccagacagattcagcggcagtgggtctggcactgatttcacactgacaatcagcagggtgaggctgaggatgttgggttttattacgtgcatgcaacttcacactgcctccgttcacgttttggccaggggaccaggtggagatacgaacgactgtggctgcacctatcg

SEQ ID NO: 211995 - DNA, 539 bp, Homo sapiens
  misc_feature: GYAE6OF02IP9XR.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctcatctcctgcaggtctagtgaaagcctcgtacacgttgatggaaacacctacttgaattggattcagcagaggccaggccaatctccaaggcgacctaatttataaggtttctaaccgggactcgtggggtcccagacagattcagcggcagtgggtctgggcacgtgatttcacactgacaatcagcgagggtgaggctggaggattggttggttttattacgtgctatgactaaacttcactacgtcggccttccgttcttacgtttgggccgtaggggacctaaggggtgtaagatacgaaacgtaacgtgtggctgactaccatcg

SEQ ID NO: 211996 - DNA, 516 bp, Homo sapiens
  misc_feature: GYAE6OF02IWSJM.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggattgttgggttttattactgcatgctaaacttcacactggccttccgttctactttcggccaggggaccaagggtggagatacaaacgactgtggctgcaccatcg

SEQ ID NO: 211997 - DNA, 509 bp, Homo sapiens
  misc_feature: GYAE6OF02JAVOF.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctgggggtcccagacagattcagcggcagtgggtctggcactgatttcacactgacaatcagcagggtgaggctgaggatgttgggttttattactgcatgcaaacttcacactggcctcgttcacttttggccaggggaccaaggtggagatcaaacgactgtggctgcaccatcg

SEQ ID NO: 211998 - DNA, 582 bp, Homo sapiens
  misc_feature: GYAE6OF02IG06Q.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaaatttataaggttttctaaccgggacttcgtcggggtcccagacagattcagcggcagtgggtctgggcactgtactttcactactgacaatcagcgagggtggaggcgtaggaggtagttggttttaggggttttatttacgtgctagtgacctaaacttcacctacgtcggtcccttccgttctacgttttcgggaccgtacggggtaccgtaagggtcggaacgtagtaaccgtaaacgtaacgtggtcggcttacggacctacctattccg

SEQ ID NO: 211999 - DNA, 575 bp, Homo sapiens
  misc_feature: GYAE6OF02GL9RG.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtggtctggcactgatttcacactgacaatcagcagggtggaggctgaggattggtttgggttttattacgtgcatgactaaactttcaactacgtcggtcccttccgttacctacgttttcgggcccgtacgggggtacctaaggggtcgggaagtacgtaaccgaaaaccggtaacgttcggttacgggtcgttacggcctacccgtattacccg

SEQ ID NO: 212000 - DNA, 647 bp, Homo sapiens
  misc_feature: GYAE6OF02IJ0P5.43.86.H09.1.454.CMB.1.raw
  modified_base (204)..(204): a, c, t, g, unknown or other
  misc_feature (204)..(204): n is a, c, g, or t
  modified_base (272)..(272): a, c, t, g, unknown or other
  misc_feature (272)..(272): n is a, c, g, or t
tcagtgtgagtagtcacgaccggtgctcgatttagtgctatagacttggggtttgggggactgatcaggactcctccagttccaccttcttccacaattgaggtctccctgctcagctcctggggctgctaatgctctggggtccctagggatccggtggggattggtttgttgatgtactcagtctccatctccctgcccgtnacccttgggcagccggcgtccatctcctgccaggtctagtgaaagcctcgtacacgttgatggaaacncctacttgaattggattcagcaagaggccaggccaatctcccgaaggcgccttaaacgttagtaaacgggtttctaaaccggggacttcgtacgggggtccctagacgagattcaagcggcaaggtgggtactggacacgttgacttttcactaacgtgactaatctaagcgaagggtggaggtctaggaggtaacgttggttttcgggttttaatttacgtgtacaagttgaacctaaacttcgactaaccgtcggtacccttaccgttaccgtaccgttttagggaccgtaggggtaacccgtaagggtcgggtaagtaacgttaacgaaacgaacgttaggtacggtacgttaggacctaccgtattaccgg

SEQ ID NO: 212001 - DNA, 522 bp, Homo sapiens
  misc_feature: GYAE6OF02GKIOW.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctgggcaccgatttcacactgacaatcagcagggtggaggctggaggagtgtttgggttttattactgcatgacaaacttcacactggcctccgttctactttggccagggaccaagggtggaagatacaaacgaactgtaggctgcacctatcgtcg

SEQ ID NO: 212002 - DNA, 564 bp, Homo sapiens
  misc_feature: GYAE6OF02JVQXL.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaagcgctaattataggtttctaaccgggatcgtggggtccagacagattcagcgcagtggtctggcactgatttcacactgacatcagcgagggtggaggcgtggaggtagttggtttgggttttattacgtgtctagtgacgtaacttcgaactacgtcggtccttccgttactacgttttacgggccgtacggggtaaccgtaagggtagggagtaagtaccgaaggtacgaaccgttggtcggtaccgtcggacctaccgtaacg

SEQ ID NO: 212003 - DNA, 513 bp, Homo sapiens
  misc_feature: GYAE6OF02HT9X4.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggttttctaaccgggactctggggtcccagacagattcagcggcagtggtctggcactgatttcacatgacaatcaagcgaggtggaggctgaggatggttgggtttattactgcatgcaaacttcacactgcctccgttcactttggccagggacctaagggtggagatacaaacgactagtggcttagctaccatcg

SEQ ID NO: 212004 - DNA, 515 bp, Homo sapiens
  misc_feature: GYAE6OF02HQGWI.43.86.H09.1.454.CMB.1.raw
  modified_base (219)..(219): a, c, t, g, unknown or other
  misc_feature (219)..(219): n is a, c, g, or t
  modified_base (488)..(488): a, c, t, g, unknown or other
  misc_feature (488)..(488): n is a, c, g, or t
tcagtgtgagtagtcacgaccggtgctcgatttagtgctatagacttgggtttgggggctgggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggganacgtggtccagcctgggaagtccctgacactctcctgtgcagcctctggattcaccttcaataattatggcatgcactgggtccgccaggctcctgggcaaggggctgggagtggggtggcacttatatcatctgatggaagtagaaagtactagcagactccgtgaacgggcgatcaccatctcagggacaatacaagcgcactctgtatctgacaaatgaacagcctagacaccgtagacggagacggtactatttattactagtgngagagacgaggttagggggagtctacg

SEQ ID NO: 212005 - DNA, 533 bp, Homo sapiens
  misc_feature: GYAE6OF02F8ZKY.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtggtctggcactgatttcacactgacaatcagcgagggtggaggctggaggtattggtttgggttttattactgctagtgactaaacttcactactggtcctccgttctacgttttcggccgagggaccaagggtggaaggtatacgaaacgtactaggtcgcgtgctacatcg

SEQ ID NO: 212006 - DNA, 834 bp, Homo sapiens
  misc_feature: GYAE6OF02JGQX7.43.86.H09.1.454.CMB.1.raw
tcagtgtgagtagtcacgaccggtgctcgatttagtgctatagacttgggttgggggacgtgatcaggactccgtccagttcgaaccttctcgacaactgaggctcctgtctctacgcctcctggggtcttgcgtaatcgctctgggtcccaggtagtccggtaggggtatgttgtggatgactcacgtactccactctccctgcccgtcacccttgggcagccggcctccatcctctgcgacggtctacgtgaaaggcctacggtacacgttgaacttggaaacctaccgtacttgaacttgggaaatttcgacgcgacgacggccgacggtcccaatcgtcctaagggcgtacccttaatttacgtaaggggtttcctaaccggggtacgttccgttaccgggggtcccaacggtacgtacggtaacgttcgaacggccggtcggaagttcggggtacgtacgggactaacgttcggtaacttttccaccgtaaccgttacggtaaccaaacgttccgaacggtcccgtaaggggtcgggtaacggtccgtttaaggaagggtaacgttttagggtttaccggggtttttaatttaaccgttcggttacgtaacgttaacgggtaccttaaaacgttttaccgtaaaccgtaacgttccgggttccccgtttacccggtttacgtaaaccggttttttcgggaaccccggtttacgggggttaacccgtaacggggttaaccggggtaaccgtaaagggttacccgtaaaaccgggtaaccgttacgggttaccggtaccgttaacggtaccggtacccgttaagttcccgg

SEQ ID NO: 212007 - DNA, 537 bp, Homo sapiens
  misc_feature: GYAE6OF02HSMZS.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcgagggtggaggctggaggtagtggtttgggttttattactgtctagtgactaaacttcactacgtcgtccttccgttctacgttttgccgtacgggtaccgaagggtggagtatacgaaacgacgtagtggctgacacctatcg

SEQ ID NO: 212008 - DNA, 519 bp, Homo sapiens
  misc_feature: GYAE6OF02GQTFM.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctgggcactgatttcacactgacaatcagcagggtggaggctgaggattgttgggttttattactgcatgcaaacttcacactcgccttccgttcacttttcggcctagggaccaagggtggagagtacaaacgaactggtggcgtgcaccatcg

SEQ ID NO: 212009 - DNA, 573 bp, Homo sapiens
  misc_feature: GYAE6OF02F25L9.43.86.H09.1.454.CMB.1.raw
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctattgaattggattcagcagaggccaggccaatctccaaggcgacctaatttataaggtttctaaccgggactcgtcggggtcccagacagattcagcggnaggtggtcnggcactgatttcacactagacatcagcgagggtggacggcgtaggaggtagttggtttagggtttttattacgttgtactagtgactaaacttcaactacgtcggtccttccgttctacgtttcggaccgtacggggtaccgtagggtacggagtacgtaccgaaacgtaacgtcggtacgggtcgtcgaccgtaccgtattccg

SEQ ID NO: 212010 - DNA, 572 bp, Homo sapiens
  misc_feature: GYAE6OF02IZN13.43.86.H09.1.454.CMB.1.raw
  modified_base (392)..(392): a, c, t, g, unknown or other
  misc_feature (392)..(392): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacactacttgaattggattcagcagaggccaggccaatctcaaggcgcctaatttaataaggtttctaaaccgggactctcggggtcccagacagattcagcggcaggtggtctggcactgatttcacactgaacaancagcgagggtggaggcgtaggaggtattggtttgggttttattacgtgtcagtgactaaacttcactaacgtcggtacccttccgttaccttacgtttcgggaccgtaggggaaccgtaagggtggaagtaactaaccgaaacgtaacgttggtggtaccgtacgactacccgtattccg

SEQ ID NO: 212011 - DNA, 631 bp, Homo sapiens
  misc_feature: GYAE6OF02H5KZF.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatcctaccaaggcgacctaatttataaggtttacctaaccgggactcgtcggggtcccagacagattcgagcggcaggtcgggtctgggcactggtactttccactactagaacaatcaggcgagggtggaggctaggaggtagttggttttagggttttatttacgttgctagttagacctaaacttcaacctacgttcggtccctttaccgttccttaaccgtttttcgggacccgtaacgggggtaacccgtaaggggttacgggtaacgtaacggtaaacccgtaaaccggtaaaccgttcgggttacggacgttacggacctacccgtattcccgg

SEQ ID NO: 212012 - DNA, 541 bp, Homo sapiens
  misc_feature: GYAE6OF02FO5I7.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcaggtgggtctggcactgatttcacactgacaatcagcgagggtggaggcgtgaggtagttggttgggtttttattacgtgctatgacaaacttcacactcggccttccgttctacttttcggccgtaggggaccgtaagggtggagtactacgaaacgacgtggtcggtcgtgctaccattccg

SEQ ID NO: 212013 - DNA, 541 bp, Homo sapiens
  misc_feature: GYAE6OF02FMZSJ.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatggtttgggttttattactgcatgcaaacttcacacgtacggtccttccgttcgtacttttcggccgtacgggggacctaagggtggagtactacgaaacgtaacgtagtcggtccgtagcaccgattcg

SEQ ID NO: 212014 - DNA, 516 bp, Homo sapiens
  misc_feature: GYAE6OF02GHVZC.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcgcagtggtctggcactgatttcacactgacaatcagcagggtgaggctgaggattgttggttttattatgcatgcaaacttcacactgccttcgttctacgttttgccgtagggaccaagggtggaagactacgaaacgaacgtagtcggctgctaccatcg

SEQ ID NO: 212015 - DNA, 604 bp, Homo sapiens
  misc_feature: GYAE6OF02IU0ZL.43.86.H09.1.454.CMB.1.raw
tcagtgtgagtagtcacgaccggtgctcgatttagtgctatagacttggggtttggggactgatcaggactcctcagttcaccttctcacaatgaggctccctgctcagctcctggggctgctaatgctctgggtcccaggatccgggtggggatgttgtgatgactcagtctccactctccctgcccgtcacccttgggcagccggcctccatctcctgcaggtctagtgaaagcctcgtacacgttgatggaaacaccttacttgaattggattcagcagaggccaggccaatctaccaaggcgtacctaatttataaggtttctaaccgggactcgtggggtcccagacagtacttcgaggcggcaggtcgggtctcggctactgtatttccactactgacaatcgagcgagggtggaggcgtaggaggtagtttgggttttagggtttttattacgttgtactagtgtaacctaaacgttcaacgtacgttcgtcctttccgttccgttaacgttttcggaccgtaggggaacctaaggggtcggaagtacgtaacgaaccgtaaggttgtacgggtacctcggacctaccgtattcccg

SEQ ID NO: 212016 - DNA, 588 bp, Homo sapiens
  misc_feature: GYAE6OF02HBSA2.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaacgcctcgtacacgttgactggaaacacctacttgaattggattcagcagaggccaggccaatcctaccgaaggccgtaccttaaattttacgtaaaggttttcctaaccgggtctcgtcggggtcccagacagtacttcgagcggcaggtgggtctgggcacgtgtactttcactactgacaatcagcgagggtggaggctggaggtagttggtttagggttttattactgtctatgactaacttcactacgtgtccttcgttctacgtttcggaccgtacggggacctaagggtggaacgtagtaaccgaaacgtaacgttacggtacggtcctacggacctaccgtattaccg

SEQ ID NO: 212017 - DNA, 586 bp, Homo sapiens
  misc_feature: GYAE6OF02FE0UF.43.86.H09.1.454.CMB.1.raw
  modified_base (372)..(372): a, c, t, g, unknown or other
  misc_feature (372)..(372): n is a, c, g, or t
  modified_base (405)..(405): a, c, t, g, unknown or other
  misc_feature (405)..(405): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatcctcctgcaggtctagtgaaagcctcgtacacgttgatggaaacacctacttgaattggattcagcagaggccaggccaatctccaaggtcacctaatttagtaaggtttctaaccgggtactcgtcggggtcccagacagattcagcggcaggtggtcnggctactgatttcacactgacatcagcgagggngaggctagaggtagttggtttagggttttatacgtgactatcgactaaacttcactacgtcgtacccttccgttacgtacgttttcgggaccgtacggggaccgtaagggttacggaacggtaacgtaaccgtaaacgtacgttaggtacggtaccgttcgaccgtaccgtagtttacccg

SEQ ID NO: 212018 - DNA, 607 bp, Homo sapiens
  misc_feature: GYAE6OF02FWQKX.43.86.H09.1.454.CMB.1.raw
  modified_base (423)..(423): a, c, t, g, unknown or other
  misc_feature (423)..(423): n is a, c, g, or t
tcagtgtgagtagtcacgaccggtgctcgatttagtgctatagacgttgggtttgggggactgatcaggactcctcagttcaccttctcacaatgaggctccctgctcagctcctggggctgctaatgctctgggtcccaggatccggtggggatgttggtgagtgactcagtcttccactctccgtgccgtcacccttgggcacgccggcctccatcctcctgcgaggtctagtcgaacgcctcgtaccacgttgatgggaaacacctacttgaattggattcagcagaggccaggccaagtctaccgaacggccgtaccctaaattttaactaacggtttacctaaaccgggtacttcgtcgggggtcccaaggaccaagacttacaagtcggcaggtgggtctgggcacgtgagtttcanacgtgaacaatcagcgagggtgaggcgtagaggtagttggtttgggttttattactgtactagtacgtactaaacttcaacgtacgtcggtccgttccgttcttacgttttcggacccgtaggggaccgtaagggtcgggaatacgtacgaaacgtagtggtacgcgtacgcctacctattccg

SEQ ID NO: 212019 - DNA, 588 bp, Homo sapiens
  misc_feature: GYAE6OF02H7TP1.43.86.H09.1.454.CMB.1.raw
  modified_base (257)..(257): a, c, t, g, unknown or other
  misc_feature (257)..(257): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagcccggcctccatctcctgcaggtctagtgaaagcctcgtacacgttgatggaaacncctacttgaattggattcagcagaggccaggccaatctccgaaggccgtaccttaatttagtaacggtttcctaaccgggacttcgtcggggtacccagacagtattcagcggctaggtgggtctggctactgtactttcactactagactaatcagcgtagggtggaggacgtggaggtagttggttttagggtttattacgtgctagtgactaacttcactacgttcgtccttccgttctacgtttcggaccgtacggggtaccgtaagggtcggaacgtacgtaaccgaaaccgacgttcggtacggtcttcgacctaccgattcccg

SEQ ID NO: 212020 - DNA, 650 bp, Homo sapiens
  misc_feature: GYAE6OF02I7SEZ.43.86.H09.1.454.CMB.1.raw
  modified_base (208)..(208): a, c, t, g, unknown or other
  misc_feature (208)..(208): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcaccctggcagccgcctcntctcctgcaggtctagtgaaacgcctgtacacggttgataggaaaccacctacttgtaattggattcagcagacggccaggccaatcacaaggctactaatttagtacggtttactaaccgggactcgtcggggtacccagaccgtagtaacttcgaacgggtcgacgtaggttcgggtcgtcggtactaacgtgtaactttccgaactacgtacgaactaaatccgtaaggcggtaaggggtggaagggcgtacggaggttacggtttggttttagggttttattacggtggtactagtagtaccttaaacttccgaacgtacgtccgttaccgtttccgtacgttacgttttcggaccggtacggggtaaccgtagggtacggaagtacgtaaccgaaacggttacgtaggtaccggtacgtacgaccgtactcgttacg

SEQ ID NO: 212021 - DNA, 576 bp, Homo sapiens
  misc_feature: GYAE6OF02GH4PM.43.86.H09.1.454.CMB.1.raw
  modified_base (301)..(301): a, c, t, g, unknown or other
  misc_feature (301)..(301): n is a, c, g, or t
  modified_base (336)..(336): a, c, t, g, unknown or other
  misc_feature (336)..(336): n is a, c, g, or t
  modified_base (429)..(429): a, c, t, g, unknown or other
  misc_feature (429)..(429): n is a, c, g, or t
tcagtgtgagtagtcacgaccggtgctcgatttagtgctatagacgttgggtttgggggactgatcaggactcctcagttcaccttctcacaatgaggctccctgctcagctcctggggctgctaatgctctgggtcccaggtatccggtggggatgtttgtgatgactcagtctccactctccctgcccgtcacccgttgggcagccggcctccgatctcctgcaggtctagtgaaagcctcgtacacgttgatggaaacacctacttgaattggaattcagcagaggccaggccaatcnccgaaggcgcctaattataaggtttctaaccgggntcgtggggtcccagacagattcagcggcaggtgggtctggcacgtgtactttcgacactgaacaatcgagcgaagggtggacggtctggaggnttggtttggtttattactgcatgactaacttcactacgtcggtcccttccgttacttacgttttcgggaccgtaggggtaccgaagggttcgaaggtacgtaacgtaaacgtacgttaggtcggtccttaggcctaccgtagttccg

SEQ ID NO: 212022 - DNA, 868 bp, Homo sapiens
  misc_feature: GYAE6OF02G2BRG.43.86.H09.1.454.CMB.1.raw
tcagtgtgagtagtcacgaccggtgctcgatttagtgctatagacttggggtttggggactgatccaggactacctcagttcaccttctcacaatgacggctcctgctcacgctcctggggctgcgtaatggcgtctcgggtccctaggtagtccgggtggggatgttgtcgatggactccagtctccacgtctccctgcccgtcacccttgggcagccggccgtccatcgtcctggcacggtcgtagtgaaagtcctacggtacacgtttgatacggaaacaccttacgtttggaaatttcggaatttcaagctaggtaggaccaggcccaagttcctccgaaagggccggacccttaaagtttacgtaacgggtttaccttaaccggggacttcggtacgggggttacccaagtacgaagtacttaccgaaggtccgggtcgaaggttcggggtcctagggtcctaacgttggtaacctttttaccgaaccgtaaccgtttcggaaaccgtaacgttaccggaacggacccgtaggggggttagggaaacggggtccgttagggaacggggtagtttacgggttttacggggtttttaacttaccggttacgggtacctaagttaggtaacccgttaaaaccgttttccgaaaccgttaccggtttaccgggtaacccctttcccgggttttaaccggttaaaccggtttttttaccgggacccgggttaaccggggggtttaacccgttaacgggggtttacgggtaaccggtaaacgttacccggaaaaacccgggttacggtttaccggggttaccgggggtaccgttaacgggtacccggttaacccgttacgtttacccgg

SEQ ID NO: 212023 - DNA, 547 bp, Homo sapiens
  misc_feature: GYAE6OF02G03K7.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggattggttgggttttatactgcatgactaaacttcactactggcccttccgttctacgttttggaccgtaggggtacctaagggtgggaagtacgtacgaaacgtaacgtaggtcgggtactggacctacctattaccg

SEQ ID NO: 212024 - DNA, 522 bp, Homo sapiens
  misc_feature: GYAE6OF02HY5WT.43.86.H09.1.454.CMB.1.raw
  modified_base (257)..(257): a, c, t, g, unknown or other
  misc_feature (257)..(257): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacncctacttgaattggattcagcagaggccaggccaaatctccaaggcgcctaatttataaggtttctaaaccgggactctggggtcccagacagattcagcggcagtgggtctggcactgatttcacactgacaatcagcagggtggaggctgaggattggttgggttttattactgcatgcaaacttcacactcggccttccgttcacttttggccgtaggggaccaaggtggagagtacgaaacgacgtgtggctgcaccatcg

SEQ ID NO: 212025 - DNA, 548 bp, Homo sapiens
  misc_feature: GYAE6OF02IB2BA.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaagcgctaattataagttctaacggactctggggtccagacagattcagcggcagtgggctggcactgatttcactactgacaatcagcgagggtggaggctggaggattggtttgggtttattacgtgcatgactaaacttcaactactgcccttccgttctacgttttcggccgtagggtacccgaagggtcggaggtaactaaccgtaaaacgaacgttggtacggactcggacctaccgtattaccg

SEQ ID NO: 212026 - DNA, 624 bp, Homo sapiens
  misc_feature: GYAE6OF02GHJUE.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtagaaacgcctcgtacacgttgatggaaacacctacttgaattggattcagcaggagccaggccaatctccgaaggcgacctaatttataaggtttctaaccgggactcgtggggtcccagacagattcagcggcaggtgggtctcggctactgtattttaccactactacgaactaatcgagcgaggggtggaggtctaggaggtagttggttttagggttttatttacgttgtactagtacgtaactaaactttcgaacctaacgttcgggtcccttcccggtttacttacgttttcggacccggtaggggtaccgtaaggggttcgggaacgtacgtaaccgaaacggtaacggttacggtacgggtacgttacggaccctaccgtattaccgg

SEQ ID NO: 212027 - DNA, 615 bp, Homo sapiens
  misc_feature: GYAE6OF02F1R16.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactcgtcggggtccagacagattcagcggcagtgggtctggcactgatttcactactgacaatcagcgagggtggaggcgtggaggtagttggtttagggttttattacgttgctagtgtactaaacttcgaactaccgttcggtacccttcccgtttaccgttaccgtttttacgggacccgttacgggggaacccgtaaaggggtacgggaacggtaacgtaaccgtaaaccggtaaaccggttcggttacgggtaccgttacggacccgtaccgtacgttaccg

SEQ ID NO: 212028 - DNA, 542 bp, Homo sapiens
  misc_feature: GYAE6OF02JHWRX.43.86.H09.1.454.CMB.1.raw
  modified_base (256)..(256): a, c, t, g, unknown or other
  misc_feature (256)..(256): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgcgtcccaggatccggtggggatgttgtgatgactcagtctccactctccctgcccgtcacccttgggcagccggcctccatctcctgcaggtctagtgaaagcctcgtacacgttgatggaaacncctacttgaattggattcagcagaggccaggccaatctccaaggcgcctaatttataaggtttctaaccgggactcgtggggtcccagacagattcagcggcagtgggtctggcactgatttcacactgacaatcagcagggtaggaggctgaggtattgttagggttttattacgtgctatgacaaacttcactactggccttccgttctacgttttcggccgtaggggacccgtaaggtcggaagtacgtacgaaacgtacgtcggtcggactcgacacctacg

SEQ ID NO: 212029 - DNA, 569 bp, Homo sapiens
  misc_feature: GYAE6OF02HO61I.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgataggaaacacctacttgaattggattcagcagaggccaggaccaatctccgaaggctacctaatttataaggtttcctaaccgggactcgtcggggtaccagacagtattcagcggcaggtcgggtctggcactgtactttcactactgacaatacagacgagggtggaggtcgtaggaggtagttggttttagggttttaagttacgtgtactagtgactaaacttacactacgtcgtccttccgttctacgtttcggaccgagggtaccgaagggtggagtacgtaacgaacgtagtggtcggctacgacacgtatcg

SEQ ID NO: 212030 - DNA, 524 bp, Homo sapiens
  misc_feature: GYAE6OF02FGE4O.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaaggcgcctaatttataaggtttctaaccgggactctggggtcccagacagattcagcggcagtgggtctgggcactgatttcacactgacaatcagcagggtgaggctgaggagtgttgggttttattacgtgtcatgcaaacttcacactggtcctccgttctacttttggcctaggggaccagggtggagtagtacgaaacgacgtgtggctgccacattccg

SEQ ID NO: 212031 - DNA, 581 bp, Homo sapiens
  misc_feature: GYAE6OF02I3LF3.43.86.H09.1.454.CMB.1.raw
tcagtgtgagtagtcacgaccggtgctcgatttagtgctatagacttgggtttgggggactgagtcaggactcctcagttcaccgttctcacaatgaggctccctgctcagctcctggggctgctaatgctctgggtccccaggatccgggtggggatggttgtgatgactcagtctccactctccctgcccgtcacccttgggcagccggcctcatctcctgcaggtctagtgaaagcctcgtacacgttgatggaaacacctacttgaattggattcagcagaggccaggccaatctcaaggccgcctaatttataaggtttctaaccgggtactcgtggggtcccagacagattcagcggcagtggtctggcacgtgtatttcgactacgtgtacatcagcgagggtggaggctggaggtagttggtttaggttttattacgtgtcagtgtactaacttcactacgtcgtaccttccgttctacgtttcggacccgtacggggaccgtaaggggtcggaggtaacgtaaccgaaacggtaacgttacggtacggaccgtagaccgtacctagttaccg

SEQ ID NO: 212032 - DNA, 560 bp, Homo sapiens
  misc_feature: GYAE6OF02H9WKW.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacactacttgaattggattcagcagaggccaggccaatcctaccgaaggccgaccttaatttagtaacggttttcaaaccgggtacttcgtcggggtcccagacagattcagcggcaggtggtctggcacgtgatttcacactgacaatcagcgagggtggaggtcgtgaggtagttggtttaggtttattacgtgtactagtagtactaaacttcactacgtcgtccttccgttctacgtttcgccgtacgggtacgtaggtggagtactacgaacgtacgtagtcggtactacgactacattacg

SEQ ID NO: 212033 - DNA, 567 bp, Homo sapiens
  misc_feature: GYAE6OF02GJ4XH.43.86.H09.1.454.CMB.1.raw
  modified_base (562)..(562): a, c, t, g, unknown or other
  misc_feature (562)..(562): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtcagtgaaagcctcgtacacgttgatggaaacacctacttgaattggattcagcagaggccaggccaatctccaaggcgcctaatttataaggtttctaaccgggactcgtggggtcccagacagattcagcggcagtggtctggcactgatttcacactgacaatcagcgagggtggaggctggaggagttggtttagggttttattacgtgtctagtgtactaaacttcactacgtcggtccttccgttcgtaacgttttggaccgtacggggtaccctaagggtcggaagtacgtacgaaaaccggtacttaggtcggtacctacggcctaaccgtnttccg

SEQ ID NO: 212034 - DNA, 526 bp, Homo sapiens
  misc_feature: GYAE6OF02GX42Z.43.86.H09.1.454.CMB.1.raw
  modified_base (221)..(221): a, c, t, g, unknown or other
  misc_feature (221)..(221): n is a, c, g, or t
  modified_base (312)..(312): a, c, t, g, unknown or other
  misc_feature (312)..(312): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (431)..(431): a, c, t, g, unknown or other
  misc_feature (431)..(431): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatgggagtttgggctgagctgggttttcctcgttgctcttttaagaggtgtccagtgtcaggtgcagctgggtggagtcgtgggggganacggtgggtccaggccgtgggaacgtccctgacactctcctgtgcagcctctggattcaccttcaataattatggcatgcacgtgggtccnccaggctcctggcaaggggctggagtgggtgcacttantcatcngagtggaagtagaaagtactacgcagactcgtagacgggccgtatcacactcacgaggacatacagcacactctntatctgacaatacgaacacgtccagacaacaggaggacgacgacgttaattacttactgtagacgagagacgtaggtacggggtagcgttaacgg

SEQ ID NO: 212035 - DNA, 557 bp, Homo sapiens
  misc_feature: GYAE6OF02HHIM0.43.86.H09.1.454.CMB.1.raw
  modified_base (514)..(514): a, c, t, g, unknown or other
  misc_feature (514)..(514): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcaggaggccaggcccaatcctaccaaggcgaccttaaattttataaacggttttctaaaccgggtactcgtggggtcccagacagattcagcggcagtgggtctggctactgatttcactactgaacaatcagcgagggtggaggctggaggtagttggtttaggttttattacgtgcatgactaactcactacgtcgtcccttcgttctacgtttcgccgacgggaccagggtcggngaactaccgaacgaacgttgtacggcgtacgactaccgattcg

SEQ ID NO: 212036 - DNA, 530 bp, Homo sapiens
  misc_feature: GYAE6OF02HQ9TU.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctctgcaggtctagtgaaagcctcgtacacgttgatggaaacacctacttgaattggattcagcagaggccaggccaatctccaaggcgcctaatttataaggtttctaaccgggactcgtggggtcccagacagattcagcggcagtgggtctggcacgtgatttcacactgacaatcagcgagggtggaggctgaggagttggtttgggtttattacgtgctatgactaaacttcacactcggccttccgtctacgtttcggctacggggaccagggtggacgagtacgaacgacgtcgtcggctgacaccatcg

SEQ ID NO: 212037 - DNA, 579 bp, Homo sapiens
  misc_feature: GYAE6OF02IBOI3.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaacgcctcgtacacgttgatggaaacacctacttgaattggattcagcagaggcccaggccaatctccgaaggcgaccttaatttagtaaggtttcgtaaccgggactcgtcggggtacccagacagattcgagcggcaggtgggtctgggcacgtgtatttcactactgactatacagcgagggtaggaggacgtgaggtagttggtttagggttttattacgtgctagtgactaaacttcactacgtcggtccttccgttactacgtttcggacgtacgggacgtaagggtcggaagtacgtaaccgtaaacgtaacgtacgtcggacttcggactaccgtattacg

SEQ ID NO: 212038 - DNA, 652 bp, Homo sapiens
  misc_feature: GYAE6OF02GTE5Q.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttggcagccggcctccatctcctgcaggtctagtgaaacgcctcgtacacgttgataggaaaccacctacttgaattggattcagcagaggccaggccaatcctaccgaaggccgacccttaaattttagttaacgggtttacctaaccgggtacctcgtcggggtacccagaccagacttcgagcggactaggtcgggtcgtggcctactgtatttccactacgtgacaatcgacgtcgagggtggaggcgtggaggtagttggtttagggtttttagttacgttgtctagttacgtacctaaacttcctacgtacgtcggttcccttccgtttaccgtacgttttcggtaccggtcggggtaaaaaaaaccgtgggtaacgggtaagtaacgttaccgtaaaccggtaacgttacggttacgggtaccgtacggtaccgtacccttagttacccgg

SEQ ID NO: 212039 - DNA, 695 bp, Homo sapiens
  misc_feature: GYAE6OF02G54OQ.43.86.H09.1.454.CMB.1.raw
tcagtgtgagtagtcacgaccggtgctcgatttagtgctatagacttgggtttggggactgatcaggactcctcagttcaccttctcacaatgaggctcctgctcagctcctggggctgctaatgctctgggtcccaggatccgggtggggatgttgtgatgactcagtctccactctccctgcccgtcacccttggcagccggcctccatctctgcaggtctagtgaaagcctcgtacacgttgatacggaaacacctacttgaattggattcagcagacggccaggccaatctaccgaaggccgtaccttaaagtttacgtaacggttttaccgtaaccgggtacttccgtacgggggtaccctaagaccgtaagtacttacgacggccggtacgtagggttcgggtcgtaggacctacgttagtacttttcgaaccttacgtacgaactaactacgaacggtacggtagggggttacgggaacgggtcgtagggtaagggtagtttgggttttacgggtttttagttacgtagtcctagtacggaccttaaacttccgaactacgttccggtcctttaccgttacttacggtttcggaccggtacggggtaaccgtaagggttacggaacgtaacgtaacgtaaaccggtaacgttcggtacgggtacttaccggacctacgtaccttacgg

SEQ ID NO: 212040 - DNA, 577 bp, Homo sapiens
  misc_feature: GYAE6OF02HP8R0.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaaccacctacttgaattggattcagcagaggccaggccaatctaccaaggcacctaatttataaggtttctaaccgggactcgtcggggtcccagacagtattcaggcggcaggtgggtctgggactactgtactttcactactagacaatcgagacgagggtggaggcgtaggaggtagttggtttagggtttaattacgtgctagtgactaaacttcaacgtacgtcggtaccttccgttactacgtttcggaccgtacggggaccgtaagggtggaacgtacgtacgaaacgacgtaggtcggacgtacgacacctattccg

SEQ ID NO: 212041 - DNA, 539 bp, Homo sapiens
  misc_feature: GYAE6OF02IY8O4.43.86.H09.1.454.CMB.1.raw
  modified_base (392)..(392): a, c, t, g, unknown or other
  misc_feature (392)..(392): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactcctccctgcccgtcacccttgggcagccggcctccatctcctgcaggtctagtgaaagcctcgtacacgttgatggaaacacctactgaattggattcagcagaggccaggccaatctcaagcgctaatttataaggtttctaaccgggactcgtaggggtcccagacagtatcagcggacagtgggtctggcactgatttcacactagacaatnagcgaggtggagcgtgaggtattgtttgggttttattacgtgtcatgactaaacttcactacgtcgtccttccgttctacgtttggccgtagggaccgaaggtggaagtacgtaacgaaacgaacgtgtcggctaggcactactacg

SEQ ID NO: 212042 - DNA, 850 bp, Homo sapiens
  misc_feature: GYAE6OF02JD1E8.43.86.H09.1.454.CMB.1.raw
tcagtgtgagtagtcacgaccggtgctcgatttagtgctatagacttgggtttggggggactgatcaggactcctcagttcaccttctcacaactgaggctccctgctcagctcctggggctgctaatcgctctgggtcccaggataccggtggggatgttgtgactgactcagtcctccactctccctgcccgtcaccgttagggcacgcccggcctccatctccgtgcgtaggtctagttgaaacgcctcggtacacgttgactacggaaaccacctacttagaaacgtttgggactttcgacgtaccgaggacggacccgacggaccctaaacgttccgtaccgaacggccgtacctttaaactttaacggttaacgggtttaccgtaaccgggtaccttcggtcggggtacccagtaccgtagtacgttacgacggtcggacgtacgggttcggggtcctacggggtactaaccgttacggttacttttaccgaaccgtacgttacggaacctaacgtccgtaacggtacggtacggggtacgggtacgggtacgttagggtaacgggttacgtttagggtttttacgggttttttaactttaacggttcgtaaccgtaaggttacgtaaaccgtttaaaccgttaccgtaaccgtaccggttaccgggttccctttaccgggtttaaccgttaaccgggttttaccgggaaccgggtaacgggggtaaaccggttaacggggttaacgggtaaaccggttaacggttaaaccggtaaaccggttaaccggttacgggtaccgggttaccgttaccggttaacccgtacccgttacgtttacccgg

SEQ ID NO: 212043 - DNA, 624 bp, Homo sapiens
  misc_feature: GYAE6OF02I8161.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgtgtgatgactcagtctccactctccctgcccgtcacccttgggcagccgcctccatctcctgcaggtctagtgaaagcctcgtacacgttgataggaaaccacctacttgaattggattcagcagacggccaggccaatctaccgaaggcgaccttaatttagtaacggtttctaaaccgggctcgtcggggtcccagacagtacttcaggcggcaggtcgggtctggctactgtactttccaactacgtcgaacgtaactcgaagcggtagggtgggaggtacgtggaggtagttaggttttgggttttaattacgtcgtctagttacgaactaaacttctaccgtacgtcggtaccctttccgttacgttacgttttacggaccggtacgggtaaccgtaagggtcggtaacgtacgtaaccgaaacgtaacgtcggttacggaccgtcggacctacccgtagttccg

SEQ ID NO: 212044 - DNA, 589 bp, Homo sapiens
  misc_feature: GYAE6OF02G5DL0.43.86.H09.1.454.CMB.1.raw
  modified_base (365)..(365): a, c, t, g, unknown or other
  misc_feature (365)..(365): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaacgcctcgtacacgttgatggaaacacctacttgaattggattcagcagaggccaggccaatctccaaggcgcctaatttataaggtttctaaccgggactcgtacgggggtcccagacagtattcagccggnaggtgggtctggcactgtatttcactactgaacaatcagcgagggtggaggtctaggaggtagttggtttgggtttttactagtgactatgaactaaacttcactacgtcgtccttccgttccttacgttttcggaccggtacggggaccgtaagggtacgggaacgtaacgtaacgtaaacgtacgttacggttacggaccgttacggccctaacgtattccg

SEQ ID NO: 212045 - DNA, 759 bp, Homo sapiens
  misc_feature: GYAE6OF02I0RJT.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccgttggcacgccggcctcatctcctgcaggtctagtagaacgcctacgtacacgttgatagaaacacctactagaattggattcagcagacggccgaacggccaaatcctaccgaaaggtccgaccgtttaaaattttaacgtaaacgggtttttacccgaaaacccggggtattccggttaccgggggtaccccaaggtaacccgtaagtacgtttaccgaagggcccggtaacgtaacgggttcggggtaccgttacggggacctacgttagtaacgttttaccgaaccgtaacgtacggtaacctaaacgttccgaaggtaccggtaaggggtacgggacgggtcgttagggaagggttaagtttgggtttagggttttaacttacgtagtacgtaagtacggtaacctaaaccgttcgaacctaaccgttccggtaccgttcccggtttactaaccggttttcggacccgtacggggtaccgtaaagggtcggtaacgtaacggtaaccgtaaacgtaacggttacgggttcggtacgttaccgacgtacccgttagttaccg

SEQ ID NO: 212046 - DNA, 537 bp, Homo sapiens
  misc_feature: GYAE6OF02GBJ3C.43.86.H09.1.454.CMB.1.raw
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagacgtgggtccagcctgggaactccctgacactctcctgtgcagcctctggattcaccttcaattaattatggcatgcacgtgggtcccgccaggcctccgtggcgaaggggctggagtggggtgcacttatatcatctgataggaagtagaaagtactacgcagactcgtagaggcgatcacatctacgaggacaattacaagcgacactctgtactctgacaaatagaacacgtacctagacaccgtacggagacggacgtacttaatttaacttactgtcgacgagacggacggtaggtacgggggtacgtacgtacg

SEQ ID NO: 212047 - DNA, 565 bp, Homo sapiens
  misc_feature: GYAE6OF02IXKQO.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggaccaatctccaaggccgaccttaatttataaggtttctaaccgggactcgtggggtcccagacagattcgagcgcaggtggtctgggcactgtatttcacatgaactaatcagcgagggtggaggctggaggtatttgggtttagggtttttattacgtgtctagtgactaaacttcaactcgtggtcccttcgttcttacgtttcgggaccgtacggggacctaagggtgaacggataccgaaacgtacgttggtcggtcgtagaccacgtattccg

SEQ ID NO: 212048 - DNA, 539 bp, Homo sapiens
  misc_feature: GYAE6OF02FVKVY.43.86.H09.1.454.CMB.1.raw
  modified_base (303)..(303): a, c, t, g, unknown or other
  misc_feature (303)..(303): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcncctaatttataaggtttctaaccgggactcgtggggtcccagacagattcagcggcagtgggtctggcactgtatttcacactgacaatcagcgagggtggaggctggaggtattggtttgggttttattacgtgctatgactaaacttcactacgtcggtccttccgttctacgtttgaccgtagggaccaaggtggagatacgaaacgtacgtggtcgcgtgactaccataccg

SEQ ID NO: 212049 - DNA, 616 bp, Homo sapiens
  misc_feature: GYAE6OF02HNTDM.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtcctccactctccctgcccgtcacccttgagcagccggcctccatcctcctgcaggtctagtgaaacgcctcgtacacgttgataggaaacacctacttagaattggattcagcagaggccaggccaatcctaccaaggcgaccttaatttagtaacggtttctaaccgggtactcgtcggggtacccagacagatcagcggcaggtgggtctggcacgtgtactttcactactacgaacaactcaacggcgtaacggggtagggacggtacgtaggaaggtacgtttgggttttagggtttttaaggttactgacctagtcgaacttaaacgttcaccgtacgttcgtccttccgttacttacgttttcggaccggtacgggtaccgtaagggtcggaagtacgtaaccgtaaagtaccgtaggtacggtctacgacctactaacg

SEQ ID NO: 212050 - DNA, 641 bp, Homo sapiens
  misc_feature: GYAE6OF02GBOEU.43.86.H09.1.454.CMB.1.raw
  modified_base (635)..(635): a, c, t, g, unknown or other
  misc_feature (635)..(635): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatcctcctgcaggtctagtgaagcctcgtacacgttgatggaaacacctacttgaattggattcagcagacggccaggccaatctaccgaaggccaccttaatttagtaacggtttcctaaccgggacttcgtcggggtcccagacagtattcagcgacgtaggtgggtctgggcacgttgatttccactactgaacaatcgagcgtagggtggacggcgtaggaggttagtttgggtttagggtttttagttacgttggtacctagttacgtacgttaaaccttccgtaaccgtacgtcgggtccctttcccggtttacttaccggttttcgggacccggtacggggtaaccgtaagggttacggtaacgtaacgtaacccgaaacggtaacgttcggtacggtacgtcggacccgtaccgtnttaccg

SEQ ID NO: 212051 - DNA, 561 bp, Homo sapiens
  misc_feature: GYAE6OF02H7Q27.43.86.H09.1.454.CMB.1.raw
  modified_base (303)..(303): a, c, t, g, unknown or other
  misc_feature (303)..(303): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagacgtggtccagcctgggaagtccctgacactctcctgtgcagcctctggattcaccttcaataattatggcatgcactgggtccnccaggctcctggcaaggggctgggagtggggtggcacttatatcatctgatggaagtagaaagtactacgcagacctcgtgaggccgattcaccatctccgagggacaattaacaacgcgacactctgtactctgacaaatacgaacacgtacctacgaccaccgtagaggacggaccggtacgttaattttaactttacgtggttacgtacggacggacggacggtaagggttaggggggtacgttacgttaaccgg

SEQ ID NO: 212052 - DNA, 582 bp, Homo sapiens
  misc_feature: GYAE6OF02GN6K8.43.86.H09.1.454.CMB.1.raw
  modified_base (303)..(303): a, c, t, g, unknown or other
  misc_feature (303)..(303): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcncctaaatttataaggtttctaaacccggggacttcgtcggggtcccagacagattcagcgcagtgggtctggcactgatttcacactgacaatcagcgaggggtggaggcgtggaggtagttggtttagggtttttaattacgtgtactagtagactaaaccttcactacgttcggtcccttccgttctacgttttcggaccgtacggggtacctaggggtacggtaagtacgtacgaaacggtaacgtacggtacggtcgtcgactaccgtattaccg

SEQ ID NO: 212053 - DNA, 650 bp, Homo sapiens
  misc_feature: GYAE6OF02IM3AN.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttggcagccggcctccatctcctgcaggtctagtagaaacgtcctcgtacacgttgatggaaacacctacttagaattggacttcagcagaggccaggccaatcctaccgaaggccgtaccttaaatttacgtaacggttttaccgtaaccgggtacttcgtcgggggtacccaagacagtattcgagcggcaggtgggtctggcacgtgactttcactactagacaatcgagcgagggtcggaagggtcgtaggagggtatttgggttttagggtttttaacttacgttagcgtaagttcgtaaccttaaacgttaccaacgtaccgtcggtcccgtttcccgttacttaccggttttggacccggtacggggtaaccgtaaggggttacggaacgtaacgtaaccgaaacggtacgttacggtcggtacgttacggacctaccgtatttcccgg

SEQ ID NO: 212054 - DNA, 632 bp, Homo sapiens
  misc_feature: GYAE6OF02GV8YW.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgattcagtctccactctccctgcccgtcacccttgggcagccggcctccatctcctgcaggtctagtgaaagcctcgtacacgttgataggaaacacctacttgaattggattcagcagaggccaggccaatcctaccgaaaggccgacccttaaattttacgttaaacgggttttaccgtaaaccggggtaccttccgttacgggggtccccaaggaaccaagtattacgaggcggctaggtggggtctgggactactggacttttcgaactacgtagaactaactacgacgacggagggtgggaggtcgtaggagggtagttggtttagggttttattacgttgactagtcgtactaaacttcactacgtcgtcccgttaccgttcgtacgttttcggaccgtacgggaccgtaagggtcggagtacgtacgaaacgtaacgtggtcggtcgtacgacctacgtatacg

SEQ ID NO: 212055 - DNA, 553 bp, Homo sapiens
  misc_feature: GYAE6OF02I9IC9.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctcaaggcgcctaatttataaggtttcaaccgggactcgtggggtcccagacagattcagcgcaggtggtctggcactgatttcactactgacaatcgagcgagggtgaggctggaggtgttgtttgggttttattacgtgactagtcgactaacttcacacgtcgtcccttcgttacttcgtttacggccgtacgggaccgtaagggtcggaagtacgtaccgaaacgtacgtggtacggtctagcctaccgtattccg

SEQ ID NO: 212056 - DNA, 654 bp, Homo sapiens
  misc_feature: GYAE6OF02G7PIL.43.86.H09.1.454.CMB.1.raw
  modified_base (262)..(262): a, c, t, g, unknown or other
  misc_feature (262)..(262): n is a, c, g, or t
tcagtgtgagtagtcacgaccggtgctcgatttagtgctatagacttgggtttggggacgtggagtcaggactcctcagttcaccttctcacaatgaggctcctgctcagctcctggggctgctaatgctcgtgggtcccaggactccggtggggattgttggtgatggactcagtctccactctccctgcccgtcacccttgggcagccggctccatctctgccaggtctagtgaaacgcctgtacacgttgatggaaacnctactgaattggattcagtcagagccaggccaatctaccaaggccgaccttaagtttacaagggttttaccgaacgggtaccttcgtcggggtacccaggtacaagtacttcgaacggtcggactaaggcgggttactcgggctaacgttgaacttttaccgaactaccgtgaactaacgtcaacggcgtaagggtcgggacggtcgtagggaaggtacttaggggttttagggttttaacttacgtaggtcctaaggttcgaaccttaaacgttccaacgtacgttcggcccttaccgttactaccgttttcggacgtaacggggtactacgggtaggacgtagaaccgtaaacgtaccgttgtaacggcttacggacacccgtgtacccg

SEQ ID NO: 212057 - DNA, 574 bp, Homo sapiens
  misc_feature: GYAE6OF02FH6D4.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactcgtcggggtcccagacagattcagcggcagtgggtactggcactgatttcacactgacaatcagcgagggtggaggcgtggaggtagttggtttagggtttttattacgtgtctattgactaaacttccactacgtcggtcccttccgttactacgttttcgaccgtaggggtaccgaagggtcggaaggtaactaccgtaaacgtaacgtcggtacggtaccgtcgactaccgtagttccg

SEQ ID NO: 212058 - DNA, 537 bp, Homo sapiens
  misc_feature: GYAE6OF02IRUWF.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtggtctggcactgatttcacactgacaatcagcagggtggaggctgaggatgtttggttttattactgctatgcaaacttcactactggcccttccgttctacgttttcggccaggggacctaaggggtggaagtactacgaaacgaacgttggtcggtactggactaccgattccg

SEQ ID NO: 212059 - DNA, 627 bp, Homo sapiens
  misc_feature: GYAE6OF02FI2L7.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatcctcctgcaggtctagtgaaagcctcgtacacgttgatggaaacacctacttgaattggattcagcagacggccaggccaatctaccaaggcgcctaatttataaggtttctaaccgggactcgtggggtcccagacagattcagcggcaggtggtctggcactgactttcacactgacaatcagcgagggtggacggtcgtggaggtagttggtttagggtttttattacgttggtcctagttcgtacctaaacgtttcaaccgtaacgttcgggtacccttccggtttcctaacgtttttcgggacccgtagggggtaacccgtaaggggttcgggaaggtaaccgttaaccggaaaacggttaaccgtaggttacgggtaccgttacggtaccgtaccgtacgtttacccgg

SEQ ID NO: 212060 - DNA, 535 bp, Homo sapiens
  misc_feature: GYAE6OF02JC6EJ.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagacggccaggccaatctaccaaggcgtacctaatttataaggtttctaaccgggactcgtgggtcccagacagattcaggcgcaggtggtctggcactgtattcacactgactaatcagcgagggtggagcgtgagtagttgtttggtttatcgtgcatgactaacttcatctcgtccttcgttctacgtttcggaccgagggtaccagggtggtacgactaccgaacgtacgtggtcgtcgtagacacctagttcg

SEQ ID NO: 212061 - DNA, 755 bp, Homo sapiens
  misc_feature: GYAE6OF02HSJ49.43.86.H09.1.454.CMB.1.raw
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagcgtggtttcgcgtagctctttaagaggtgtcagtgtcaggtgcagctggtggagtcgtgggggagacgtggtccagccgtgggaacgtccctgacactctcctgtgcagtcctctggattcaccttcaataattatggcatgcacgtgggtccgcgaggctacctggaccgaaggggcctgggacggtggggtcggacctacgtttaatacttcaacttccgtaggtaagttaggggaaagttaagtaaaacggttacctaacgggacctaaggtaacccgtcccggtaggtaaccggggtaccgtaacgtttacccacctacgttcccgtaccgtaacgggggtaaaccttaaaacgtttaaaccgtaaaccggtaccggtaccgttaacccgtttaccgttacgtttaccgttaccgtttaaccgggaacttaaaacgttacggtaaaccgtaacggttacccgtacggacccttaaaccgttacggaacgggtaccggtaacgggttacttaacgtttttaaccgtttacgtaggttacggtacgtaacggtacggtaaccggttacggggtttaaggggggttacggttacccgtttaacgg

SEQ ID NO: 212062 - DNA, 690 bp, Homo sapiens
  misc_feature: GYAE6OF02JCOQD.43.86.H09.1.454.CMB.1.raw
  modified_base (233)..(233): a, c, t, g, unknown or other
  misc_feature (233)..(233): n is a, c, g, or t
tcagtgtgagtagtcacgaccggtgctcgatttagtgctatagacttgggtttggggtacgtggagtcaggactcctcagttcaccttctcacaatgaggctcctgctcagctcctgggctgctaatgctctgggtcccaggatccggtggggatgttgtgatgactcagtctccactctccctgcccgtcacccgttgggcagcccggcctccgatctcctgcaggtctagngaactcctagtacacgttgagtcggtaaacacctacttagaaattggattcgagctaggaggtaccagggacccaatcctaccgaaacggccgtacccttaaatttacgtaaacggttttacgtaaaccgggtacgttccgtacgggggtaccccaaggtaccgagtaacgtcgaagtcggaccgaaggttcggggttcctaggtccgaactggtaccttttacaacgtaccgtagaacctaaatctaaggcgtacggggtagggacgccggtagaacgggtagttggttttacgggtttaattacgtgtacaagttcgaactaaacttcgaacgtacgttcggtacccttccgttacttaccgtttcggaccgtaacggggtccctaagggtcggaagtacgtaaccgaaccggtaagttccggtaggacctttaggacccgtacgacgtttaccg

SEQ ID NO: 212063 - DNA, 568 bp, Homo sapiens
  misc_feature: GYAE6OF02GSUCZ.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggcaatctccaaggcgcctaatttataaggtttactaaccgggactcgtggggtcccagacagattcgagcggctaggtgggtctgggcacgtgtatttccactactgacaatcgagcgagggtggaggcgtggaggtagttggtttagggttttattacgtgtactagtgtactaaaccttcacgtacgtcggtccttcgttcgtacgtttcggaccgagggtactaagggtggaagtacgtacgaaacgtacgtaggtcggctacgactaccgtagtccg

SEQ ID NO: 212064 - DNA, 618 bp, Homo sapiens
  misc_feature: GYAE6OF02HSHBH.43.86.H09.1.454.CMB.1.raw
  modified_base (209)..(209): a, c, t, g, unknown or other
  misc_feature (209)..(209): n is a, c, g, or t
tcagtgtgagtagtcacgaccggtgctcgatttagtgctatagacttgggtttggggactgatcaggactcctcagttcaccttctcacaatggaggctccctgctcagctcctggggctgctaatgctctgggtcccaggatccggtggggatgttgtgatgactcagtctccactctcctgcccgtcaccttggcagccgctcatcnctgcagtctagtgaaagcctcgtacacgttgatggaaacacctacttgaattggattcagtcagaggccaggccaatctccaaggcgctaatttataaggtttcaaccgggtactcgtcggggtccagacagagttcgagcggcgtaggttcgggtctgggactacgtgtaacttttcaacctacgtagactaactcgtaaggcgtaggggttaggaagggtcgtaggagggtagttggttttacgggttttatttacgtgtaccgtagttgtacctaaacgttctaaccgacgttacggcccgtttaccgttcgtaccgtttttcgggccgtacggggaccgtaaggggtcggtaacggtactaaccgtaaacgacgttacggtcggacgtcggtactaccgtattcg

SEQ ID NO: 212065 - DNA, 904 bp, Homo sapiens
  misc_feature: GYAE6OF02IPFXD.43.86.H09.1.454.CMB.1.raw
tcagtgtgagtagtcacgaccggtgctcgatttagtgctatagacttgggtttggggacgtttgatcaggactcctcagttcaccttctcacaatgaggctcctgctcagctcctgggctgctaatgctctggtcccaggatccggtggggatgttgtgatgactcagtctccactctccctgcccgtcacccgttggcagcccgcctccatctcctgccaggtctagtcgaaacgtcctacgtactaccggttgacgtacggaaaacctaccgttaacgttacgtaaacgtttcgggtatttaccgaaggtactaaacgggaacgggtacccgaaacgggtccctaaaacgttccgtaaccgaaacgggtacccgttaaccctttaaaacgttttacgttaaaaccgggttttaacccgttaaaaccggggtacttaccggttaacgggggtacccctaaacggtaaccgtaacggtaactttaccgacgggaccggtcgtaaggttcgggttactcgggtactacgtagtacgtttaccgacacgtacggactaaacgtcgtaacgtcgtaaggggtacgtaacggtcgttaggtaacggtagtttagggttttacgggttttaacgtttacgtacggttactaacggttacgttaaccgtaaacgttttaccgaaaccgtttaacgtaccggggtttaccccgtttaaccgggtttacccgttttaaaccgggtttttaccggggaacccgggtttaccggggtaaacccgggtttaacgggggtaacgggttaaaccggttaaccggttaaaccccgggtaaaaccggtttaaacccgttacgggtttacccggtaacccggttaccggtaacccggttaaccgttacccgtttaaccgg

SEQ ID NO: 212066 - DNA, 745 bp, Homo sapiens
  misc_feature: GYAE6OF02IW22O.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatcctcctgcaggtctagtagaaagcctcgtacacgttgataggaaactacctacttagaattggattcagcaggacggccgaaggaccaatctaccgaaacggtccgacccttaaattttagttaaacggtttacgtaaaccgggtacttacgtcgggggttacccaagtaccgaagtacttacgaacggcggtacgaggttcggggtctaggaccgtacgttaggtaacttttaccgaacgtaccgtacgtaaccgtaaagttccgaacggtaccggtaagggggtacgggtaacggggtaccgttaaggggaacgggttaacggtttaggggtttttacgggttttttaagttaccgttcgtaaccgttaagttacgtaactaaaccgtttcgtaaccgtaacgttccgggtcccttaccgtttacgttaccgttttacgggacgtaccggggtaaccgtaagggtacggtaagtacgtaacgtaaaccgtaagttacggtacggtccgtacggacctaccgtagttaccg

SEQ ID NO: 212067 - DNA, 594 bp, Homo sapiens
  misc_feature: GYAE6OF02ID4K5.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagcccggcctccatcctcctgcaggtctagtagaaacgccttcgtacacgtttgattggaaaccacctacttgaattggattcagcagaggccaggccaatccgtccgaaggcgaccttaatttataaggtttcaaccggatcgtcggggtccagacagattcagcggcaggtcggtctggactacgttgtactttcgactactagactaatcagcgagggtaggaggtcgtggaggtagttggttttggttttatcgttagctagtgtactaacttcgaactacgtcgtaccttcccgttcttaccgttttacggccgtacgggtaccgtagggtacggaacgtacgtacgtaaaccgtacgttcggtacgtacgttacggacacctagttcg

SEQ ID NO: 212068 - DNA, 705 bp, Homo sapiens
  misc_feature: GYAE6OF02GQ09C.43.86.H09.1.454.CMB.1.raw
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagctgggttttcctcgttgtctcttttaagaggtgtccagtgtcaggtgcagctggtggagtcgtgggggagacgtggtccagcctgggaagtccctgacactctcctgtgcagcctctggacttcaccttcaataattatggccagtgcacgtgggtccgccaggctcgtggcaagggctaggagtgggtgcacttagtatcatcgtagagtcggaaagtagaaaagttcgtaacgccgtaagtaacccgttaccggtaggaaacggggtcccgtaaacgttaccgaacccgtaacttaccgtacccggaacgggtaaaccgtaaacgtttaaccgaaacggtaccgtacctaaccgttaccttaggttaaccttctaccggtaacctaaaacgtacggaaacctacggtacccgttacgaaaccgtaacccgtaggaacgggtacggaaccggtaccctttaaggttttaactttaccggttaggttaccggtacgggaacggtacgggtaaccggtacgggtttacggggggtacgttacccgtttaaccccggg

SEQ ID NO: 212069 - DNA, 590 bp, Homo sapiens
  misc_feature: GYAE6OF02GRUBK.43.86.H09.1.454.CMB.1.raw
  modified_base (308)..(308): a, c, t, g, unknown or other
  misc_feature (308)..(308): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgcgtcccaggatccggtgggggatgttgtgatgactcagtctccactctccctgcccgtcacccttgggcacgccgcctccatctcctgcaggtctagtagaaacgcctcgtacacgttgatggaaacctacctacttagaattggattcagcagaggccaggccaatctccaaggcnccttaatttataagtttctaaccgggctcgtcgggtacccagacagtattcgagcggcaggtcgggtctggcacgtgtacttttacactactgaacaatcgaagcgagggtggagcgtaggaggtagttggtttggtttattacgtgtactagtgactaactcgaactacgtcgtacctccgttacttcgtttacggaccgtacgggtaaccggtaagggtacggtacgtaagtaccggtaaacgtacggttaggtcggtaccgtcgtaccgtaccgtaacg

SEQ ID NO: 212070 - DNA, 607 bp, Homo sapiens
  misc_feature: GYAE6OF02H2C58.43.86.H09.1.454.CMB.1.raw
  modified_base (256)..(256): a, c, t, g, unknown or other
  misc_feature (256)..(256): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacncctacttgaattggattcagcagaggccaggccaatcctaccaaggcgtaccttaaatttataacggttttccaaccgggtactcgtcggggtacccagtacagtattcgaacggcggcaggtgggtactgggactacgtgtatttcaactactagacaatcgagcgagggtggaggctggaggtagttggtttagggttttattacgttagtctagtcgtacctaaacttcgaactacgtcggtccttccgttactacgttttcggaccgtacgggaccgtaagggtaggtagacgtaaccgaaacggtaacgttggtacggtaccgtacggtaccgtacctagttaccg

SEQ ID NO: 212071 - DNA, 603 bp, Homo sapiens
  misc_feature: GYAE6OF02FN5LE.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatcctcctgcaggtctagtgaaacgcctcgtacacgttgataggaaacacctacttgaattggattcagcagaggccaggccaatcctaccaagggccgtacctaattttataacggtttctaaccgggtactcgtcggggtcccagacagtacttcagcggcaggtgggtcgtggctacgtgtatttccactactgaacatcagcgagggtggaggtcgtaggaggtagttggtttagggttttagttacgtgtacgtagtgtactaacttccacgtacgtcgtcccttccgttacttaccgttttcgggaccgtacggggtaccgtagggtcgggaagtacgtaaccgtaacgtaacgttggtacggtacgtacgtcctacgtattaccg

SEQ ID NO: 212072 - DNA, 584 bp, Homo sapiens
  misc_feature: GYAE6OF02FPD6A.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactcgtggggtcccagacagattcagcggcagtgggtctggcactgactttcacactgacaatcagcagggtggaggcgtaggaggtagttggtttgggtttttattacgtgtctagtgtacaaacttcactacgtcggtcccttccgttcctacgttttcggaccggtacggggtaaccgtaagggtgggtaacgtacgtaacgaaaccggtaacgttacggtcgggtaccgttacggaccctacctagttaccg

SEQ ID NO: 212073 - DNA, 556 bp, Homo sapiens
  misc_feature: GYAE6OF02HAZE7.43.86.H09.1.454.CMB.1.raw
  modified_base (363)..(363): a, c, t, g, unknown or other
  misc_feature (363)..(363): n is a, c, g, or t
  modified_base (386)..(386): a, c, t, g, unknown or other
  misc_feature (386)..(386): n is a, c, g, or t
  modified_base (416)..(416): a, c, t, g, unknown or other
  misc_feature (416)..(416): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccgcctccatctcctgcaggtctagtgaaagcctcgtacacgttgatggaaacacctacttgaattggattcagcagaggccaggccaaagtctccaaaggcgacctaaattttataaggttttcaaaccgggctcgtggggtcccagacagattcagcggnagtgggtctggcactgatttcanactgacaatcagcagggtgaggctggaggnttgttgggttttattacgtgctatgactaaacttcaactactcggtccttccgttctacttttcgggacctaggggacctaagggtggaacgtaactacgaaacgtaacgttcggtaggcttacggactaccgtattccg

SEQ ID NO: 212074 - DNA, 750 bp, Homo sapiens
  misc_feature: GYAE6OF02JJ1PI.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctgggctgctaatgctctgggtcccaggatccggtggggatgttgtgatgactcagtctccactctccctgcccgtcacccttgggcagccggcctccatctcctgcaggtctagtgaaacgcctcgtacacgttgataggaaacacctattgaattggattacagctagacggccaggccaaactctaccgaaggccgacttaatttaacgtaacggtttactaaccgggtactcgtcggggtcccagacagtatccaaggcggcgtaggtcgggtactcgggactacgttgttacttaccgacgtacgtagaacctaacgttacgacggaccggtaggggtcggggaaacgggttccggtaagggaacgggtttaacggtttcggggtttttacgggtttttaagtttaccgtggtaccgtacgtttacgaaacccgttaaacctttaccgaaccctaccgggttaccggttacccgtttacccggttttactaacccgggtttttccgggtacccgggtaagggggtacccgtaaacggggttcgggtaaaccgttaaccgtaaccgggttaaaaccgttacccggttacgggttacggtacccgttaaccggacccgttaccgtacggttacccg

SEQ ID NO: 212075 - DNA, 599 bp, Homo sapiens
  misc_feature: GYAE6OF02HCX6U.43.86.H09.1.454.CMB.1.raw
  modified_base (219)..(219): a, c, t, g, unknown or other
  misc_feature (219)..(219): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtggggganacgtggtccagcctgggaacgtccctgacactctcctgtgcagcctcgtggattcaccttcaaataattatggacatgcacgtcgggtccgccaggcctccgtggacgaaggggctgggagtggggtgctacttatatcatctgatgggaagtagaaagtactacgcacggactcgtaggacgggccgtacttacacctactcctacgacgggaactaattacgaacgcgacacttctgtactcgtacgactaagtacgaacgacgaccgtacgaaccgtaccgtaggacggacgtacggtactttaacgtttaactttacgtaggttacgacggacggtacggtaaccggtagggttacgggggtacgttacgtaccgg

SEQ ID NO: 212076 - DNA, 674 bp, Homo sapiens
  misc_feature: GYAE6OF02H0QVA.43.86.H09.1.454.CMB.1.raw
  modified_base (419)..(419): a, c, t, g, unknown or other
  misc_feature (419)..(419): n is a, c, g, or t
  modified_base (460)..(460): a, c, t, g, unknown or other
  misc_feature (460)..(460): n is a, c, g, or t
tcagtgtgagtagtcacgaccggtgctcgatttagtgctatagacttgggtttggggactgatcaggactcctcagttcaccttctcacaatgaggctccctgctcagcctccgtggggctgctaatgctcgtgggtcccaggcgtcggtggggatgttgtgatgactcatctcactctcctgcccgtcacccgttgggacacgccggcctcactctccgtgcgagtctagtagaacgctacgtacacgttgaagtaggaaaacctcctaacgttagtaagttggacttacgagcgacggacggaccacggacccaacgttccgaccggaaagtccgtaacctttaaagtttaactacgggttttaccaaaccggggtctcgggtaccgggtaccaaggactacgtactcgacggacgngtaggttcgggtacgcgtaactagtactacttacgaacctntacggaactaagtcgacggtacgaggggtaggaacgtcgtaaggagttagtttagggtttgttttagtacgtgtatacgtagtaacctaacgtacaacgcgtaccgtccgttactacgtacgtttacgacggtacgggaacgtaggtacggtagaacgtaacgtaaacccgtaagttccggtaggtactaacggtcccgtacgtaacgttaccg

SEQ ID NO: 212077 - DNA, 699 bp, Homo sapiens
  misc_feature: GYAE6OF02GGXG5.43.86.H09.1.454.CMB.1.raw
tcagtgtgagtagtcacgaccggtgctcgatttagtgctatagacttgggtttgggggacgtgatcaggactcctcagttcaccttctcacaatgaggctccctgctcagctcctggggctgctaatgctctgggtcccaggatccggtggggatgttgtgatgactcagtctccactctccctgcccgtcacccttgggcacgccggcctccatcctcctgcaggtctagagaagcctcgtacagttgataggaacacctacttgaattggattcagtcagagaccaggaccaatctacaaggcacctaatttataacggtttactaaccgggtactcgtacggggtccagtacagaacttcaagccggactaggtcgggtctaggcgtacgttacgacgttttacaacgtcctagtaactaagtaccgtacgacgacggggtaggagggtccgtaggaagggtaagtttcgggtttagggttttaactttacgtcggtactagttacgggtactaaaccgtttctaacgtaccgttagggtacccttaccggtttacttaacccgttttagggacccggttaacgggggtaacccgtaagggggttacggaaacggtaccggtttaaaccgtaaaacggttaaccggttacgggtaccgggtacgttaccggaaccccttacgtaacgtttacccgg

SEQ ID NO: 212078 - DNA, 622 bp, Homo sapiens
  misc_feature: GYAE6OF02HZ2S7.43.86.H09.1.454.CMB.1.raw
  modified_base (171)..(171): a, c, t, g, unknown or other
  misc_feature (171)..(171): n is a, c, g, or t
  modified_base (270)..(270): a, c, t, g, unknown or other
  misc_feature (270)..(270): n is a, c, g, or t
  modified_base (370)..(370): a, c, t, g, unknown or other
  misc_feature (370)..(370): n is a, c, g, or t
tcagtgtgagtagtcacgaccggtgctcgatttagtgctatagacttgggtttgggggactgatcaggactcctcagttcaccttctcacaatgaggctccctgctcagctccgtggggctgctaatgctcgtcgggtcccaggatccgggtggggatgttgtgatgactnagtctccactctccctgcccgtcacccgttggcagccgcctccactctctgcgtaggtctagtacgaaacgtcctacgtacacgttgagtacgaaaccncttatagattgatgagcagagccgtagaccaatcctacgaaggctactttaattagtaacggttcgaacgggtctcggtacggccagacagtctgagcgngtaggtggtctggactagtcgtatcactatagtaacagtcgtagcgagggtacggaggtcgtaggtaggttagttggttttaggtttaactcgtagactagtacgtaactaacgttacaacgtcgtaccgtccgttaccgtttacgtacgtttacggaccggtaacgggtaacgtaacggggtaggaaacgtacgtaaaccgtaaacgtcgttacggtacggtacgtaccggtaactaccgtaacgttaccg

SEQ ID NO: 212079 - DNA, 727 bp, Homo sapiens
  misc_feature: GYAE6OF02JDBFE.43.86.H09.1.454.CMB.1.raw
  modified_base (141)..(141): a, c, t, g, unknown or other
  misc_feature (141)..(141): n is a, c, g, or t
  modified_base (168)..(168): a, c, t, g, unknown or other
  misc_feature (168)..(168): n is a, c, g, or t
  modified_base (720)..(720): a, c, t, g, unknown or other
  misc_feature (720)..(720): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggntccgggtggggattgttgtgatgactnagtctccactctccctgcccgtctacccgttgggcacggccggcctccatcctcctgctaggtctagtcgaaacgtcctggtactacggttgaagtacggaaacctacctacttgaaagttggaattcaagtcaaggacggccgacggtaccaaagtcctacgaaacggtccgtaaccgtttaaatttaaggtaaccggttttaaccgtaacccggggtacttcggtaccgggggtaccaagtaccgaagtacttacgagccggtactagggttcggtacgtggaactcgttagttacttcaaccgtacgtacgtaacgtaactacgaacggtaccggtaaggggtaggtaacgggtctagggaacggttaggtttcgggttttaaggttttaactacggttagtacgtagttacgtaaccttaaaccgttcgaacgtccggttaccggttccttccggtttactacggtttcggaacggtacgggtaaccggtaagggtacgaacggtacttaaccgaaacgtagtacgtacgggtcttacgccgttaacncgttacg

SEQ ID NO: 212080 - DNA, 558 bp, Homo sapiens
  misc_feature: GYAE6OF02FMW2D.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgacctaatttataaggtttctaaccgggactctcgggggtcccagacagattcagcggcagtgggtctggcactgatttcactactgaacaatcagcgagggtggaggcgtaggaggtagttggtttgggtttttaattacgtgtactagttcgactaaacttcacgacgttcggtccttccgttctacgttttcgaccgacgggaccgaagggtcggaagatacgaaacgacgtggtacggctgcgtaccattcg

SEQ ID NO: 212081 - DNA, 634 bp, Homo sapiens
  misc_feature: GYAE6OF02G6NKC.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacgtacttgaattggattcagcagagccgaggccaatctccaaggccgacctaatttactaaggtttacctaaaccgggtactcggtcggggtacccagtacagtattcgaacggcgtacgtaagtgggtccgtagggcacgtggtactttccaacgtatacgaacaattacagcgaagggtggaaggtcgtggtaagggtaacgttgggtttaggtttacttacgtagtcgaagtcgtaaccgtaaacgttcaaaccgtccgtacgggtaccctttccggttacttaccgttttacggcccgtacgggacccgtaggtaacgggaagtaacgtaacgtaaacggtacttagggcgtacgtcgacctacgtacttacgg

SEQ ID NO: 212082 - DNA, 611 bp, Homo sapiens
  misc_feature: GYAE6OF02JC3PM.43.86.H09.1.454.CMB.1.raw
  modified_base (371)..(371): a, c, t, g, unknown or other
  misc_feature (371)..(371): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgcgtcccaggatccggtgggggatgttgtgatgactcagtctccactctccctgcccgtcaccttggcagccgcctccatctcctgcaggtctagtgaaacgcctcgtacacgttgatggaaacacctacttgaattggattcagcagacggccaggccaatcctaccaaggcgaccttaaattttacgtaaggtttactaaccgggactcgtcgggtacccagacagattcgaggcgganaggttggtctggactacgtgtactttcacactgaacatcgagacgagggtggacgcgtaggaggttagtttggtttaggttttacttagtcgactagtacgtaccttaacttacgactacgtcggtacccttccgtttaccgttacgttttccggaccggtaacgggtaccggtaagggtaggacgtaacgtaaccgtaaacggtacgttaggtaccggtactacggtacctacgttacg

SEQ ID NO: 212083 - DNA, 701 bp, Homo sapiens
  misc_feature: GYAE6OF02GKX95.43.86.H09.1.454.CMB.1.raw
  modified_base (321)..(321): a, c, t, g, unknown or other
  misc_feature (321)..(321): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtgggggagacggtggtccagcctgggaagtccctgaccactctcctgtcgcagcctcgtggtacttccacctttcaaattaattatggctatgcctacgtcggggtcccnccgaggcctccgtgggcgaagggggctgggtaggtggggtggcctactttatataccattcgtaggagttacgggaaaagttaacggaaaacggtttacctaaccgggaccgtaaacggtacccgttacccgggtagggaaaccggggtcccgtaacttacccgaaccctaacgttccgtaccgtaacgggtaaacctaaacgttaaccgaacggtccgacgtaccgttcgtagttacgtactacggaactaaacgtacgaaaccgtcgaccgtacgaacctaccgagggaacggacggtacggttacgtttaatttacgttaacgtggtacgacggacggaggtacggtagggttacgggggtacgtacgttaaccggg

SEQ ID NO: 212084 - DNA, 662 bp, Homo sapiens
  misc_feature: GYAE6OF02H3CRS.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctctgcaggtctagtgaaacgcctcgtacacgttgataggaaacacctacttagagttggattcagcaggacggaccaggaccaaatcctaccgaaggccgtacctttaaatttacgttaaacggttttacgtaaccgggacttcgtacggggtacccagacagtatcgagcggcgtagtgggtctgggctagtagtatttccaactacgttagaactaaatcgaacggtacgagggggttagggaacggcttagggaagttagttgggtttttaggttttatacttgactagtgaactaaaaccgttccaacttaccgtcggttccctaccggtttacttaccgttttacgggacccggtacgggggacccgtaagggttagggtaacgtacgtaacgtaaaacggtacgtaggttacgggccttacggacctaccggtactttacgg

SEQ ID NO: 212085 - DNA, 579 bp, Homo sapiens
  misc_feature: GYAE6OF02G43O7.43.86.H09.1.454.CMB.1.raw
  modified_base (450)..(450): a, c, t, g, unknown or other
  misc_feature (450)..(450): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagctgggttttcctcgttgctcttttaagaggtgtccagtgtcaggtgcagctgggtggagtcgtgggggagacggtggtccagcctgggaagtccctgacactctcctgtgcagcctctggattcaccttcaataattatggcatgcacgtgggtccgcaggctccgtggcaaggggctgggagtggggtggcacgtttagtatcatctgatagggaagtagaaagtactaacgcagtaccgtcgtaggaacgggccgattcacctatcctaccgagggacaagttacgaagcgacactctntatctacgactaatacgaacacgtacctagacctaccgtgaaggacggacggtacgttaattttaacgttacgtagttaggaccgtaggaacggacggttaggggtacgggggtactaccgttaaccgg

SEQ ID NO: 212086 - DNA, 948 bp, Homo sapiens
  misc_feature: GYAE6OF02JFLC7.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctccgtggggctgctaatgctcgtcgggtcccaggacgtccgggtggggtattggttgtgatgactcagtcctccactcctccctcgcccgtcacccgttgggcacggccgcctcactcctcctggcctaggtactaggtacgaaacgtcccgttacggtaacgtacggttagaacgtaacggtaaacctaccttaacgttaacgtaagttacggtacttcgggaacgtaccgaagggtacccgaacggtaccgggtaaaccctaaaggttccccctaaaaccggtaaccgggtacccgtaaaaccggtttttaaactttaaaccgggtttaaaaccggtttttaaccccgggaaaaacccggggtttaccttaaccggggggttaccccggggtaaacccgtaacgggtaaacccgtaaggttaacccgttaacggtaacgggtccggaaacggttacggggttaccgggttacggtacggggtaccttaacggtaccggtttaacgttaaccgaaccgttacgtaaccggtaactaacgtaccggtaacgtaccgggtagggtacgggacgggttacgtaagggtaacggttaggtttacgggtttttaacggtttacgttaacggttacgtaaccgttaagggttaaccgtaaacgttaaccgttacctaaaccgttccgggtacccggttaccgtttaccggttaacctttaccggggtttaccgaaccggggttaaccgggaaccggttaacggggtaacggtaacggtaaccgtaaacggtaaccgttacggttacggtaccggttacgtaccgaccgttaacgtacgttacgg

SEQ ID NO: 212087 - DNA, 584 bp, Homo sapiens
  misc_feature: GYAE6OF02HIGXV.43.86.H09.1.454.CMB.1.raw
  modified_base (393)..(393): a, c, t, g, unknown or other
  misc_feature (393)..(393): n is a, c, g, or t
  modified_base (452)..(452): a, c, t, g, unknown or other
  misc_feature (452)..(452): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagacggtggtccagcctgggaagtccctgacactctcctgtgcagcctctggattcaccttcaataattatggcatgcactcgggtccgccgaggcctccgtggacgaaggggctgggaggtggggtggcacttagtatcatctgatggaagtaagaaagtactacgcagactccgnggaagggaccgtattacacctactctaccgagggaactaaacttacgaacgcgcacctntagtatctagaccaaatagaacagccgtacgaccacgtacggagacggaccgtacgttaatttacgtttacgttacgtacgtacggagaacggtacggtacgggttacggggggtacggtacgttaacccgg

SEQ ID NO: 212088 - DNA, 819 bp, Homo sapiens
  misc_feature: GYAE6OF02HU5IN.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccgttgggcacgccggcctccatcctcctgcaggtctaggtcgaaagccttcgtacacggttgatggaaaacctccttacttgaattggattcgagcaggacggaccgaggaccctaattcctaccgaaaggccgtaccttttaaaagttttaacgtttaaaccggggtttttaccgtaaaacccgggggtacctttaccgggttaccgggggtaccccaaaggtaaccgaacggtaactttccgaacgggtcggaccgtaagggtttcgggggtcctacgggaccgtacgtttacggttacttttaccgaaccgttacgtacggtaaacaaacgttaccggaacggtaccgggtaaggggttacgggaaacgggtccgttaaggggaagggttacggtttagggttttttacggggtttttaaatttacccggtagtacgtaacggttaacgtaaccgttaaaaccgtttacgaaccgttaaccggttccggtaccccgtttcccggtttaacgttaaccgtttttacgggacccggtaacgggggtaacccgtaaggggtaacggtaacgtaacgtaaccgtaaaacggtacgttcggacggtactacggacctaccgtagttccg

SEQ ID NO: 212089 - DNA, 621 bp, Homo sapiens
  misc_feature: GYAE6OF02HPP2F.43.86.H09.1.454.CMB.1.raw
  modified_base (246)..(246): a, c, t, g, unknown or other
  misc_feature (246)..(246): n is a, c, g, or t
  modified_base (315)..(315): a, c, t, g, unknown or other
  misc_feature (315)..(315): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagacgtggtccagcctgggagtccctgacnctctcctgtgcagcctgtggtacttcaccttacaaattaattatggacagtgacacgttcgggtacccnccgaggcctccgtggcgaaggggctgggaggtgggtacggctacttagtactacgatcgtaggactagggaagttaacggaaacgttacgtacgacgtaacgtacccgttacggtaggaacgggtaccgtaattccaacctatccgaccgtaaggaactaaactaccgaagccgactaccgtctagtactcgtagactaaacgtacgaacgacgccgtacgtaccacgtacggagacgtacgtacgttattacttacgtcgtacgtacggacgtacgtacggtaggtacggggtactcgtaaccgg

SEQ ID NO: 212090 - DNA, 787 bp, Homo sapiens
  misc_feature: GYAE6OF02HM3U4.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttggcacgccggcctccatctcctgcaggtctagtagaaacgtcctcgtacacgttgataggaaacctaccttacttagtaagttggattacagcaaggacggccaacggaccaactccgtaccgaagggtcccgtacctttaaaagttttaacgtttaaacgggttttaccgtaaaacccggggtacttaccggttaccgggggtaccccaaaggaactaaacggtaacgttaccgaagggccgggtacgtaagggtcggggttaccgtagggaccgtaacgttaggttaacttttaccgaaccgtaaccgttacggaaaccctaaaagtccgtaaaggaccggtaaggggggttacgggaacgggtacgttagggtaaacgggttagtttagggttttttacggggtttttaaatttaccgtaggtaccgtaagttacgaaaccttaaaccttcgaacgtaccgtcggttaccccttcgtttaccgtacgttttccgggaccggtaacggggtaccgtaacggggtagaaccgtaataaaccgtaaaaccgtagtcggttacggaccgtacgtacccgaccgttagttaccg

SEQ ID NO: 212091 - DNA, 751 bp, Homo sapiens
  misc_feature: GYAE6OF02I0O66.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccgggtggggatgttgtgatgactcagtctccactctccctgcccgtcacccgttgggcagccggcctcatctcctgcaggtctagtgaaacgcccttcgtacacgttgattacggaaaacctaccttacttagaagtttggattcagcaaggacggcaaggccaagttcctaccgaaggccgtacctttaaagtttaagttaacgggtttaccgtaaacccggggcttaccggtacgggggtacccaagaccgaagtacttacgaggtccggacgtagggttcggtacgtggactacgttggtactttaccgaactacgtacgaactaacgtcaaggtacggtaaggggtcgggaacgggtcgtagggtaacgggttagtttagggtttttacgggtttttaacgttaccgttagtaactaagttacggtaaaccttaaaccgttaccgtaaccgttacggttaccggttcccgtttacccggtttaccgtttaccggttttaccgggaacccgggttaacggggaacccgtaaggggttaacggacggtaacgtaaccgaaacggtaccgttagggtcggtacgttccgaaccgtacctacgttccg

SEQ ID NO: 212092 - DNA, 715 bp, Homo sapiens
  misc_feature: GYAE6OF02IRUK9.43.86.H09.1.454.CMB.1.raw
  modified_base (161)..(161): a, c, t, g, unknown or other
  misc_feature (161)..(161): n is a, c, g, or t
  modified_base (219)..(219): a, c, t, g, unknown or other
  misc_feature (219)..(219): n is a, c, g, or t
  modified_base (248)..(248): a, c, t, g, unknown or other
  misc_feature (248)..(248): n is a, c, g, or t
  modified_base (290)..(290): a, c, t, g, unknown or other
  misc_feature (290)..(290): n is a, c, g, or t
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagctgggttttccncgttgctcttttaaagaggtgtccagtgtcaggtgcagctggtggagtcgtggggganacgtggtccagcctgggacgtccctgacnctctctgtgcagcctctggacttcaccttcaaagttaattanggctatgcacgtggggtcccgcgaggtcctccgtggacgaaggggctgggngtggggtgcacgtttanacgtcaagtcttagagtagggtaaagtaagaaaaggttacctacgggacaacggtacctaccgggtaggtaaacggggacccgtaacgttacctaacccgtaacttccgtaccgaacgggtaacctaaacgttaaccgaaacggtcccgaccgtaaccgttaccgtttagtaaccgttccgtacgtaaacgtaaaacgttacggaaacctaaccggtaccctaacggaacctaaccgtaggaacgggtacggaaccggtaaccgtttaagttttaaccgttaacgttcgttaacggtacgtaagggtaacggtaaccggttaaggggttaacggggggtacttacggttaacccggg

SEQ ID NO: 212093 - DNA, 564 bp, Homo sapiens
  misc_feature: GYAE6OF02F0VUE.43.86.H09.1.454.CMB.1.raw
  modified_base (292)..(292): a, c, t, g, unknown or other
  misc_feature (292)..(292): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagagcaggccaatcnccaagcgacctaatttagtaagtttctaacgggctcgtcggggtccagacagattcgagcggcagtggtctggcagtgtatttcactactgacaatcaggcgtagggtggaggcgtaggacggtagttggtttagggttttattacgtgtctatgactaacttcactacgtcgccttcgttaccgtacgtttcggaccgtacgggacgtaagggtggaacgtacgtaacgtaaacgtaccgtaggtacggtcgtacgcctaccgtacttccg

SEQ ID NO: 212094 - DNA, 592 bp, Homo sapiens
  misc_feature: GYAE6OF02FMQEZ.43.86.H09.1.454.CMB.1.raw
  modified_base (280)..(280): a, c, t, g, unknown or other
  misc_feature (280)..(280): n is a, c, g, or t
  modified_base (418)..(418): a, c, t, g, unknown or other
  misc_feature (418)..(418): n is a, c, g, or t
  modified_base (478)..(478): a, c, t, g, unknown or other
  misc_feature (478)..(478): n is a, c, g, or t
tcagtgtgagtagtcacgaccggtgctcgatttagtgctatagacgttgggtttggggactgatcaggactcctcagttcaccttctcacaatgaggctccctgctcagctcctggggctgctaatgctctgggtcccaggatccggtggggatgttgtgatgactcagtctccactcctccctgcccgtcacccttgggcagccggcctcatctcctgcaggtctagtgaaagcctcgtacacgttgatggaaacacctactgaattggattcagcagnggccaggccaatctccgaaaggtccgaccttaaagttttagtaaaggtttcctaaaccggggtctcgtcggggtcccaagacagtaacttcgaagcggtacaggtcgggtctagggcactggatttcactactacganatacagcgtaggtggagcgtggaggtacgttggtttagggttttattacgtgtactagtnacgtaacttcactacgtcgtaccttccgttactacgttttcggaccgtacgggacgtaaggtggtaacgacgtacgtaaacgtacgtacgtcggcgtcgacgtacctattaccg

SEQ ID NO: 212095 - DNA, 719 bp, Homo sapiens
  misc_feature: GYAE6OF02H6KJG.43.86.H09.1.454.CMB.1.raw
  modified_base (223)..(223): a, c, t, g, unknown or other
  misc_feature (223)..(223): n is a, c, g, or t
  modified_base (443)..(443): a, c, t, g, unknown or other
  misc_feature (443)..(443): n is a, c, g, or t
  modified_base (713)..(713): a, c, t, g, unknown or other
  misc_feature (713)..(713): n is a, c, g, or t
tcagtgtgagtagtcacgaccggtgctcgatttagtgctatagacttgggtttggggactgatcaggactcctcagttcacttctcacaatgaggctccctgctcagctcctggggctgctaatgctctgggtcccaggatccggtggggatgtttgtgatgactcagtctccactctccctgcccgtctacccgttgggcaggcccggcctccgatctccgngcgtaggtctagtacgaaacgcctacgtacacgttagtagtacggaaacctaccgttacttagtaattggattccagacgaggacggaccgaaggccctaaagtcctaccggaagccgtaacttaagtttagtaacggtttaccgaaccgggtacctcggtaccgggggtcccaggtaacgaagtactttcgaggtacggacctagggttacgggtccgnggtacctaacgggtcgttactttaccgaaccgtaactacggtaacctaacgtacgaacggtaccgggtaaggggtacggggtacggacggttagggaggttaacggttagggttttttacggggtttaattaccgttagactagttacgtaacctaaacgtttcaacgtccgtacgtccttccgttactacgtttcggaccggtagggaccggtaaggtcggaacgtagtaaccggtaaacgtacgtggtcggacgtacggactaccgtnttaccg

SEQ ID NO: 212096 - DNA, 572 bp, Homo sapiens
  misc_feature: GYAE6OF02GV6LR.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctcaaggcgactaatttataaggtttcaaccggtactcgtcggggtcccagacagattcagcggcagtgggtctaggctactgtatttcactactgaacaatcagcgagggtggaggcgtgagggtagttggtttgggttttattacgtgctagtgtacgtaaacttcactacgtcggtcccgttccgtttacgtacgttttcggaccgtaggggaaccgtaagggtggaacgtagtaacgtaaacgtaacgtggtacggacgtcgactaccgtattacg

SEQ ID NO: 212097 - DNA, 647 bp, Homo sapiens
  misc_feature: GYAE6OF02HG34R.43.86.H09.1.454.CMB.1.raw
  modified_base (425)..(425): a, c, t, g, unknown or other
  misc_feature (425)..(425): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccgttgggcagccggcctccattctcctgcaggtctagtgaaacgcctcgtacacgttgatacggaaacctaccttacgttgaatttgggactttaccaggcaaggacggcccggacgaacgtactccgaacggacgtaccgtaatttaagtttaggtttacgttaaccggaccggtcgtcgggtaccgacacgagacgtacacgacggccgaggtggtcgtcgcgtactagtnttactacacgtcaagtaactcgagacgagggtaggtaggcgtggaggtaggttggttttaggttttacggttttaacgtcgtacgttagagttaccgaaacttacctacgtacgtacggttcccgttaccttccgtactttacggtccggacggtacggacggttaggtacgacgtacgaaacgtaacgtacggtgtcgtgaccgtactacgttcttaaccg

SEQ ID NO: 212098 - DNA, 659 bp, Homo sapiens
  misc_feature: GYAE6OF02GPCHX.43.86.H09.1.454.CMB.1.raw
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagacgtggtccagcctgggaagtccctgaccactcgtcctgtcgcagcctctggattccacctttnaaattaattntggctatcgcacgtgggtccgccgaggtcctccgtggtacgaagggggtcctagggaggttaggggtcggacgtaaccgttagttacgtaccatcgtagtacggtaggtaaacggtaagaaaacggttacctacgacgtacggaactccggtaggaacgggtcctacttaccaccagtacctaccggaaggaaccaacgttaacaacgcgacaccgttctacgtacgtactcgaactaaacgtacgaaaccgacgacctacgaccgtaacgtcgaagggacgtaccggtaacgtttactttattaacgtggttaccggaggtaacgtacggtaacggtagggttacgggggtacttaccgttaccgg

SEQ ID NO: 212099 - DNA, 801 bp, Homo sapiens
  misc_feature: GYAE6OF02J2D26.43.86.H09.1.454.CMB.1.raw
  modified_base (141)..(141): a, c, t, g, unknown or other
  misc_feature (141)..(141): n is a, c, g, or t
  modified_base (794)..(794): a, c, t, g, unknown or other
  misc_feature (794)..(794): n is a, c, g, or t
tcagtgtgagtagtcacgaccggtgctcgatttagtgctatagacttgggttggggactgatcaggactcctcagttcaccttctcacaatgaggctccctgctcagctcctggggctgctaatgctcgtgggtcccaggnttccggtgggactggttgtgatcgacctcacgttcctaccgacttcctccctgcccgtactacccgttgggcctacgcccggtccttccgattccgtccttgaccgtacggtctaaggtcgaacgtcccttagtacgtacgttgaactaacggaacctaccgtactttagagtttcggaattcgacgtcgacggacgtcccgaggtacctaacgttccgtaaccgaacggtcccgtaaccgtttaagtttaacgtaacggttttccggaaaaccggtccttaccggtacgggggttaccccaacggtaacctacggtacgttaccgaacggtccggtacgtaaggttccggtcgtacggacgttactcggtaacttccaaccgtctaacgactaaccgttcgaaacgggtcgttacggggtacgacggtacgtacggtaacggtacgtttacgggttttaggtttaccgtacgttccggtaacgtaccgttaacgaaccgtttaacctacgtaaccgttacggttccggtaacccgtttccggttacgttaccggtttaccgggtaccgtaccggggtaaccttacggggacgtttaaccgaagtaaccgttaaccggagtttcgggactacggttccggacccttaacggtntaaccgg

SEQ ID NO: 212100 - DNA, 758 bp, Homo sapiens
  misc_feature: GYAE6OF02JV4B5.43.86.H09.1.454.CMB.1.raw
  modified_base (219)..(219): a, c, t, g, unknown or other
  misc_feature (219)..(219): n is a, c, g, or t
  modified_base (262)..(262): a, c, t, g, unknown or other
  misc_feature (262)..(262): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagcgtgggttttcctcgttgctcttttaagaggtgtccagtgtcaggtgcagctggtggagtcgtggggganacgtggtccagcctgggaagtcctgacacgtctccgtgtgacncgcctctggacttcaccttnaattaattagnggcatgacacgtcgggtcccaccgagtcctccgtgggaccgtaacgggggctagggtacggtcgggggtacggacttaccgttaagttactccgtaattccgtaggtaagttaaggggtaaaaggttaaacggaaaacgtttacgttaaccggacgtaaaagttcccgtaccggtacgggaaacgggacccgttaatttacccgaacttacgttacccgtaacggtaacggggaaacttaaacgttaaccgaaacggtccggtaacctaccgttacgtacggttaactttaccgtaaaggtacctaaaacgttacgaaaccgtaacgtacccgtacgaaaccgtaccgtaacggacggtaacggccggtttaacttaacgtttttaagtaccgttaggtaccgtaaggtaacggtaacgggtaaccgggtaggggtttacgggggacgttaccgtttaacccggg

SEQ ID NO: 212101 - DNA, 679 bp, Homo sapiens
  misc_feature: GYAE6OF02GKYEG.43.86.H09.1.454.CMB.1.raw
  modified_base (252)..(252): a, c, t, g, unknown or other
  misc_feature (252)..(252): n is a, c, g, or t
tcagtgtgagtagtcacgaccggtgctcgatttagtgctatagacttggggtttggggctgggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagacgtgggtccagccgtgggaacgtccctgaccnctctcctgtgcagcctgtggattccaccctttacaaattaattagtaggctagtcgacgacgtcgggtacccgccgacggtcctccgtggacggaaggggcgtagggaggtgggggtcgacgtacgttaattacgtcattcgtagtacgttaagggaaagtaaacgtaaaggtactaccggacgtaaggtacctacggtaggaacgggtaccgtattctactactataccgtaccgaggaaccctaaattaaaccgacgtaccgcctaacgtcttagttaacgtctacgaactaaacgacgaaacacggtacctacgaacctaccgtacggaggacggtaacgtcgtttaatttacgtttaacgttacgggtacggtacgggtaacggtaacgggtacgggtacgggttacgggggtacgttaccgg

SEQ ID NO: 212102 - DNA, 842 bp, Homo sapiens
  misc_feature: GYAE6OF02HTH25.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctcccgtgcccgtcacccgttggcacgccggcctccatcctctgcagtctaggtgaaacgtcctacgtacacgttgacgtaggaaaccacttacttgaaacgtttggacttacgagtaccaaggtaacggcccgaacggtacctaaaacttccgtaacccggaaaggggtcccgtaacccgttttaaaagttttaaacgttaaacggggttttaccgtaaaacccggggttttacctccgggttaaccgggggtacccaaggtaaccgtaacgttacgtttaacgacggtaccggggtacgtaacgggtcggggttacccgtgggaaccttacccggtaggttacctttaccgaacccgtaacgtacgaacctaaacgtacggtacggtaccgggtaaggggtgggtaacgggtcgtaacggggtaagggttacggtttgggttttaacgggggtttttaacttacggtagtacgtaacggttcgtaaaccgtaaacctttcgaaacctccggttaacggtcccgtttaaccggttcctttaacggtttcgggaaccgggtaaccggggtaactaaacggggtaacgtaaccggtaacgttaaacccgtaaacggtaaccgtacgggttccggtaaccgttggacccttacccgtagtttacccgg

SEQ ID NO: 212103 - DNA, 710 bp, Homo sapiens
  misc_feature: GYAE6OF02IMTFG.43.86.H09.1.454.CMB.1.raw
  modified_base (443)..(443): a, c, t, g, unknown or other
  misc_feature (443)..(443): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccgggtggggatggttgtgatgactcagtcctccactcctccctcgccccgtcacccttgggcacggcccggcctccatcctcctgccaggttctagtagaaacgtccctcgtaactacgttgacgtacggaaacctacctacttagaagttggacttcagctaggacggcctacgccaacgtcctaccgaacgggcctacctttaaatttaacgttaacggtttaccgtaaccggccttacggttcggggtcccagtacgagtattacgacggcggtacagggttggtacgtgggtaccngttaggtactttaccacgtacgtacgtaacgtaacgtacctaggaacggtgggtacgggaaggtcgttaggaggttacgttagggttttagggttttaagtttacgttcgtactagtacgtaactaacgttactacctacggtccgttccgttaccgtttcgtaccggttttcggaccgtacggggtaccgtacgggtacggaacggtaacgtacgtaaaccgtacggtaggttaccggtcgtaccgacgttaccgtacgttaccgg

SEQ ID NO: 212104 - DNA, 643 bp, Homo sapiens
  misc_feature: GYAE6OF02F3J5C.43.86.H09.1.454.CMB.1.raw
  modified_base (458)..(458): a, c, t, g, unknown or other
  misc_feature (458)..(458): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgcgtcccaggatccgggtggggatgttgtgatgactcagtctccactctccctgcccgtcacccttgggcagccggcctcaccctctcctgcaggtctagtgaaagtcctcgtacacgttgataggaaacctacctacgttgaagttggattcgagcgaaggacggccgacggaccaatcctaccgaaggccgtaccttaagttttaataacggtttccgtaaaccgggacttcggtacggggtaccagactagtacttcgacggtccggacgtaggttcgggtcgtagggctacgtgtactttcactacgtacgaactaatcgaggngtaggggtggacggtcgtaggtaggttagtttgggttttagggttttacttacggtgtactagttcgaactaaccgtctaacgtacgtcgtcccttacgttcgttacgtttaccggacgtacgggaccgtagggtcggaacgtaagtaccgaacggtacgtcggtacgctacgtacgaccttacg

SEQ ID NO: 212105 - DNA, 738 bp, Homo sapiens
  misc_feature: GYAE6OF02FWAVX.43.86.H09.1.454.CMB.1.raw
  modified_base (245)..(245): a, c, t, g, unknown or other
  misc_feature (245)..(245): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggctccatctcctgcaggtctagtgaaagcctgtacaggttnatggaaacacctacgttgaattggattcagcagacggccaggacccaatcctaccgaagggtccaccgttaaattttaacgttaaacggtttaccgtaaacccggggacttccggttacgggggtccccaaggtacctaagtacttacgaacggtccggtacgtaacgggttggggttcctggggactacgttacgtaacttttccaactacgtagaactaagtcctaggacgtaggggttcggacgggtcgtaggtaacgggtagtttacgggtttaggttttttaacgttaccgttggtaccgtagtacgtaaccgttaaacgttccaaccgttacgttaccggtccgtttcccggtttacttacggttttaccgggaaccggtaccggggtaacccgtaaggggttacggtaaacggttaaccgtaaacggtaaacccggttaacgtacgggttacggccgttaacggaccgtaacccgtaacgttccgg

SEQ ID NO: 212106 - DNA, 770 bp, Homo sapiens
  misc_feature: GYAE6OF02HH0NI.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcacgccggcctccatcctcctgcaggtctagtagaaacgtcctacgtacacgttgaactaggaaacctaccttacttagtaattggattcagcagacggccaggacctaatccgtaccaacgggcctaccttaaattttagttaacgggttttaccgaaacccgggtacttccggtacggggtacccaagaccgtaagacttcgaaggtccggtactagggttcgggtactcggactacgttagtaccttttaccaacgttacgtacgtaactaaacgtcgaaggtacggaaggggttacgggacggtaccgttagggaagggttaaggtttcgggtttttacgggttttaatttaccgtacgtaccttaacgttacggtaaccttaaaccttaccgtaaccgtcgttacccggtcccgttttacccgtttacgttaaccggtttttacgggaccgggtaacggggtaaccgttaacggggtagggaacgttaaacggttaaacccgtaaaaccggtacggtttacggttaccggtaccgttaccggtaaccctacccgttaagtttcccgg

SEQ ID NO: 212107 - DNA, 678 bp, Homo sapiens
  misc_feature: GYAE6OF02HLHQN.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccgttgggcagccggcctccatcctcctgcaggtctagtgaaacgcctcgtacacggttgatacggaaacctacttacttgaagttggattcgagacagacggccaggccaatcctaccgaaagggtcctaccttaaatttagttaacggtttaccgaaaccgggtcttacggtacggggtacccaggtaactacgtacttcgaaggtccggtacgtacgggttcgggtacgtcggactacgtacggtacttttaccaccgtaacgtacgaactaagtaccgtagacggtaaggggtacgggtaacggtcgtacggtaggtacggtttagggttttagggttttacttaacgtgtacgtagtacgtacctaacgttacgacgtacgtcgtaccttccgttactcgtttcgaccgtacgggaccgtaggtacggtactacgtaaccgaaacgtacgtcggtcggtacgtacggactacgtacgttacg

SEQ ID NO: 212108 - DNA, 749 bp, Homo sapiens
  misc_feature: GYAE6OF02GIX6T.43.86.H09.1.454.CMB.1.raw
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
  modified_base (470)..(470): a, c, t, g, unknown or other
  misc_feature (470)..(470): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctcgtcgggtcccaggatccgggtgggggatggttgtgatgactcagtctccactcctccctcgcccgtcctacccgttgggcacggcccggccttccactcctctgcctaggtcctagtagaacgtccttacggtactacgttgatacggaaacctaccttagttanaagttggtacttacgagngaacgggnggacccgaggaccctaagtccctaccgaaacggggtcctaacctttaaaatttaacgttaacgggtttaccgtaaccgggtaacttccgggttacgggggtacccaaggaccgtaagtacttcgaacgcggaccgtggtcggggttaacncgggtactacgtacgttactttaccgaactccgtagaactaatccgaaggcgtacgggggtaggcgggtacgtagagggttactttaggggtttacggttttaacttagcggtactagtacggtaacctaaacttccgtaaaccgcgttacgggttccctttacccggttacgtttaccggtttccgggtacccgggtacggggaacttaacgggggtacggtaacgaacggtaaccgaaacgtacgtggacggtaccgtacaccgtacctgttacccg

SEQ ID NO: 212109 - DNA, 592 bp, Homo sapiens
  misc_feature: GYAE6OF02GC9ZU.43.86.H09.1.454.CMB.1.raw
  modified_base (586)..(586): a, c, t, g, unknown or other
  misc_feature (586)..(586): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaacgcctcgtacacgttgataggaaaccactacttgaattggattcagcagagccaggccaatctaccaaggcctacctaatttataaggtttccaaccgggtactcgtcggggtacccaggacagtacttcgagcggactaggttcgggtctggactacgtgtactttcacgtactgacaatcacgcgagggtgagtcgtagaggtagttggtttggttttattacgtgtactagtgtactaactcgactacgtcgtcctccgttctacgtttcgaccgtagggaccgtagggtacggacggtacgtaaccgtaaacgtacgttacgggtacgtacccgtacgtaccgtaccgtnttaccg

SEQ ID NO: 212110 - DNA, 1017 bp, Homo sapiens
  misc_feature: GYAE6OF02HQCMB.43.86.H09.1.454.CMB.1.raw
tcagtgtgagtagtcacgaccggtgctcgatttagtgctatagacttgggtttggggactgatcaggactcctcagttcaccttctcacaatgagctcctgctcagctcctggggctgctaatgctctgggtcccaggatccggtgggatgttgtgatgactcagttcctccactcctcccctggccccgtcctacccgttgggccacggcccggccctccatcctccgtgcgtaggtctagtagaaacgtccttacgtactacggttgaacgtacggaaacctaccgttacttacgtaaagtttcgtacgtttcgacgacgaagggacggacccgaacgggaccctaaacgttcccgtaacccggaacgggtaccgttaacccgttttaaaacgtttttaacggtttaaaccggggttttaaccccgttaaaaccccggggttaccgttaccgggttacccggggggttaaccccggaacgtaacccggtaacggttaacgtttaccggaaccgggtacccggggtacggttaacggggttccgggggtttcccgttccggggtaacccgttaaccgtttaaggttacccgtttttaacccgaaaccgtttaaccgttaacggtaaacccttaaaaccggttaccgttaaaccggggaccgggttaaacggggggtttaccgggggtaaacgggttccgggttaaggggtaaacggggtttaacgggttttttaaggggtttttttaacggggttttttaacgttttaacccggtaggtaaccgtttaacgttaacggtaaacctttaaaacccgtttaccgtaaaccggttaccggtttacccgggttccccgttttaaccggttttacccttttaacccgggttttaccgggacccggggttaacggggtaacccggttaagggggtaacggtaaccggttaaacgtaaacccgaaaccggttaacggttcggtaacgggttacctacggtacccctaccgttcgtttacccgg

SEQ ID NO: 212111 - DNA, 912 bp, Homo sapiens
  misc_feature: GYAE6OF02G6Q1S.43.86.H09.1.454.CMB.1.raw
tcagtgtgagtagtcacgaccggtgctcgatttagtgctatagacttgggtttggggactgatcaggactcctcagttcaccttctcacaatgaggctcctgctcagctcctggggctgctaatgctctggtcccaggatccggtgggatgttgtgatgactcagtctccactctccctgcccgtcaccttggcagccgcctcatctctgcaggtctagtagaaacgtccctacgtaacacggtttagaagttacggaaaaacctacccgttaacgttagtaaacgtttagggaactttaccgaacggtaccgaaaggaaccgggtaccccgaaacggggtaacccctaaaacgttacccggtaaccccgaaaaggggtaccccggttaaacccttttaaaagtttttaaaacggtttaaaacgggttttaacccgtaaaaaccccgggggtactttacccggttacggggggttaacccccaaggtaaacccgtaaaggtaactttaccgaaacgggtccgggtaccgtaaagggtttcgggggtacctacgggtaacccgtaacgttacggttaactttttaaccgaaccgttaaccgtaacggtaaaccctaaacgtaaccgaacggtaaccggtaagggggttaccgggaagggttaccggtaggtaacgggttaagtttacgggtttttagggtttttaaactttaaccggtacgtacgtaacgttaccgtaaactaaaaccgtttacgaaccgttaaccgtaccggtacccgtttaccgttacctttaaccggttttaccgggaaccggtaacggggtaaccgtaaacgggtggtaaacgtaaacgtaaaccgtaaaacggtaacgttacggtacggtacctaccggaacctaccgtacgttaccg

SEQ ID NO: 212112 - DNA, 754 bp, Homo sapiens
  misc_feature: GYAE6OF02HEIQU.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttggcagccgcctccatctcctgctaggtctagtacgaaacgtcctacgtactacgttgactacggaaacctaccttacgttgaaattcggtaattcgagacgtaggacggccaggaccctaatcctaccgaacggtcctacctttaaatttaacgtaacggtttaccgtaacccggggtcttccggtcggggtaccccaaggtacaggtacttcgaacggtccggtagtagggttcgggtcctcgggtacctagttcggtaactttccgaacctactcgaactaacgtcgaacggtcggtaggggtagacgggttcgtagggtaacgtaggtttcgggttttaagggtttttaactacggtacgtacgtaacgtcgtaaccttaaaccgttccgaacgttaccggttccggtacccctttaaccggtttaccttaaccgggttttcgggaacccggtacggggtaaccgtaacggggttacgggaaacgtaacgtaaacccggtaaacggtaccgttacgggtacggtacccgttaacggacccttaccgtagttcccg

SEQ ID NO: 212113 - DNA, 648 bp, Homo sapiens
  misc_feature: GYAE6OF02GLZEN.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttggcagccggcctccatctcctgcaggtctagtgaaagcctcgtacacgttgataggaaacacctacttgaattggattcagcagacggccaggccaatcctaccgaaggccgaccttaatttaagtaacggtttacgtaaaccgggtacttcgtacggggtcccaagacagtacttacgacgcggactaggtcgggtctggctacgtgtactttcactactagaactaagtacaggacgaggggtaggacgggtcgtaggaggtagtttgggtttagggttttacttacgtgtctagttagaacctaacgttacaccgtaccgttgtcccgttccgttccgttacgttttcggacccggtacggggaacccgtaagggtcggaagtaacgtaaccgtaaaccggtaacgttacgggtacggtaccgtaccggtaccgttaccgtacgttaccg

SEQ ID NO: 212114 - DNA, 808 bp, Homo sapiens
  misc_feature: GYAE6OF02GVR5Q.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccgggtgggatgttagtgatgactcagtctccactctccctgcccgtcacccgttgggcacgcccggcctccatctcctgccaggtctagtagaaacgtcctacgtacacgtttgagtaggaaacctaccttacttagtaagttggaacttcgagtcaggacggccgaacggtaccctaaatcccgtaccgaacgggtccgtaacctttaaagttttaacgttaacgggtttacctaaaacccggggtcttccgggttacgggggtacccaggaccgtagtacgttaccgaacggtccgggactagggttcggggtaccttacggggaccttaacgttacggttaactttttacccgaaccgttaacgttacggtaaacctaaacgttaccgaacggtaccgggtaggggttacgggaacggtcgtagggtaggttagtttacggggttttacggtttttaacgttaacggttcgtaacgttaacggttacgtaaccgttaaaccgtttcgtaaccgttaccgttaccggtacccgttttacccggtttaccgtttaacggttttccggaccggttacggggtaacgtaacgggtacggaacgtaacgtaaccgtaaacggtacgttagggtacgtcgtaaccgtaccgtaccgttagttacccg

SEQ ID NO: 212115 - DNA, 721 bp, Homo sapiens
  misc_feature: GYAE6OF02GA5BW.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccgggtggggatgttgtgatgactcagtctccactcctccctcgcccgtcacccgttgggcacggccgcctccactcctcctgcaggtctagtagaacgcctacgtactacgttgagtacggaactaccttacttagaattggtatcagcagacgccgagccatctacgaacggtctaccttaatttagttaacggtttaccgtaaccgggtctcggtccgggtacccagacgtagtattcgaggtcggactagggtcgggtctggtactacttggtactttccaactacgtagaacctaagtcgaggacggtaggggtacgggacggtcgtagggtaacggttaggtttagggttttagggttttttaactacggttacgtcgtaacttaccgtaacgttaaaccgttaccgaaccgttacccgttacgggttcccctttaccggtttacctttacccgggtttccggtacccgggacggggtaaccggtaacggggtttacgggaacgttaacggtaacccgtaaaccggtacgtttcgggacgggtaccgttacggaccctaccgtactttaccgg

SEQ ID NO: 212116 - DNA, 579 bp, Homo sapiens
  misc_feature: GYAE6OF02GAJLY.43.86.H09.1.454.CMB.1.raw
  modified_base (218)..(218): a, c, t, g, unknown or other
  misc_feature (218)..(218): n is a, c, g, or t
  modified_base (337)..(337): a, c, t, g, unknown or other
  misc_feature (337)..(337): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtggggganacgtggtccagccgtgggaatccctgacactctcctgtgcagcctctggattcacctttcaataattatggcatgcactgggtccgccaggctcctggcaaggggctagggagtggggnggtcacttatatcatctgagtggtaaatagaaagtactaacgcaacgactcgtagaacgggaccgtacttacgacctatctaccgacggacgtaactaacgaagccgacactctagtatactagacgtaatacgaacacgacctacgacctaccgtaggaggacggacggtacgtaagtttaactttacgtcgtagtacggaggacgtacggtaagggtaggggggtacgttgttaacccgg

SEQ ID NO: 212117 - DNA, 712 bp, Homo sapiens
  misc_feature: GYAE6OF02G9PKW.43.86.H09.1.454.CMB.1.raw
  modified_base (225)..(225): a, c, t, g, unknown or other
  misc_feature (225)..(225): n is a, c, g, or t
  modified_base (255)..(255): a, c, t, g, unknown or other
  misc_feature (255)..(255): n is a, c, g, or t
  modified_base (704)..(704): a, c, t, g, unknown or other
  misc_feature (704)..(704): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacctgggcagccgcctccatcctctgcagtctagnaaacgcctacgtacacgttgataggaaacncctatgaagttgattcacgcaagcgacccgaggacccaatcctaccgaaggccgtaccttaaatttagtaacggtttcgtaaaccgggtactccggtacggggtcccaaggaccaacggtcttacgacggtccggacgtacgggtcgggttacctgggtacctacgttacgttaacggttttaccaaccgtaaccgtacggaacctaaacgttcgaacggcgggtagggtagggacggtcgttagggaagggttaaggtttcggttttagggttttaacgttcgttaggtactaacgttggaaacctaaccgtttacaaccgtccggtacggttacccttccggtttacgttaccgttttcgggaccgaccgggttaacgtacgggtaacggtaacgtaaccgtaacggtaaacgttacgtggtaccggtaacgtaccgacctaccgtnttacccgg

SEQ ID NO: 212118 - DNA, 774 bp, Homo sapiens
  misc_feature: GYAE6OF02GGINL.43.86.H09.1.454.CMB.1.raw
  modified_base (750)..(750): a, c, t, g, unknown or other
  misc_feature (750)..(750): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtcctccactctccctcgcccgtcacccgttgggccacgcccggcctccatcctccgtgcaggtctaagtagaaacgcctacgtactacgttgatacggaaactaccttattacgaagttggtacttcgagcgaggacggccacggaccctaattccgtaccgaagggtccctaaccttaaattttaacggttaaacggttttaccgtaaaaccggggtaccttcgggtaccgggggttacccaaggacctaaacgtacttacgaacggtcggacgtagggttcggtcgtgggactacgtgttatttaccaacgtactacgaactaaccgttcgaacggtcggtaaggggtcgggtaacggtaccggtagggtaacggtaaggttttcgggttttacgggttttttaattaccggttggtacctaagttacgtaaccgtaacctttaccgaacgttaccggtccgttaccgttccgtttacccgttacgggttttaccgggaccggttaacggggtaaccggtaagggttacgggaaagtaacctaaaccggtaaacgttaaccggtaggtcgggttaaccncggtacccgtacgttaccttccgg

SEQ ID NO: 212119 - DNA, 777 bp, Homo sapiens
  misc_feature: GYAE6OF02HQALG.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggattgttgtgatgactcagtcctccactctccctgcccgtcacccgttgggcacgccggcctccatctcctgcgtagtctagtagaaacgcctacgtacacggttagaatacggaaacctaccttacttacgtaagttaggactttacgagtaccaaggtaccggaccgacggacccaagtcccgtaccgaacggccgtaacctttaaagtttacgttaacgggtttacctaaaccggggtactacggttcggggtacccaaggactagtattcgaggcggacgtaggttcggtcgtacggcctacgtgtactttcaaccgtacgtacgtaacgactacgaacggtacggtacggggtagggaacggtcgtaagggtaacgggttagtttacgggttttagggttttaacgtttacgtacggtactaacggttacgtaaaccttaaaccgtttaccgaaccgttaccggttaccggttaccccgttttaccggtttaaccgtttaaccggttttacgggaccccgggttaaacggggtaccggtaaacgggttcgggaaaccgtaacgtaaaccgtaaacggtacgttacggtacggtaccgttaacgaccgtaccgtattacccgg

SEQ ID NO: 212120 - DNA, 750 bp, Homo sapiens
  misc_feature: GYAE6OF02GDN0H.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctccgtggggctgctaatgctctgggtcccaggatccgggtggggatgttgtgatgactcagtctccactctccctgcccgtcacccgttgggcacggccggcctccatcctcctgctaggtctagtagaaacgcctcgtactacgttgatacggaaacaccttacgttgaattggattcagcaggacggaccaggaccaactccgtaccgaaagggtcccgtaacctttaaaagtttttaacgttaaaacgggttttaccgtaaaacccggggtacttccggttacgggggtacccctaaggaactagtacgttacgacgggccgggactagggttcggggttcgtcgggactacgtggttaactttccgaaccgtacgtacgtaacaacttacgaacggtacggtaggggtgggaacggtcggtaggtagggttagtttgggttttagggttttacttacgtagtctaaggtacgtaccttaaacgttaccaacgtaccgttcggttacccgtttccggtttacgtttaccggttttacggaccgggtacggggtaaccgtaaggggtacgtaaggtacgtaaaccgtaaacggtacgttacggtacggtccgtacggacccgtaccgtagtttaccgg

SEQ ID NO: 212121 - DNA, 834 bp, Homo sapiens
  misc_feature: GYAE6OF02G7LFD.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccgttgggcacgccggcctccatcctcctgcaggtctagtacgaaacgcctcgtacacgttgataggaaaccaccttattagtaattggtacttcgagtccgaaggacgggtaccaacgggacccaaattccgtacccgtaacgggtacccgtacctttaaagttttaacgttaaacgggtttttaccgtaaacccggggtacttaccgggttcgggggtacccctaaggtaccgtaaggtacttaccgaggtccggacgtaagggttcggggttacgtcgggtaccttaacgttggttaaccgttttaccgtaactaaccgttacgaacctaacgttacgaacggtacggtaagggggtacgggacggtacgttagggaagggttaggtttagggtttttaacgggtttttaacttacggttagtaccgtaagttaccgtaaccttaaacccgtttacgaaacccgttacggttacccgggttcccttttaccggtttacctttaaccgggttttaccgggtacccgggtaacgggggtaacccgttaacggggtacgggtaacgtaaccgttaaaccggtaaaccggttacggttaacggttcgggtacctcgggtaaccctaccggttagtttacccgg

SEQ ID NO: 212122 - DNA, 762 bp, Homo sapiens
  misc_feature: GYAE6OF02G97HM.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctccgtggggctgctaatgctctcgggtcccaggagtccgggtgggggattgttgtgatgactcagttctcccactcctccctcgcccgtccacccgttggcacggccggcctccatcctcctgcgaggtctagtagaaacgcctacgtacgtacggttgaacgtacggtaaacctaccttacttagtaagttacggattacgagacgaggacggaccgaacggacctaactccgtaccgaacggtccgtaaccgtttaattttaacgttaacggtttaccgtaaccggtaccgttcggttaccggggaccctaacggactaaggtacttacgaggccggtacgaggttcgggtccgtggacgtacgttagtacgtttacacgtaccgtacgtaaccaacgtcgaacggtcggtagggtcgggtaggccggtagggtacggttaggtttttaggggtttagtttttactagtcgtcgtaacttcgtaactaccttacgaccgttacgtccgggtttacccttaccggttaccgttacgttaccggggtaccggtacggggtaaacccggtaggggtaaccggtaacggtaaccgttaaccgtaaacggttacgtccgggtacgaccggttaccgtaccgttaccagtttccgg

SEQ ID NO: 212123 - DNA, 875 bp, Homo sapiens
  misc_feature: GYAE6OF02IMTE9.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtggggatgttgtgatgactcagtctccactctccctgcccgtcacccttggcacgccggcctccatctcctgcaggtctagtagaaacgtcctcgtacacgttgatacggaaaactaccttacttagtaagtttggacttcgagtacaggacggaccgacggacctaaactccgtaccgaacggccgtacctttaaattttaacgttaaacgggttttaccgtaaacggggtacttaccggttacgggggtacccaaggtaacgtacgtacttaccgacgggaccggtacgtaagggttcgggttacgtcgggtacctaacgttagtaactttaccgaaccgtacgttacggtaaactaaacgttaccgaacggtaccgggtaagggggttcgggaaacggggtcgttaacggggtaaagggttacgggttttagggttttttaacgggggtttttaactttaaccgttaggtaaccggttagtttaacggtaacccgttaaaaacctttcccgtaaaccgttaacccggttccggttaaccccgttttcccggttttaaccgttaccccggttttttaccgggggaaccccgggttaaccgggggttaaaccggtttacgggggtaaacggttaaccggtaaccgttaaaaacccgggtaaccgttaccgggttagggtaccggtaaccgttacccggaaacccgtttaccgtacttttaccccggg

SEQ ID NO: 212124 - DNA, 715 bp, Homo sapiens
  misc_feature: GYAE6OF02JF58A.43.86.H09.1.454.CMB.1.raw
  modified_base (435)..(435): a, c, t, g, unknown or other
  misc_feature (435)..(435): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccgggtgggggatgttgtgatgactcagtctccactctccctgcccgtcacccgttgggcagcccggctccatctcctgcaggtctagtgaaacgccgtcgtacgacgttgaagtacggaaactaccttacgttagtaattgggacttcgagcaggacggacccaggaccaatcctaccgaagggcctaccttaatttaacggttaacggtttaccgtaaaccggggtacttcggttaccggggggtacccaaggaaccgagtacttaccgaggtcggcgtaggtcgggtcncggactacgttgtactttacacgtactcgaactaacgtcaggcgtaggggtggagtcgtaggtaggtagtttagggtttaggttttaacttacgtcgttacagttacgaaccgtaactttcgaaccgttacgttccgtacccgtttccggttacctttaccgggtttccgggaccggttacgggggtaacccgttaaggggtcgggtaaaccgtacgtaacccgtaaaaccggtacgttcgggttaccggtccgtacggtcccgtaaccttcgttaccgg

SEQ ID NO: 212125 - DNA, 880 bp, Homo sapiens
  misc_feature: GYAE6OF02JR4M0.43.86.H09.1.454.CMB.1.raw
  modified_base (146)..(146): a, c, t, g, unknown or other
  misc_feature (146)..(146): n is a, c, g, or t
  modified_base (189)..(189): a, c, t, g, unknown or other
  misc_feature (189)..(189): n is a, c, g, or t
tcagtgtgagtagtcacgaccggtgctcgatttagtgctatagacttgggttttgggggtacgttggagtcaggactcctcagttcaccttctcacaatgaggctcctgctcagctcctggggctgctatgctctcgggtccaggntccggtgggagtgttgtgatggactcagtctccactcctcccngccctcacccttggccacggcccggcctaccgactcctcctgacgacggtctaggtagaactcctacgtaccgtttgactacggaaacaccgttactagtaacttggtacttacgagtacgtacggagggtccccgaaggtacccgtaacttcccgtaaccggaacggtacccgttaaccgttttaaaacttttaacggtaaaaccggggttttttcccgtaaaacccggggttaccgtttaccgggttacccggggttacccccaaggtaaacccgtcgttaaaccggtttcgaaacggtacccggggacctaagggtttccggggggtaccttaggggtacccttaacggttacggttacgtttaaccggaccgttaaacttaccgggaactaaacggttaccgaggaaccgggtaagggggtacggtaacgggttcccggtaagggtacgggttaggtttggtttttttaaccggggtttattaacgtcggggactacgtttggtaacccttaaaccgttccggaaatttacccggtagggtttcccccttaacgggtcttttaaccggttacggggcccccgttaagggggtacgtaacgggggttaacgagtttaacccggtaaacgtaaacccggttaagtttccgggggaactttggacccccttaagggtaccttagtcccgg

SEQ ID NO: 212126 - DNA, 697 bp, Homo sapiens
  misc_feature: GYAE6OF02GRTWH.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctccgtggggctgctaatgctcgtgggtcccaggatccgggtggggatgttgtgatgactcagtcctccactcctccctcgcccgtccacccgttgggccacgccggcctccatcctcctgcgtagtactagtagaaacgtcctacgtacgtacgttagagtacggaaacctaccttattagtaattcggattcgagacgagacggaccgacggacctacgtccgtaccgaacggtccgtaactttaaatttagtaacggtttaaccgtaaccggtctcggtacgggtccaagacagtacgtcacggcgtacgtaggtcggtcgtcgacgtacgtgtactttaccgactacgtacgtaaacactacgaaggtcggtaggggtacggacggtcgtaaggtaggttagtttagggtttttacggttttaattccgtacggtactaagtacgtaaaccgttaaccgttccgacgtaccgttcggtacccttaccgttacgttaccgttacgggaccgtacgggtaacgaggtacgggaactaaccggtactaaacggtcgttaggtacgcgtaccgacgtcctacgttccg

SEQ ID NO: 212127 - DNA, 806 bp, Homo sapiens
  misc_feature: GYAE6OF02GA8DA.43.86.H09.1.454.CMB.1.raw
  modified_base (779)..(779): a, c, t, g, unknown or other
  misc_feature (779)..(779): n is a, c, g, or t
tcagtgtgagtagtcacgaccggtgctcgatttagtgctatagacttggggtttgggggactgatcaggactcctcagttcaccttctcacaatgaggctccctgctcagctccgtggggctgctaatgctcgtcgggtcccaggatccgggtgggatgttgtgatgactcagtctccactcctccctcgcccgtctaccgtggcacgccgctccatcctcgtgacgtacggtactaggtagaaacgtcccgtacgtaccgtagttagaactaaccggaaactaacccttagttagtaagttacggtattacgacgacgaagggaccggaccgacggaaccctaacgtaccgtaccggaacggtacctaacgtttaaacttttaacggttaacgggtttaaccgaaaccgggtcttccggtacggggtaccccaaaggtaacgtacgtacgttacggacggtaccggtacgtaaggggttcgggtaactcggggacttacgttacggttacttaccaacgtctaacggaactaaacgtccgaaggtaccgggtaaggggtggacggtaccttaggggtaaaggttaacgggttttgggtttttaaacggttttacttaacgcggtaaccttaacggttagtaaacccttaacccttacggaacccgtttacggtaccgttcccgtttaacccttacggttaccgggttacgaacccgggttacgggaacggtaagggttaacgaacttaaccggtaaacgaacggttacggtcggtacncggttacgaacccgtactcgtttaacg

SEQ ID NO: 212128 - DNA, 846 bp, Homo sapiens
  misc_feature: GYAE6OF02GZX0Y.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctcgtgggtcccaggactccggtggggatgttgtgatgactcagtctccactcctccctgcccgtcacccttgggcagccgcctcatctcctgctaggtctagtcgaaacgtcctacgtaacacgttgaagtacggaaaacctaccttacgttagtaaagttggactttacgagacgaaggacggaccaagggtacccaaacttccgtaaccggaaacgggccgttaaccctttaaaagttttaacgttaaacgggttttaccgtaaacccggggtacttacggttaccgggggtacccaagtaaccgtaaggtaacttcgaacggtccgggacgtaagggttcggggtaccttaggggacctaacgttaggtaacttttcccgaactaccgtacgtaaacctaagtacgaacgggtacggtagggggtacgggaacgggtaccggttagggtaaggtacggttttagggtttttacgggtttttaaacgttacggttacgtacgttacgttacgtaaaccgttaaacccgttacgtaacccgttaacgttaccggttccctttaccccggtttaacttaacccgtttttaccggggaacccggtacgggggtaaaccgtaacggggttaccgggaaagttaaccgtaacccgtaaaacggttaaccgtttacgggttacggtacccggttaccgaacccgttaccgtacgtttaaccgg

SEQ ID NO: 212129 - DNA, 756 bp, Homo sapiens
  misc_feature: GYAE6OF02I4PPM.43.86.H09.1.454.CMB.1.raw
tcagtgtgagtagtcacgaccggtgctcgatttagtgctatagacttgggtttggggactgatcaggactcctcagttcaccttctcacaatgagctcctgctcagctcctggggctgctaatgctctgcgtccaggatccggtgggatgttgtgatgactcagtctccactctcctcgccgtctaccgtggacacgccgcctcatctcgtgcgtagtctagtacgaacgtcctacgtacgtacgttagatacggaactacgttactagtaagtgtatcgagcgagacggccaacgtactaactccgaaccgacggtactaccttaaagtttaacgtaacggtttaccgtaacgggtccttacggttacgggtaccagtaacgtgtactacgaaggtccggagtacgggttcgggtctagggactacgtacgttattaccgactacgtacgtaacgtaactacgtcggacggtaggggttaacggagggtacggttagggtaacggttaggttttacgggtttttaacgggtttacttaacggtacggtacgttaagttacgtaaccgttaacttaccgtaaccgttaccggtttccggttcccgtttaaccggtttaccggttaaccgttttaccgggaacccgggttaacggggaaccgggttaacggggttaaacggtaccggttaaacgttaaccgggttaaaaccggtacggttacgggtacggtaccgttacggtacctaccgtttaacg

SEQ ID NO: 212130 - DNA, 758 bp, Homo sapiens
  misc_feature: GYAE6OF02FTXOX.43.86.H09.1.454.CMB.1.raw
  modified_base (219)..(219): a, c, t, g, unknown or other
  misc_feature (219)..(219): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagctgggttttcctcgttgctcttttaagaggtgtccagtgtcaggtgcagctgggtggagtcgtggggganacgtgggtccagccgtggggaacgtccctgaccactctcctgtgcagcctctggacttcgaccttcaattaattatggcatgacacgtgggtccgccaggtcctccgtggcgaaggggctagggaggtggggtggctacttagtactcgtatcctaggtaagtcgggaaagttaagaaaaggttactacggcaacggtaccgttaccggtaggaaacggggtaccggtaacgtttacaacccgtaactccgtacccggaacggggtaacctaaacgtttaacgaacgtaccggtaccgtaacgttacttacggttaacttaccgttaggtaaaccgtaaaattaaccggaaaccgtacgtacccgttaagtaacccgtaaccgttacgggaaccgggtaacgggtaaccggttaccgttttaaacgtttttaaccgtttaaccggtttacggtttacgggttaacggtaacgggttaacggtaaaccggggttaacggggtttaacggggggggtacggttaccggtttaaaccccggg

SEQ ID NO: 212131 - DNA, 742 bp, Homo sapiens
  misc_feature: GYAE6OF02HXK8B.43.86.H09.1.454.CMB.1.raw
  modified_base (169)..(169): a, c, t, g, unknown or other
  misc_feature (169)..(169): n is a, c, g, or t
  modified_base (226)..(226): a, c, t, g, unknown or other
  misc_feature (226)..(226): n is a, c, g, or t
  modified_base (229)..(229): a, c, t, g, unknown or other
  misc_feature (229)..(229): n is a, c, g, or t
tcagtgtgagtagtcacgaccggtgctcgatttagtgctatagacttgggtttggggactgatcaggactcctcagttcacctttctcacaatgaggctccctgctcagctcctggggcttgctaatgctctcgggtccaggatccgggtgggatgttgtagatgactnagtctccactcctccctgcccgtctacccgttgggctacgccggcctccactctccnganacggtctaagtagaaactcctacgtactacgttgagaggtaaacctaccgtacttagtaagttggtacttcgagtcacggacggtaccaaggaccctaatccgtaccgtaaaggaccgtacctttaaatttaacgttaacggtttacgaaaccgggtcgttacgtcggggtacccctaagtaccgtaagtacttacgacggaccggtacgtaggttcgggtaccgtacggacgtacgttacgtacgttttacgactaccgtagtaaactaagtacgtaacgtacggtacggggtagggaacggtcgtagggtagttacggtttagggttttaggtttaactttagtacgtacagttagtaaccttaaacttaccgtaacgtacgtaccgtttacccgttacccgttacgttccggtttacggtacgggttaaccggacggttaacggtacgggtaacacgtaaaccgtaaacggtacgtcggtcggtacgtacgtacctacgtactttaacgg

SEQ ID NO: 212132 - DNA, 607 bp, Homo sapiens
  misc_feature: GYAE6OF02G9IBQ.43.86.H09.1.454.CMB.1.raw
  modified_base (391)..(391): a, c, t, g, unknown or other
  misc_feature (391)..(391): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccgcctccatctcctgcaggtcagtgaaacgcctcgtacacgttgatggaaaccactacttgaattggattcagcagaggccaggccaactctaccaaggcgacctaaattttactaaggtttactaacccgggattcgtggggtcccagacgagtattcgagcggacgtagtcggggtctggctacgtntactttcactactgaactaatacgaacgcgaacgggtagggacggtcgtagggaacggtagtttgggtttagggttttaacttaacgttgtacgtattcggaactaaaccttcgaactacgtgtcctccgttctacgtttcgaccgtacgggaccgtaagggtcggaagtacgtaacgaaacgtacgtacggtcggacgtacgacctatacgttcg

SEQ ID NO: 212133 - DNA, 721 bp, Homo sapiens
  misc_feature: GYAE6OF02GJ3UR.43.86.H09.1.454.CMB.1.raw
  modified_base (280)..(280): a, c, t, g, unknown or other
  misc_feature (280)..(280): n is a, c, g, or t
  modified_base (467)..(467): a, c, t, g, unknown or other
  misc_feature (467)..(467): n is a, c, g, or t
  modified_base (662)..(662): a, c, t, g, unknown or other
  misc_feature (662)..(662): n is a, c, g, or t
tcagtgtgagtagtcacgaccggtgctcgatttagtgctatagacttgggtttaggggactgatcaggactcctcagttcaccttctcacaatgaggctccctgctcagctcctggggctgctaatgctcgtgggtcccaggatccgggtggggatggttgtgatcgactcagtcctaccactcctccgtcgcccgtctacccgttgggcacgcccggtcctccgtatcctcgtagcgtagtctagagaactcctacgtactacgttgacgtacgaaccnccttatgtaaagttcggattcgagcgaaggccgacccgtacggactaacgttccacgaacgggtccttaacctttaaagttttaacggtaaacgggttttacccgtaaaccgggtctttaccggggtaccggggtacccaagtaaccgtagtaccgttacgacggtccggacgtagggttcggtcgnggtaccctagttcgttacgtactacgtagtacgtaacgtactagacggtacggtacggggtaggaggttaccgtaggacggtttagtttcgggttttacggttttactaacgtcgctaacgtgtaaactacgtaccaagtccggttacgtccgttacgttctcggtttacggaccggtacgggtaacgtagggtntaaaccggtctaaccggtaagtcggttaaggtccggtacaaccggtctacgtccttacg

SEQ ID NO: 212134 - DNA, 810 bp, Homo sapiens
  misc_feature: GYAE6OF02JDEIX.43.86.H09.1.454.CMB.1.raw
  modified_base (219)..(219): a, c, t, g, unknown or other
  misc_feature (219)..(219): n is a, c, g, or t
  modified_base (655)..(655): a, c, t, g, unknown or other
  misc_feature (655)..(655): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtgggggancggtggtccaggccgtgggaacgtccctgacctacgtctccgtgtcgcacggtcctcgtggtacttcacccttacaaattaattacgtagggacctagttcggacccgtaacggttccggggtaccccgtacccgaacgggtccgttcccgtacggggtaccggaaaacggggggtcccttaaggggtaacggggtttccgggggtacgggtaaccttaacggttttaaacgtacgttacccgtaaggtttcccggttaacggtaaaggttaacgggggtaaagttaaaccggtaaaaacggtttacccgttaaccggaccggtaacggtacccgttaccgggtaagggtaaacccgggtccgttaacgttaccgaccgtacgtaccgtaccgtaacgggtaactaacgttacgaacgtaccgtactacgtacgtntaccgtcgtacgaactaacgtacgtaacgtacgaccgttacgaaccgtaacgtacggtaacggtacggtacgtacgttaacgtttaacgtacgttaggacgtaccggtaagtaaccgggttacggtacgggttacggggtactacggttaaccgg

SEQ ID NO: 212135 - DNA, 744 bp, Homo sapiens
  misc_feature: GYAE6OF02FXH6T.43.86.H09.1.454.CMB.1.raw
  modified_base (337)..(337): a, c, t, g, unknown or other
  misc_feature (337)..(337): n is a, c, g, or t
tcagtgtgagtagtcacgaccggtgctcgatttagtgctatagacttggggtttgggggctgggagacgagcccagcactggaagtcgccggtgtttccattcggtgatcagcactgaacacagaggactcaccatggagtttgggctgagctggttttctcgttgctctttaagaggtgtccagtgtcaggtgcagctgggtggagtcgtggggggacacggtggtccagccgtgggaaacgtccctgaccactctaccgtgtcgcagcctctggacttcacctttcaattaacttagtggcagtgtcacgtcgggtcctaccgaggtccttacgngggacgaagggggtctcgggaagggtgggtacggctaacgtttaatactcgtatccgtagtacgtaaaggggtaagtaacgggtaaaaacgtaccgttaaccgggaccgttaaacgtaccggttaaccgggttaacggggaaccgggtaccggtaacttacccgaaccggtacctaccggtacccggtaagggaaacccttaaacgttaaccggaaacgcgggtaaccctacggttacttaggtaaccttcggactaaacgaaacgttaacgaaacgtaccggtacctaacggtacccgaccgttaggggaacggtacgacggtaacgttttaaagttactttaacggtcgttaacggccggtaagtacgggtaacgggtaagggtggggtacgttaccgtaaccgg

SEQ ID NO: 212136 - DNA, 813 bp, Homo sapiens
  misc_feature: GYAE6OF02FWBTB.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctcctcgcccgtcacccttggcagccgcctcatctcctgcagtctagtgaaacgcctcgtacacgttgactaggaaactacctacttgtaattggtattcgagcaggacggccacggaccaactcctaccgaacggccgtaccttaaattttaagttaaacggttttaccgtaaacccggggtaccttaccggtacgggggttaccccaagaccgtaagtactttccgaacggcggcgtaagggtcggggtctgggctacgttaggtacttttccaacgtaccgtacgaactaaagttccgagggtccgtaagggggttcgggaacgggtccgttagggaagggttggtttagggtttttacggggttttttaaacttacgttacgtacgttaacggttaccgtaaccgttaaaacccgtttccgtaaaccgttaacggttccgggtttaccccctttacccggttttacggtttaacccggttttaccggggtacccgggtaaccggggggtaaacccggttaagggggttaacgggaaacgttaacccggtaaacgttaaaaacccgggttaaacggttcgggtttaaccgggtaccggttaaccgtacccggtaacccgttaccgtttacccgg

SEQ ID NO: 212137 - DNA, 642 bp, Homo sapiens
  misc_feature: GYAE6OF02IEWRT.43.86.H09.1.454.CMB.1.raw
  modified_base (221)..(221): a, c, t, g, unknown or other
  misc_feature (221)..(221): n is a, c, g, or t
  modified_base (266)..(266): a, c, t, g, unknown or other
  misc_feature (266)..(266): n is a, c, g, or t
  modified_base (291)..(291): a, c, t, g, unknown or other
  misc_feature (291)..(291): n is a, c, g, or t
tcagtgtgagtagtcacgaccggtgctcgatttagtgctatagacttggggtttgggggctggggagacgagcccagcactggaagtcgcccggtgtttccattcggtgatcagcactgaacacagaggactcaccatggagtttgggctgagctgggttttcctcgttgctcttttaagaggtgtccagtgtcaggtgcagctggtggagtcgtgggggnacgtggtccagcgtgggactcctgacactctcctgtcgcagcctntggtacttctaccttacaattaatntggctagtgcacgtcggtccgcaggtcctcgtggcgaaggggctagggaggtggggtgactagttactctcatctggacgtaaggtaagtagaaacgtacgtaccgtcgaacgtcgtaccggtagggacgggtacgtacgtaccgacctaacgtcctaccggaacgggtaactaaagttaacgaacggacctaccgaccttacgtacgttactacgtacggtaactaaacgtacgaactaccgtcctacgaccgtacgtaggacggacgtaccggtactttaagttactttacggtagtacggtacggacggtacgaaccggtaggggttacggggtacgtccgttaacgg

SEQ ID NO: 212138 - DNA, 767 bp, Homo sapiens
  misc_feature: GYAE6OF02FG7RY.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccgggtgggatgttgtgatgactcagtctccactctccctcgcccgtcacccttgggcagccggcctccatcctcctgcaggtctagtgaaacgcctacgtactacgttgaatacggaacaccttattagaattggattcagcagaggccacggaccaatcctaccgaacggcctacctaagttttagtaacggtttaccgtaaccgggacttcggtcggggtaccagtaccagtacttcgacggcggtacgacgggttgggttcgtaggggtacctacgttagtacgttttaccaaccgtaaccgtagtaacctaactacggtaaggaccgggtaagggggtaggtacgggtaccgttagggaagggtttagtttggggttttacgggttttttaacgttacggttacgtacgtaacgttcggtaacgttaaaacgtttccgaaccgttaagttcccggggtttaccctttaccccgtttacggtttaccggtttttaccgggaccgggttaacgggggaaccggttaacggggtaacggggtaacgtaaaccggttaaaccgtaaaccggtaacggttcgggttacggtaccgtaccggtaccgtacccgttagttaccccg

SEQ ID NO: 212139 - DNA, 767 bp, Homo sapiens
  misc_feature: GYAE6OF02H6ZH0.43.86.H09.1.454.CMB.1.raw
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
  modified_base (225)..(225): a, c, t, g, unknown or other
  misc_feature (225)..(225): n is a, c, g, or t
tcagtgtgagtagtcacgaccggtgctcgatttagtgctatagacttggggtttggggactgactcaggactcctcagttcacctttctcacaatgaggctccctgctcagctccgtggggctgctaatgtctcgtgggtcccaggtagtccgggtggggattgttgtgatgactcagtctccactctcctgcccgtcaccgttggcagccgccncatctcngcngtcagtgaactctctacacgttgagtacgaaactacctattagattgggtactcagacaggacggccaggaaccatcctaacggaacggtcgtaccttaagtttagttaacggtttaccggtaaccggtcgtccgttacgggtaccagacgtagtacttcgaggtcgacgtggtacggtcgtgctattcgactttcacatacgacaagtcacggtaggagggtagggacggtacgtacgggtaggttaggtttttaggtttaacggttttttaacgtagttaccggtaacgtaacggttaaccgaaacgtttaacccgttaacgtaaccgttaaacccggttcccgggtaacccgtttttaaccggttccttttaaccggggttaaccgggggtaccgggtaaacgggggttaaaccccgggtaagggggttacgggtaaaccggttaaaccggtttaaaccccggaaaagggtttaacgggttacggggttaaccggttacccggtaaccggacggtttaacccgtaacggttttccccgg

SEQ ID NO: 212140 - DNA, 746 bp, Homo sapiens
  misc_feature: GYAE6OF02HKCLS.43.86.H09.1.454.CMB.1.raw
  modified_base (172)..(172): a, c, t, g, unknown or other
  misc_feature (172)..(172): n is a, c, g, or t
  modified_base (176)..(176): a, c, t, g, unknown or other
  misc_feature (176)..(176): n is a, c, g, or t
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
  modified_base (249)..(249): a, c, t, g, unknown or other
  misc_feature (249)..(249): n is a, c, g, or t
  modified_base (341)..(341): a, c, t, g, unknown or other
  misc_feature (341)..(341): n is a, c, g, or t
  modified_base (414)..(414): a, c, t, g, unknown or other
  misc_feature (414)..(414): n is a, c, g, or t
  modified_base (546)..(546): a, c, t, g, unknown or other
  misc_feature (546)..(546): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcacatggagttggctgagctgggtttcctcgtgctcttttaagnggtntccagtgtcaggtgcagcgtggtgagtcgnggggganacggtggtccaggccgtgggtaagtccctggaaccncgtctcctggtgccagcccctgtaggtacttccgtaccttacgaaattaaacttgtacgggctaagttcgaccgtaacgttcggggtacccnccgaaggtcccgttccgtaggacccggaaggggtcctgggaagggtcggggtcgacctaacggttaacgtttnaagttgttcggaatgggaaaagttaacgaaaattccgtacggctaacggtaccgtaccgtaggaacggtaccgtacgtacctaaccgacgtccgttaacgaaccgggtactaaacttaccggaaacggtacncgtaacgttacgtgttaacctcggttagtaaaccgttaagaacggtaaaccgtaacgtaccgtacgtacccgaacccgtagggtaaggttaccggaaccggttacgtaaacttttaaccggttacggtaccgttagggtaccgtaacggtacgggtaaacggttacggggttaacgggggtacgtaaccgtttacccggg

SEQ ID NO: 212141 - DNA, 791 bp, Homo sapiens
  misc_feature: GYAE6OF02GT758.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcgtggggctgctaatgctcgtcgggtcccaggacgttccgggtggggtattggttgtgagtgtactcgagtcctacccacttcctccccgtcgtccccgtacctacccggttgggcaccggcccgtcctcctatcctcctgccgtaggtctagtaagaacgtccttcgtaccgtacgttcggataacggtaaacctaccttacgttagtaagtttggtacttacgagtccgaaggccggtaccgacggtaccctaacttcccgtaccggaacgggcctaaccttttaaaggttttaacgttaaacggtttaaccccggtaacccgggtacctttccgggtaccggggtacccaacgaacgtaacgtagttcgacgggacggtacgtagggttcgggtctacgggacttaccgtagttacttaccaacgtactacggaactaacgtacgaacggtcgggtaaggggcggtacgggtacgtaggtaacgggttgttacggggtttttaggttttaatccgtagtacgtacgtacgtaacttaaccgttactaccgtaccgttcggtaccctttccggttacgttaccgtttaccgggaccgggtacgggtaaccggtaagggtacggaacgtacggtaaccgaacgttaacgtggtaccggcgtactaccgtacctcgttacg

SEQ ID NO: 212142 - DNA, 1032 bp, Homo sapiens
  misc_feature: GYAE6OF02GACME.43.86.H09.1.454.CMB.1.raw
  modified_base (950)..(950): a, c, t, g, unknown or other
  misc_feature (950)..(950): n is a, c, g, or t
  modified_base (1000)..(1000): a, c, t, g, unknown or other
  misc_feature (1000)..(1000): n is a, c, g, or t
  modified_base (1023)..(1023): a, c, t, g, unknown or other
  misc_feature (1023)..(1023): n is a, c, g, or t
tcagtgtgagtagtcacgaccggtgctcgatttagtgctatagacttgggtttggggactgatcaggactcctcagttcaccttctcacaatgaggctcctgctcagtctcctggggctgctaatgctcgtcgggtcccaggtacgtccggggtggggtattggttcgtgtatcgtactcgtagttcctacctaccttccctcccgtcggccccgttccgtacccgttgggccgaccggcccggtcccttcctacttcccgttccgtcggtaccggtacggtttaccgtaaggtaaccggaaaccggttccccgttacggtaaaccgttacggttacgtaacggttaaacccggaaacctaaccgtttacgtttaagggtaaacgtttcggttaaacgttcggaacggtacgaacggggtaaccggtaccggaaccggtaaccttaacggttacccgtaaccgggaaaccggttacccgttaaccgtttttaaaacgttttaaaccgggttaaaccgggttttacccgggtaaacccggggttaccgtttccggggttaccgggggtaaccctaagggtaacccgtaacggtttaaccgtcccggggtaacgggtaccgggttaccgggtttaggggttaccggggttaccgtaccgggttaaccgttaacgttttacccgggtttaacttaaccggaaccgtttacggtaccggttaaaacgtaacggttaccccgggtaaaggggtaccgggggttaggggttaaccgggaacggtttacggggtaacgggggttagttttaagggttttacgggtttttacgtttttaacgttcggaacgttagtttaacgtacgtaaaaccctacgttacgttaacccggtcgttccgtttacccgtttacgttaccggtttacggtaccgggttaaccggacggtttaaccgggnggtaaacgtacgttaaccggaaacggtaaggttccggtcgggttacccgnggtaacccggtcctttaccggtnttacccggg

SEQ ID NO: 212143 - DNA, 921 bp, Homo sapiens
  misc_feature: GYAE6OF02FQLGC.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctccgtggggctgctaatgctcgtcgggtcccaggactccgggtggggatggttgtgatgactcagtcctccacttcctccctcgccccgtctacccgttgggaccacggtccccggtcccttaccagttcccttcccgtggtaccgtagggttaccgttaacggtacgaaaaccgtccccgttaccgtaaccggtaacgtttggaacgttaacggaaaaccctacccgtttaacgttaaggtaaagtttcgggtaaccttcggaacgtaccgtaaggaccgggaccctaacgggaacccctaaaacgttccccgttaaccggaaacggggttaccctaacctttttaaaggttttaaaccggttaaccgggtttttacccgaaacccgggggtttacttccgggttaccggggggtaccctaacggtaacgtaacgtattacccggaaggtccgggtacgtaggggtttccgggtactcgggtaacccttacgtagtttaccgtttaccgacgtacggttacgtaaaccgttaagtaccgtacggggaacggttacgggggtacgggtaaccggtcggttaacgggaagggttttacggttttcgggtttttaacgggtttttaacttccgggtaacgtacgtacgtttaacgtaaccgttaaacgtcgtaacccgtacgtttccggtaacccttttccgttacgttaccgtttcgggaccgggtttaggaaccgggttaggtacgtaaccgtaagtaaccgtaaggttacggtcgttacggtacgtaccgtaccttaccgtagttacccgg

SEQ ID NO: 212144 - DNA, 713 bp, Homo sapiens
  misc_feature: GYAE6OF02F1CSP.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactcctccctgcccgtcacccttgggcagcccggcctccatcctcctgcaggtctagtagaaacgcctcgtacacgttgatggaaacacctattgaattggattcagcagacggccaggacccaatcctaccgaaggccgtaccttaaattttacgtaaacggttttaccgtaaacccggggtacttcggtacgggggttaccccaaggaacgaacgtacttaccgaaggtccggacgtaaggttcggggtacctcgggactaccgttagtaacttttccgaaccgtaccgttacggaacctaaatcgaacggtcggtagggggtagggaacgggtacgtagggtaaggttagtttacgggtttagggttttttaactcgttacgtacttagttacggtaacttaaaccgttcaaccgttacgtcggttacccgttaccgtttacgttaccgtttagggacccggtacggggacctaagggtcggaacgtacgtaaccgaacgttacgttacgtggtaccgtagacccgtacgttattcg

SEQ ID NO: 212145 - DNA, 697 bp, Homo sapiens
  misc_feature: GYAE6OF02JZL7R.43.86.H09.1.454.CMB.1.raw
  modified_base (224)..(224): a, c, t, g, unknown or other
  misc_feature (224)..(224): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcaccgttggcagccgcctcatctcctgcagtctagngaacgcctacgtacacgttgagtacggaaaacctccttagttataacgtttggactttaccgagtacgaacggtacggacccacgggaccctaacgtccgtaaccgtaagggcccgtacctttaaagtttttaacgtaacgggttttaccgtaaaccggggcttaccggtacggggtacccaaggtaacgagtacttacggacggtcgaccgttaggtcgggtcctaggcctaacgttggtacttcgaacgtcgtacgaactacgtacgaaggtcggtagggtaggacggtacgtagggtacggtaggtttaggttttacgggtttacttacgtagtctagttacgaacgttaaccttcgaccgtacgtccgttacccgttcgttacgttccggttacgacggtacgggtacgtagggtcgaacgtacgaacgtaaccgtagtcggtacgacgtacgcctacgactttaccgg

SEQ ID NO: 212146 - DNA, 784 bp, Homo sapiens
  misc_feature: GYAE6OF02HG8TU.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggagtccggtggggatggttgtgatgactcagtctccactcctccgtacgcccgtccacccgtttgggacacggccggcctccactcctccgtcgcgtacggtctagttagaaacgtccctacgtactacgttagaagtacggaaacctaccttacgttagtaacgttggtacttctaagacgtaaggacggaccgaacggaccctaagtacccgtaaccgaacggacccgtaacctttaaagttttaaacgttaacgggttttaccgtaaccgggtacgtccggttaccggggtaccaggacgtagtatccgaggcggacgaggtcggtcgtcggacgtacgttgttacttacgaacgtacgtacgaacgtaactacggacgacgggtacggggtagggtaggtcgttaaggggacggttaaggtttgggtttttacgggttttaacgtttacggaacggttacgtagttaacgttaacgttaaacctttaccgaaaccgttcggttaccggttacccgtttccgtacgttacggtttacccggacgggttaaccgggtaacgtaacgggtaacggaatacggtaaaccgtaaccggtaaggttcggttaccggacgttaccggaaccttacccggtgtttaccg

SEQ ID NO: 212147 - DNA, 745 bp, Homo sapiens
  misc_feature: GYAE6OF02GYYAC.43.86.H09.1.454.CMB.1.raw
  modified_base (736)..(736): a, c, t, g, unknown or other
  misc_feature (736)..(736): n is a, c, g, or t
tcagtgtgagtagtcacgaccggtgctcgatttagtgctatagacttgggtttgggggactgatcaggactcctcagttcaccttctcacaatgaggctcctgctcagctcctggggctgctaatgctctgggtcccaggatccggtggggatgtgtgatgactcagtctccactctccctgcccgtcacccttgggcagccggcctcatctcctgcaggtctagtagaacgtccttcgtactacggttgacgtaggaaaaccaccttaacgttgtaaattgggtatttacgagtaccaggacggccgaaggtcccaaatccgtacccgaacgggtccgtacctttaaagttttaacttaaagggttttccgtaaacccggggtacgtaccggttcgggggttccccgaagaccgtaacgttacgttaccgaacgggtccggggtaacgtacgggttcggggttcgtagggtacccgtaacgttggtacgtttttaccaaccgtaacgttacggtaaccgtaaacggtttcaaacgggtacccgggtaaggggtacggggtaacgggccggttaggtaacgggtaggtttggttttacggggttttactttaacggtgtacgtagtacgtacttaacgttctacgtacgtcgtccttcgttcgttcgttaccggccgtacgggactaagggtcgaacggtactaacgtaacgtacgtacgtggacctacggtaccncgtacgtcg

SEQ ID NO: 212148 - DNA, 830 bp, Homo sapiens
  misc_feature: GYAE6OF02I9GNG.43.86.H09.1.454.CMB.1.raw
tcagtgtgagtagtcacgaccggtgctcgatttagtgctatagacttggggtttggggactgatcaggactcctcagttcaccttctcacaatgaggctccctgctcagctccgtgggctgctaatgctcgtcggtcccaggagtccgggtgggattgttgtgtatgtactcagtcctacctacctcctccctcgacccgtccacccgttgggcacggcccgacctcctactcctctgacgacggttactagtaacggtaacctccgttacggtaacgtaacggtgtaacgtaaccggaaacctaccttgtaggttagtcgtagttcacggcgtacggacgtccggtacgtaccaaacgtcctaaccggacggtcctaacctttaagtttaaccggtacggttaccggtaaccgtcgttccgggtaccggtaaccacggtaactagtaactaccgtaggtccggtacgttcgggtcggtaccgtcggaccttaacggtacttaacgttccgaaccctacggtacgtaaactacggtacgtacggtacggacgggttagggaccggtagtcggggtaacgttgggttttacggtttagggttttaaccgtaccgtcggtaactaacgggttaccgtaaccgttaaaccgtaccgtaacccggtacgttcccggttaaccccgtttcgtttacgttaacgggttaaccggtaaccgggttacgggtaacccgtacgggggttaataaccggttaaacgaacggttaaaccggttccggtaacggttcccgaaaccggttccgtaaccggtttaaccgttccggttaacccgg

SEQ ID NO: 212149 - DNA, 1079 bp, Homo sapiens
  misc_feature: GYAE6OF02GR3PD.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctctgggtcccaggatccgggtggggatggttgtgatgactcagtctccactcctcccgtcgccccgtctacccgttgggcacggcccggcctccatcctcctgcgtaggtctaaggtacgaaacgcccttacggtacctaccggttagaacgttacggaaaacctacccgtttaacgttaggtaaacgttttcgggtaactttacgaacggacgaaacgggtaccgggacccgtaacggggtacccctaaaacggttccccgtaacccggaaaacggggtacccgttaaacccgttttaaaacgttttttaaacggtttaaaaccggggtttttaaccccggtaaaaccccggggggtacccgttttacccggggttaaccgggggggttaaacccccctaagggtaaacccgttaaacggttaacccggttttaaacccggaacggggtaccccggggtaaccgggtttaacgggggtttacccggggggtttaccggttacggggtaaccccgttaaaccggttttacgggttaaacctttttacccgaaacccgttaacggttaaccggaaaccgttaaacgtaccggtaaacgggtacccgggggtaaaggggggttaccgggggaacggggttaccggttaaaggggtacggggtttaaggttttacgggggtttttttaacggggttttttaaaccgtttacgggtttacggtaccgtttaaggttaccggttaaacccgtttaaaccgttaccgtaaccgttaaccgggttcccgtttaccccgttttaccggttttaaccgtttaaccggtttccgggaacccggggtaaccggggtaacggttaacggggtaacgggtaaacggtaaccgttaaaccggtaaaaccggttaacggttacgggttacggtaccggtacgtacccgttaccgaccgttttaccgg

SEQ ID NO: 212150 - DNA, 797 bp, Homo sapiens
  misc_feature: GYAE6OF02F2A8F.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctccgtggggctgctaatgactcgtgggtcccaggtactccgggtgggatgttgtgatgactcagtctccacttcctccctgcccgtcacccgtggcagcccgctccatcctctgactaggttctagtacgaacgccttcgtaacgtacgttagagtacggaaaaccctacccttagttacggtaagttcggtacttaccgaagtccgaaggaacggacccgaacggaccctaaacttccccgtaaccggaaacggtacccgttaacctttaaaaagttttaaacgggtttaaacggttttacccgggtaaaacccgggtccttaccgggttaccgggggtaaccccaaggtaaaccgtaggttaacctttaccggaacgggtccggtacggttacgggttacggggtaccgtacgggtacctaaccgttgtaaccgttttaccaacgtaacgttacgaactaacgtacaacgggtggtaaggggtcggtaaggaccgtaggtagggttagttttagggtttaggtttttactacgttacgacttacgtacgtaacctaattccgaccgtagttcccgtaccgtttccgttacgtacgtttaccgggacgttaacgggaccgtaacgggtcgtaaagaaccgtaacgtaaacgtagttcggacgttaccgtacgaccgtacgtacttcg

SEQ ID NO: 212151 - DNA, 708 bp, Homo sapiens
  misc_feature: GYAE6OF02FIP5C.43.86.H09.1.454.CMB.1.raw
tcagtgtgagtagtcacgaccggtgctcgatttagtgctatagacttggggtttggggctgggagacgagcccagcactggaagtcgccggtgtttccattcggtgatcagcactgaacacagaggactcaccatgggagtttggggctgagctgggttttcctcgttgctcttttaagaggtgtccagtgtcaggtgcagctggtggagtcgtgggggagacggtgggttcccaggcctggggaacgttccccgtgaccactctccgtgtgcagcctcgtggattcacctttcgaattaattatggcattgctacgtcgggtaccgccgaaggtcctccgtgggcctaagggggctaggggagtgggggtgctacgttagtatcgtatcgtaggtagtacgggaagttaacggaaacgttactacgggtacctaaggtacccgttaccgggtaggtaacggggacccgtacgtttaccgacctacgtccgttaccgaagggaacctaacgttaacgaacggtacgtacgtacttcgtacgtagtacgtacggtactaagtacgtaacctaacgaccgtagtaaccgtaccgttacggtaacggacggtacggtacgttaacgtttaacgttacgttacggttacggtacggtaacgggtacggtaagggttacgggttacgggggggtacgttaccggttaacccgg

SEQ ID NO: 212152 - DNA, 818 bp, Homo sapiens
  misc_feature: GYAE6OF02FMGR1.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctggggctgctaatgctcgtgggtcccaggatccgggtggggatgttgtgatgactcagtctccactcctccctgcccgtcacccgttggcacgcccggcctccatcctccgtgcgtaggttctagtagaaacgtcctacgtactacgttagactaggaaacctacctattagtaagttggtacttcagacaggtacggccgaggacctaatccgtaccgaacgggtcctaccttaaagttttaacgttaaacgggtttaccgtaaacccggggtacttccgggttaccggggtaccccaaggtaaccgagtaacgttccgacgggtccgggtacgtagggttacggggttcgttcgggtacctacgttacggtaacgttttacccgaaccgttaccgttacggtaaactaacgtaccggaagtaccgggtaaggggtagggtaacgggtccggttaagggtaacgggtttaggtttacgggttttttacggggttttttaaacgtttaccggttacgtacgttaacgttacgtaaccttaaaccgttccgtaaccgtaccgttccggttacccgtttccgtttaccgttaccggttttaccgggaccggttaacggggtaaccgtaaggggtacggtaaccgtaacgttaacccgtaaacggtacgttacggtacggtaccgtacgtacccgtaccgtacgttccg

SEQ ID NO: 212153 - DNA, 835 bp, Homo sapiens
  misc_feature: GYAE6OF02IPELU.43.86.H09.1.454.CMB.1.raw
  modified_base (160)..(160): a, c, t, g, unknown or other
  misc_feature (160)..(160): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccgggtgggattgttgngatgactcacgtctccactcctcccgtcgcccgtctacccgttggcacgcccggcctccactctccgtgcgagtactagtacgaacgtcctacgtactacgttgacgtacgaactaccgttacgttagtaagttggtaattccgagtacgaacggtaacggaccgacggtaaccctaacttaccgtaccgaacgggaccgttaacctttaaagttttaacgttaacggttttaccgtaaacccgggtccgttccggttaccgggggttacccaaggtaccgtacgttacttaccgacgggtccggtacggtaacggttcgggtccgttacgggacttaaccgttagttaccttaccacgtaacgtacgtaacaaaacgtcgaacggcgggtaaggggttacgggacggtcgtaacgggtagggttacgtttttcgggttttaaacggtttttacgttaccgtagttaccgtagttaccggtaaaccttaaccgttaccgacgttacccgggttaccttaccccgttttacccggttaccgttttaacgggttccgggacccggggttaaccggggaccggtttaaagggggtcgtaaaccggttaaccgttaaaccgaacgggttaacgttcgggttaacccgtcggtacgtaccccgtaacgtttagttcccgg

SEQ ID NO: 212154 - DNA, 808 bp, Homo sapiens
  misc_feature: GYAE6OF02JPHTP.43.86.H09.1.454.CMB.1.raw
  modified_base (168)..(168): a, c, t, g, unknown or other
  misc_feature (168)..(168): n is a, c, g, or t
  modified_base (463)..(463): a, c, t, g, unknown or other
  misc_feature (463)..(463): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctcgtggtccaggacgtccgggtgggatgttgtagatgactnagtctccactctcccgtgcctctaccgttggacacggcccggtcctaccgtatcctccgtagccgtaggtctagtacgaacgtcctaccgttactacgttgaacgtaccggaacctaccgttagttacgtaagtttacggtacttacgacgtacgaggaccggacgacggtaacctagtccctacgaacggtcctaacttaaacgtttagttaacggtttaccgtaccgggactcggtaccggggtacccaggtaaccaggtactacggacggtacggaccttgggtacgggtcncgggtacaggtttagttacctttacccgacgtaccgtagtaacctacgtactacgggtacgggtacgggtagggaaccggtggttaaccgggtaaggtttcgggtttaagggttttttacggttttacgttaaccggttagtaccgtaacgtacgttaaaccgttaaccgttaccgtaacccggttaacggttccggttttaaccccgttttcgtttacccggtttaaacgggtttaccgggacccggggtaaacgggttacccggttagggtacccggttaaggttaaccgaacccgtaaggttacgtcggtacggccttacggaacccggtacttagttaccg

SEQ ID NO: 212155 - DNA, 876 bp, Homo sapiens
  misc_feature: GYAE6OF02F08B1.43.86.H09.1.454.CMB.1.raw
tcagtgtgagtagtcacgaccggtgctcgatttagtgctatagacttgggtttggggactgatcaggactcctcagttcaccttcgtcacaatgaggctccctgctcagctcctgggctgctaatgctactggtcccaggatccggtggggatgttgtgatgactcagtctccactctccctgcccgtcacccttggcagccggcctccgatctctgcagtcagtgaagcctcgtacacgttgataggaacacctacgttcgaagttcggtatttccaagtcgagacggacctacggaccctaacgtccgtaccgaaacgggtacccgtccgtttaacgttttaaacgtaacgggtttttaaccccgtaaacccgggggtaaccctttccggttaccggggggttaccccctaacgggtaaccgtaacggtaaccggttttaccgaaggggttcccgggaccgtaacgggggttacggggtttccgtacgggggtaccttaaccgttacgggtttaacgttttaccccgtaaccggttaccgttacggtaaaccgtaaacgtttaccgaaacggggtcgtaaacggggggttacgggtaaacccgggtacgggtttaaccgggtaagggtaacgggtttttaccgggttttaggggggttttttttaaaccttaccggtttaacgtcggttaaacgttacgggtaacctaaaccgtttacccgtaaaccgttcgggttaaccgttcccgtttacccgtttccgttaaccggtttttccgggacccgtacgggtaaccgtaacggtacggtaacgtacgtaaccgtaaacgtacggttacggtacgtaccggtacgacccgtaccgtagttacccgg

SEQ ID NO: 212156 - DNA, 826 bp, Homo sapiens
  misc_feature: GYAE6OF02FHUQA.43.86.H09.1.454.CMB.1.raw
tcagtgtgagtagtcacgaccggtgctcgatttagtgctatagacttgggtttggggactgatcaggactcctcagttcaccttctcacaatgaggctcctgctcagctcctggggctgctaatcgctcgtcgggtccaggtctccgggtgggtatgttagtgtatgacgtctacgtcctcctaccgtcctacccgtcgtcccgtacctacccgttcgggactacggccccgggtacctaccgtacgtcctccgtcgacctaggttcctaaggtacgaacggtcctaccgtaaccgtacggttaggagtaaccggtaaacctaccttacgttacgtaaggttacggtaccttacgacgtacgtaacgggcgacccgtacggtaacctaactccgtaacgaggtaccgttactttaaagtttaacgttaaacggtttaccgtaacggtccgtacggtaccgggtacctaaggtacgtacgtaacgttcggaacggtcggtacgggtagggtcggtacggtcgtaccgttacgtacttacttaccgactacgtacgtaacgtaactacggagggtacggtagggtacgggtacgtacggtacgggaagggtttgtttacgggttttacggtttacgttacgtacgtaccgtagggtaccctaaacgtaaccttacgtaacccggtactttccggttacccgttccttaccggttacgttaccggggtacccggtagggtaaccctaggggtacgtaaaccgtacgttaaaccgtaccgtacggttcggacggtaacccgttaccggaccttaccggttacttacccgg

SEQ ID NO: 212157 - DNA, 789 bp, Homo sapiens
  misc_feature: GYAE6OF02H1T21.43.86.H09.1.454.CMB.1.raw
  modified_base (499)..(499): a, c, t, g, unknown or other
  misc_feature (499)..(499): n is a, c, g, or t
tcagtgtgagtagtcacgaccggtgctcgatttagtgctatagacttgggtttggggactgatcaggactcctcagttcaccttctcacaatgaggcctccctgctcagctccgtggggctgctaatcgctcgtacgggtcccaggacgttccgggtaggggtattggttgtagactgacctcacgtctccactcctccgtcgcccgtcgacccgttgggccacggcccggacctcctatccgtccgtgaccgtaggtctaaggtacgaaacgtccgtacgtactacggttagacgttacggaaaacctcgttaacgtagtaagttaggacttacgagccgtaagggcggaccgagtaccctaaaggtccctaaccggaacggtccttactttaaagtttaacggttaacggttccgaaaccgggtcttaccggtcgggtacccaaggtaccagttactcggacgcggtcgtaggtcggtacgtcggactagttacgtnttaccacgtacgtagacgtaacgtcgacgtacgggtagggtcggtaaggtcggtaggttaaggtaggttttcgggttttaacggttttaagttacgtagtaccgtaagtaccgtaaaccgttaaccttaccggtaacgttaccggttaccgggttcccttttaccgggttacgttaaccgggttacgggaccgggtaaccggggttacggttaacgggtacggaccgttaacgtaaccggtaaacggtcggttacggtaccgacgttaccggcctacgttaccgttaccg

SEQ ID NO: 212158 - DNA, 718 bp, Homo sapiens
  misc_feature: GYAE6OF02G55BX.43.86.H09.1.454.CMB.1.raw
  modified_base (534)..(534): a, c, t, g, unknown or other
  misc_feature (534)..(534): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctcgtgggtcccaggatccgggtggggatgttgtgatgactcagtctccacttcctccctcgcccgtccacccgttgggccacggccggccctccactcctcctgctaggtctaagtgaaacgtcctacgtacacgttagaagtacggaaacctacctaacgttgtaaagtttggacttacgagtacgaaggacggaccgaggtaacccaaatccgtaccgaacggaccgtacctttaaagtttaacttaacgggtttaaccgtaacccgggtagttccggtaccgggggtaccaaaggactaacggtacttagaacggcggcgtagggttcgggtacgtcggacgtacgttacgtagtttacaacgacgtacgaactaagtacacgacggtagggtaggaggtacgnggtaaggttagttcggttttaggttttattacgtgtactagtacgtaactaaccgttactaccgtacgtacgttaccgttcccgtttattccgtttacggaccggtaggaccggtaaggtaggaaccgtagtaaaccgtaacgtacgtacggtacggttacgactaaccggtcttagttaaccg

SEQ ID NO: 212159 - DNA, 911 bp, Homo sapiens
  misc_feature: GYAE6OF02HO34J.43.86.H09.1.454.CMB.1.raw
tcagtgtgagtagtcacgaccggtgctcgatttagtgctatagacttgggtttggggactgatcaggactcctcagttccaccttctcacaatgaggctccctgctcagctcctggggctgctaatgctcgtgggtcccaggatccgggtggggattgttgtagatgactcagtctccactcctcctgccctcaccgtggcagccgcctcatctctgctagtctagtagaacgcctacgtacacgttagatacggtaaacctacgttacgttagtaagttgtacttcgaaggtacaaggaccggtacccgaacgggtaaccctaaacgttcccgttaaccggaacgggtacccgtaaacctttaaagttttaacggtttaaaccgggttttacccgtaaacccggggttacctttaccgggtacccggggttacccaacggtaaccgtaacgtactttaccggacgggtaccggtaccggttagggtcgggtaccgtcgggacctacgttacggttactttacgacctaacgtacggtaacctaactacggtaacggtcgggtaacggggttacgggtaacggtaccggttaagggtaccggggtttaagtttttacgggggttttttaacgggtttttaaactttaccggacggttaacgttaaccggttaacggtaaacccctttaaaccggttcccgtaaaaccgtttccgggttaacccggggttacccgtttttaaccccggtttacccttttaacccggggtttaacggggaaccccgggttaacggggtaaccgtttaaagggggtccgtaacggttaaaccgtaaacccggtaaaacgggttaccggtttacggtaccgggtaccgttacccggtaacccgttaccggtacccgtttacccgg

SEQ ID NO: 212160 - DNA, 477 bp, Homo sapiens
  misc_feature: GYAE6OF02FMVX5.43.86.H09.1.454.CMB.1.raw
  modified_base (279)..(279): a, c, t, g, unknown or other
  misc_feature (279)..(279): n is a, c, g, or t
  modified_base (436)..(477): a, c, t, g, unknown or other
  misc_feature (436)..(477): n is a, c, g, or t
tcagtgtgagtagtcacgaccggtgctcgatttagtgctatagacttgggtttggggggactgatcaggactcctcagttcaccttctcacaatgaggctccctgctcagctcctgggggctgctaatgctctgggtcccaggatccgggtgggggatggttgtgatgactcagtctccactctccctgcccgtcacccttgggcagccggcctccatcctcctggctaggtctagtagaaacgcctcgtacacggttgagtcggaaacaacctacttnaagttggtatctaagccagacgggccaggacccaatctaccgaagggaccgccgttaaatttaacgttaaacggttttacgtaaacccgggtacttccgtgggggttacccaaggacagtaattaccaggcggacaggtgggttcgtggcgacttgnnnnnnnnnnnnnnnnnnnnnnnnnnnnnnnnnnnnnnnnnn

SEQ ID NO: 212161 - DNA, 781 bp, Homo sapiens
  misc_feature: GYAE6OF02HLTW6.43.86.H09.1.454.CMB.1.raw
  modified_base (474)..(474): a, c, t, g, unknown or other
  misc_feature (474)..(474): n is a, c, g, or t
tcagtgtgagtagtcacgaccggtgctcgatttagtgctatagacttgggtttgggactgatcaggactcctcagttcaccttctcacaatgagctccctgctcagctcctgggctgctaatgctcgtcggtcccagtatccggtgggtattgttaggtgatacgtactcgtacgtcctccacttcctcccgtgtccccgtactcccgtggacgacggtccgtccctacgctccgtctacgcgttacgtcgtagtagaaaccgtccgttacgtactacgtttacgagtaacggaaaccctacgttacgtttaagagttggtacttaccgagtacgtaggaccgccgtacggaccctaagtccaaccgtagaccgttacttaaaacgtttacgttaacggtttaccgacgggtaccttcgggttccggtaaccagtaccgtaggtctaacggaccgtcggtcgtaggttcgtacncggtactaccgtagttacctcgtaacccgtgtaactaccgtacgttacgtaacggaccggtagggtacgggttacggacggttaacggttagggttaacgggtttacggttttacgggttttaaccgttacgtacgttaaccgttcggtaacgttaacccgttaaccgtacgtacccgttaccggttcgttacccggttacctttacgtacccggttacggacgtaccggtaaggtcggttacgaacgttacggaaacccgtacgtaacgttcggtaccgtagtacccgtacttacctacgttaccg

SEQ ID NO: 212162 - DNA, 897 bp, Homo sapiens
  misc_feature: GYAE6OF02JKU9Y.43.86.H09.1.454.CMB.1.raw
  modified_base (579)..(579): a, c, t, g, unknown or other
  misc_feature (579)..(579): n is a, c, g, or t
tcagtgtgagtagtcacgaccggtgctcgatttagtgctatagacttggggtttggggggactgatcaggactcctcagttcaccttctcacaatgagctccctgctcagctccgtggggctgctaatcgctcgtcgggtcccaggacgtccggggtggggtattggttgtaggtatcgtactcacgttcctcctacctccttcccctcggtccccgttccacccggttgggccacggcccgtcctacctcttccctccgtcggcgtacggttactaagggtacgaaccgtcccgttacgtaaccgtaggttacgaacgttaccggtaaacctacccttaagttaggtaacgttacggttactcggagtaccgtagggaccggtacccgtaacggtccctaaaccttcccgaaccggaaccgggttccgttaaaccttttaaaggtttaaaccggttaacgggttttacccgggaaacccggtaccgtttccgggtaccgggggtacccaacgggtactaaacggtcgttaccggaacggtccggtaacggtggggttccggtcgtacggacgtttacngtttaaccgtacacgtaccgtaaacgtaccgtaacgtccgacggtacgggttagggtacgggtacgtcgtaagggtacgttagggtttacgggttttacggtttagttaccgtacggtactacgggttactaacctacgttaccaacggttccgtacgttcccgtttcggttaccggttaaccggtttccggggaaggttacccggggaaacgtttacgggggtaacttaacggttaacccgggtaacgttaaccggttacgggtttaaccggtcgggttacccgtaaccgtaacccgttaggtacccggtttaccgg

SEQ ID NO: 212163 - DNA, 840 bp, Homo sapiens
  misc_feature: GYAE6OF02IK51R.43.86.H09.1.454.CMB.1.raw
tcagtgtgagtagtcacgaccggtgctcgatttagtgctatagacttggggtttgggggactgatcaggactcctcagttcaccttctcacaatgaggctccctgctcagctcctggggctgctaatgctcgtgggtcccaggatccgggtggggattgttgtgatgactcagtcctccactcctccctcgcccgtcaccgttggcacgccggcctccatctcctgcgtagtactaggtacgaaacgtcctacgtacgacgtttagaactacggaaaacctaccttaacgttagtaacgtttggactttcgacggtactaggaccggacccgacggtaccctaaactccgtaaccgaacgggaccttaaccgtttaaaagtttaacgttaacgggttttaccgaaacccgggtacgttacgggtaccggggtacccaaggacgtacgttacttccgaacgggtcgacgtacgggttcggtaccgtacgggtactaaccgttaggtaccttttaccgaaccgttacgtaacgaactaaacgtcgacgggtaccggtaaggggtacggaggacgtaggggtaacgttaggttttacgggtttttttaacgggtttaactttaaccggtcgggtaaactacttacgggtaaacccctttaaagtcccgtaaaccgttaaccggttccgggttaccccttttaaccgggttttaaccgttccgggttttaaccggggaccgggttaacgggggtaacctagggggttacgtaaccggtaagttaaaccccgttaaggtaaccggttcggtacggtccgtaacgacccgttagtaaccgtttccg

SEQ ID NO: 212164 - DNA, 827 bp, Homo sapiens
  misc_feature: GYAE6OF02IISEW.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctccgtggggctgctaatgctctgggtcccaggatcggtgggatggttgtgatgactcagtctaccacttcctcccgtgacccgtcacccgttgggcacggccggcctccatcctcctagcgtaggtctaaggtcgaaacgcctacgtacacggtttgaactcggaaacctacctacgttgtaagttggtacttacgaacgcgtaaacggcgggacccgaacgggtacctaaaactccgttaaccgaaacggggtcccgtaaccctttaaaaattttacggttaaaacggtttttacccggaaaacccgggggtactttaaccgggttccggggggtaccctaaagggtaaccacggtacgtttacgaacgggtaccggccgtaagggtttacggggtcgtgggtacctacggttacggttaacttttacggaacctaacgtacggtaacgtaaactccgtaaaggcggtaaggggtaccgggaaggtcgtaacggtaaagggtttaggttacggtttttagggttttaactttaccgggtagttaccgtagttaccgtaaaccgttaaagttaccctacgttacggtaccggttcccgtttacccgtttaacgtttacgtttaccgggaccggtaacggggtacggtaacggggtaacggtacgtacgttaaacgaaaccgtacggtggtacggttcacggtacctaccgtacgttac

SEQ ID NO: 212165 - DNA, 737 bp, Homo sapiens
  misc_feature: GYAE6OF02HJYX1.43.86.H09.1.454.CMB.1.raw
  modified_base (527)..(527): a, c, t, g, unknown or other
  misc_feature (527)..(527): n is a, c, g, or t
  modified_base (595)..(595): a, c, t, g, unknown or other
  misc_feature (595)..(595): n is a, c, g, or t
tcagtgtgagtagtcacgaccggtgctcgatttagtgctatagacttgggtttggggactgatcaggactcctcagttcaccttctcacaatgaggctccctgctcagctccgtggggctgctaatgctcgtgggtcccaggactccgggtggggattggttgtagatggactcagtcctccactctcccgtgcccgtacacccgttgggcacggccggcctcgactctccgtgcgtacggtctagtacgaacgtcctacgtactacgttgaagtacggaaacctcttaacttgtaacgttggacttcgagtcgaagggtaccgcccaaagggtaccctaaacttccggaaacccgtaaggccgttaaaccctttaaaagttttaaacggttaaaccggggtttaccccggtaaaaccggggtccttccgggtaaccgggggttacccaacggtaactacgtacgttacgacgggtacgtacgtaagggttcgggtctcggactacggtgttacttcatcgacgtanaacgtcgaggtacggacgggtaggacgtcggtaaggtcggttaggtttacggttttagggtttaaccncgtagtatacgtacgtaaccgtaaacttcctaaacgtcgttaccgttccttaccggtttacgtacgtttccgggaaccgagggtaaacgtgggtaacgaacttaggtaaccaagtcgtggtacgctcggtacaccttgtacc

SEQ ID NO: 212166 - DNA, 871 bp, Homo sapiens
  misc_feature: GYAE6OF02I4NLC.43.86.H09.1.454.CMB.1.raw
tcagtgtgagtagtcacgaccggtgctcgatttagtgctatagacttgggtttggggactgatcaggactcctcagttcaccttctcacaatgaggctccctgctcagctcctgggctgctaatgctctcgggtcccaggatccggtggggtattggttgtagtacgttgactcgtacggtcctccacttccttccccgtcggccccgtccgtaccccgttcgggccgtacggtcccgggtccctcctaacttccgttccctggtaccggacggttccttaaggtaagaaaccggtcccgttacgtacgtaaccggtttgaagttacggaaacctacctacgttagaacgtggtacttacgagcgaagtacggcctaacggacctaacgttccgaccgaacggtccggtaaccttaagtttaacgtaacgggtttaccgtaaaccgggtcgttacggtaccgggggtacctacggtaacccgaaggttcgttccgaacgggtccggtacggtaacgggtacgggttctacggggcctaacggttcgtaacgtttacccgtacgtaaccgtaaacggtactaacgtccgaaacggtacgggtaaaggggttacgggaaggtccggtaggtaggttacggtttggtttacgggttttaaattccggtacgtacgtaccgttaacgtcgttaaaccttccgaaccttacgggtcgttaaccccggtttcccgttaaccgtttaacggttttaccgggacccgggtaacgggggtacccgtaaacggggttcggtaacggtaacgttaaacggtaaacccggtaacgttacgggttccgtaaccgggcctaaccggtacccgtaccgttaccggg

SEQ ID NO: 212167 - DNA, 901 bp, Homo sapiens
  misc_feature: GYAE6OF02I71ZE.43.86.H09.1.454.CMB.1.raw
  modified_base (187)..(187): a, c, t, g, unknown or other
  misc_feature (187)..(187): n is a, c, g, or t
  modified_base (219)..(219): a, c, t, g, unknown or other
  misc_feature (219)..(219): n is a, c, g, or t
  modified_base (522)..(522): a, c, t, g, unknown or other
  misc_feature (522)..(522): n is a, c, g, or t
  modified_base (860)..(860): a, c, t, g, unknown or other
  misc_feature (860)..(860): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagtccttgggtttttcctcggttgctttctttttaaaggngggttcgtccctaggttcgtccgtaagggttnaccgtggccttaggggttcgggacggtttcggtaggggggtaagtaccggttcggacccgtacgggttcccgtaggggtaaccggttccccctggaacccgtaccttccgtttccgtcggttcggactacgtcccttacgttacggttaacttccgtaacccgtttaacgacgtttaaaagttccggtggtaccgtactccggtacgttaaccggttccgggacccttaccggtaaccggtccgtccggacgggtaccgggtaacgggggtccgtttagggggtacggggttcgggggtaacncgtttaaacccggttaatttacccggttaagttaaccgttcggttaacggggtaacggtttaaacgggtaaaggtttaaaccgggtaaaccttaaccgggttaacacccgggtaagtttacccggtacccggtaaacggggtaacccggttacccgtttaaacggtaccctttacccgtaccggtaccgttaaccggaaccgggtaacctttaaaccgggtacgtacccggtacggtaaccttacccgttaagttccttaacgtacccgtagtactaaacgtaccggactacgaccgttcaaccgttcgacggtcgacgtaggactttcgtacgtacncggtgcgaggtcggtaggtacgggttaggacgtcgtaacgg

SEQ ID NO: 212168 - DNA, 984 bp, Homo sapiens
  misc_feature: GYAE6OF02GXA8G.43.86.H09.1.454.CMB.1.raw
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
tcagtgtgagtagtcacgaccggtgctcgatttagtgctatagacttgggtttgggctgggagacgagcccagcactggaagtcgccggtgtttccattcggtgatcagcactgaacacagaggactcaccatggagtttgggctgagcttgggttttcctcgttgctcgttttaagaggtntccagtgtcaggtncagctggtggagtcgtgggggganacggttcggtacccaggtcccgtagggggtaacgtcccccgttaggaccctacgttcccgttacccgttggtacgcgtaacggccccgttaccgtttaggggtaacttttcccgtaaacccctttttaccgaaaaacgtttaaaacgttttaaagttacggggtaacccctaaagtttacgggtacccgtaaccggtttcggggggttacccccggttaaccccgacgggggttacctaccccggtttacggggacccggtaaaaacggggggggtcccttaggggggttaaaccgggtttcggggggttacggggtaacccgttaaccggtttttaaaacgtaccggttaaccgtaaacgttaccggttaccgggttaaaggtttaaccgggggtaaaacggtttaaaacggggttaaaacggtttaaacccgtaacccgggtaccgtaaccggttaaccgttacccgggttaacgggaaaccggggttacccggttaacgtttaaccgtacccgtaacgttcctaacccgggtaacgggtaaccgtaacttaaaccgtacggtaccgaccgttaaccgttacgttacgtaattacgtacggtactaaacggttacgaaacggtaccgccgttaacgacccgtaaccgtaggtaaccgggacgtacgggttaacgtttacgtttaaacgttacgttaacggttacggtaggtacggtacgggttaacggaacggtttagggggtaccgttacgttaacccggg

SEQ ID NO: 212169 - DNA, 726 bp, Homo sapiens
  misc_feature: GYAE6OF02IT9FT.43.86.H09.1.454.CMB.1.raw
  modified_base (325)..(325): a, c, t, g, unknown or other
  misc_feature (325)..(325): n is a, c, g, or t
  modified_base (394)..(394): a, c, t, g, unknown or other
  misc_feature (394)..(394): n is a, c, g, or t
  modified_base (456)..(456): a, c, t, g, unknown or other
  misc_feature (456)..(456): n is a, c, g, or t
tcagtgtgagtagtcacgaccggtgctcgatttagtgctatagacttgggtttgggctgggagacgagcccagcactggaagtcgccggtgtttccagttcggtgatcagcactgaacacgagagactcacagtggtagtttggctgacgtcgttcgggttttcctcgttgacttacgttttaagaggttcgtaccgtagtcgtcgaaggtcgacgtgcgtggtggacgttcggacggggacgtacggtcgtaccgtaggtaccgtacgggaaccgttcccgaggtcctaccgtctccgtagtcgtccgacgtcgtcgtacggtnttaccgtccttaaataaattacttgcgtactacgtacgacggttcgtccgggtcccaccgtacgttccncggtagacggtagggtcgtgggtagttcgggaactacgttactaagtcctaatccgttaagngtacggtaagaaccggtaaagtaacgacgccgttaagacgtttacccgacggtaaggtaccgtcgttacaccggtactaccgtaccgtacgaacggtaaactaacgtaccgtacggaccactacgtaccgttactacgttactaggtaacctagtaacgaacgtcgttaacgaccgttcgaacggacgtaagtaccgttaagttaccgttaagtaccgtagtacgtgacgtaacggagttacggacgggtacggttacgacgttaaccgg

SEQ ID NO: 212170 - DNA, 688 bp, Homo sapiens
  misc_feature: GYAE6OF02JDTBR.43.86.H09.1.454.CMB.1.raw
  modified_base (526)..(526): a, c, t, g, unknown or other
  misc_feature (526)..(526): n is a, c, g, or t
  modified_base (683)..(683): a, c, t, g, unknown or other
  misc_feature (683)..(683): n is a, c, g, or t
tcagtgtgagtagtcacgaccggtgctcgatttagtgctatagacttgggtttggggactgatcaggactcctcagttcaccttctcacaatgaggctccctgctcagctcctggggctgctaatgctcgtgggtcccaggactccgggtggggattggttgtgatcgactcagtctccactcctcctcgcccgtcaccgtgggcagccgcctcatctcctgcgagtctagtacgaacgtccgtacgtacacgttagagtaacggaaacctacctagttacgtaaatttggaacttcgacggtacaagggacggtaccgaacggtacctaaacgttccgtaaccggacggtccggtaacctttaagttttaaacgttaacgggttttacccgtaaaccgggttaccgttgggttaccgggggaccctaagtaccgtaggttaactcggacggcggaacgttgggtacggtcgtacgcgtacgtagtttacttcaactcgtactaactaagtcgacgacggtagggnggacgtcggtagtaggttggttacggtttggtttagtctcgtacgtagtcgaactacttcgaactcgtcgtccgttacttcgttacgttcggaccgtagggtaacgtcggtggaacgtactaacgtaaccgtagtcggcggtacctagcctaccgtnttccg

SEQ ID NO: 212171 - DNA, 833 bp, Homo sapiens
  misc_feature: GYAE6OF02FOBGK.43.86.H09.1.454.CMB.1.raw
  modified_base (232)..(232): a, c, t, g, unknown or other
  misc_feature (232)..(232): n is a, c, g, or t
  modified_base (478)..(478): a, c, t, g, unknown or other
  misc_feature (478)..(478): n is a, c, g, or t
tcagtgtgagtagtcacgaccggtgctcgatttagtgctatagacttgggtttgggggactgatcaggactcctcagttcaccttctcacaatgaggctccctgctcagctcctggggctgctaatgctcgtgggtcccaggactccgggtggggatggttcgtgatgactcagtcctaccacttcctccctgcccgtactacccgttgggcacggcccggcctccattccnccgtgctaggtctaaggtacgaaacggtccttacggtaacctaacggttgaacgttaaccgaaactacctacgtttagaatttacggtaacttcaagtcggaacgacggtacccgaggtaccctaaacttccgtaaccgaacggtacctactttaaacgtttaaggttaaacggtttaaccgtaacggtacgttccggttacgggggtaccctaagtaccgtaaggttactacgacgggtaccggngtttaagggtcgggttcgtcgggtaccgttaacgtagtttaccgttaccacgaacttacggaactaaaccttacgaagggtccggtaagggggttaagggacggtacggtaagggtagggttaaggttttacgggtttttagggttttaggttaaaccgtcggtaactttaacggtacggttaaactaaacccgttaccgtaccgttaccggtacccgtaccgtttaaccggtttaccgtttaaccgggtttaccgggaacccgttacggggtaaaccgacgggggttacgtaagaaacccgttaaggaaaccggtaacggttacggtcgttacgtacgccttacctacgttccg

SEQ ID NO: 212172 - DNA, 694 bp, Homo sapiens
  misc_feature: GYAE6OF02ITXPX.43.86.H09.1.454.CMB.1.raw
  modified_base (245)..(245): a, c, t, g, unknown or other
  misc_feature (245)..(245): n is a, c, g, or t
tcagtgtgagtagtcacgaccggtgctcgatttagtgctatagacttgggtttggggactgatcaggactcctcagttcaccttctcacaatgaggctccctgctcagctcctgggctgctaatgctctgggtcccaggatccggtggggattgttgtgatgactcagtcctccactctccctgcccgtcacccttgggcagccggcctccatctccgtgcaggtctagtcgaaagcctcgtacncgttgataggaaacctacctacgttagaattaggattcgagcgagtacggaccgacggacctaactccgtaccgaagggtccgtaaccttaaagttttaacgttaaacggttttaccgtaaaccgggtacttccggttcgggggtacccaacggactaagtacttcgacgccggactaggtcgggtctacggctaacgtgtactttcgactacgtcgtaacaatacgacggacggtaagggtggtacggtcgtaggtaggtaggtttggttttacgggttttattacgtcggtataagttcgaacttaacttaccgtaaccgtaccgttccggtacctttacccggttaacttcccggttttacggtacccggtagggtaacttacgggtaaggtcgaaagtacgtaaacgtaaccggagtacggttccgacgtacgacctaccgtacg

SEQ ID NO: 212173 - DNA, 812 bp, Homo sapiens
  misc_feature: GYAE6OF02JO6IH.43.86.H09.1.454.CMB.1.raw
  modified_base (528)..(528): a, c, t, g, unknown or other
  misc_feature (528)..(528): n is a, c, g, or t
  modified_base (570)..(570): a, c, t, g, unknown or other
  misc_feature (570)..(570): n is a, c, g, or t
tcagtgtgagtagtcacgaccggtgctcgatttagtgctatagacttgggtttggggactgatcaggactcctcagttcaccttctcacaatgaggctcctgctcagctccgtgggctgctaatgctctcgcgtcccgaggtacgtccggggtggggattggttggtggtatacgtactcgagtcctacctcgtcctcccgtcgccccgtaccgtcccgttgggacctccggtcccggtacctacctctcccttccggttcgaaccgtagggttaccgttaagggtaaccgtaaaccggtccgtaaccggttaaccttaacggttagaaccgtaacggaaaaccttaccgtaagttacgtaagttcggtacttacgacgacgaaccggtacggtaccgtaaccggtactaacgtacccgtacccgggaacggttaccgttaaccttttaaaagttttaacgggtttaaccgttacccgggtaacggttaccgtccggttacgggaaccctagaccgtagtacgtccgnggtaccgcgtacggtcggtcacgttctacgtacgtacttacnctacgtactaaccgagtacgtcggaaagggttgggtacggtacggtacgtaggttaacggttgttttagggtttacggttaagttcctacggtagtcgttaacgtaccgtaacgttcaacgttacccggttcgttacgttcccgttaaggttccggttacgggacgacggttaacggtgggtactaaccggtcgtaaacgtaacggttaggttcgaaaccggttccgaactcgtagttcccg

SEQ ID NO: 212174 - DNA, 774 bp, Homo sapiens
  misc_feature: GYAE6OF02GG1CN.43.86.H09.1.454.CMB.1.raw
  modified_base (218)..(218): a, c, t, g, unknown or other
  misc_feature (218)..(218): n is a, c, g, or t
tcagtgtgagtagtcacgaccggtgctcgatttagtgctatagacttgggtttggggctgggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtggggganacgtggtccagccgtagggaacgtccctgacactctcctgtgcagccctcgtggtacttccgaacctttaccaaaatttaaatttacgtgggtacctaatcggactaaccggttcgggggttccccacccggaacggtcctccggttacgggaccgaaagggggtccgtggggaggttcgggggtcggtaccgtaactttaagacttaccgaagttcgttacggtagtaacgggtaaagtaaggaaaaacgtaccgttaacgacgtaacggtaccgttacgggtaacgggtaacgggtaccgtacttacccgaaacgtaccgttacccgtaccggtaacgggtaaaccgtaaacgttaaccgtaacggaccggtaccctaacgttcttacgttacgtacgtacgaactaacgtacgaacgacgtaccgttacgaaccgtaccgtaggaacggtacggaacgtacgtttaactttaacgttacggttacggtacggtaacggtacggtaacggtaagggttacgggttacggggggttactaccggtttaacccggg

SEQ ID NO: 212175 - DNA, 737 bp, Homo sapiens
  misc_feature: GYAE6OF02HL3UE.43.86.H09.1.454.CMB.1.raw
  modified_base (215)..(215): a, c, t, g, unknown or other
  misc_feature (215)..(215): n is a, c, g, or t
  modified_base (306)..(306): a, c, t, g, unknown or other
  misc_feature (306)..(306): n is a, c, g, or t
  modified_base (336)..(337): a, c, t, g, unknown or other
  misc_feature (336)..(337): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (624)..(624): a, c, t, g, unknown or other
  misc_feature (624)..(624): n is a, c, g, or t
tcagtgtgagtagtcacgaccggtgctcgatttagtgctatagacttggggtttgggggctggggagacgagcccagcactggaagtcgccggtgtttccattcggtgatcagcactgaacacagaggactcaccagtgggtagtttgggctggagcgttgggttttcctcgttgtcttgttttaaggaggtcgtccgtatggtcgtaggtgcgngtcgtgggtgggacggtcgggtagggggacgtcggtggtcgtacgcggtagggtaacgtccgtagaacctccttccgtcgtggtcggcgcncctgtgtactctactactaataattgtcgnntgacgtcgtcggtccacgtgcctcggtacggacgggacgggtcgtgggtagggtcggggtatacctagttacnctactacgtaacggngtagtaaggtaaggtaacggtaacgtactaacgggctacggtacggtacgtacgggaccgacgttcctacgactaccgtacgtaaccggaagtaaactagtaacggacgcctacacttacgttcgtacttcgaacccggaaattaacccggtagaacccgtcggtaaccctaagggacctaaaacggggttacgggaanaacccggggttctttaagtttaaacctttacggaggtccgggttaaacgggaccgtttaaggacggggtacggggttaaggggtttccgggacccgttacgttaacccggggg

SEQ ID NO: 212176 - DNA, 795 bp, Homo sapiens
  misc_feature: GYAE6OF02IVMID.43.86.H09.1.454.CMB.1.raw
tcagtgtgagtagtcacgaccggtgctcgatttagtgctatagactttgggtttgggggactgatcaggactcctcagttcaccttctcacaatgaggcctccctgctcagctcctgggctgactaatgctctcgggtcccaggactcgggtgggattgttgtgatcgactctagttcctacctacttcctccctcgcccgtcctacccgttggcacggcccggcctacctagttcctaccgtgccgtaggttcgtacggtagaaacggtcccgttacgtaacgtacggttagaacgtacggaaaacctacctttacgttaggtaacgtttggacttacgagaccgaagacgggccaccggtaccaactccgtacccgtaaggcccttactttaaagttttacgtaaacggttttaccgtaccgggtacgttcgtcggggacccagacgtagtactacgacgtcggacgtagggtcggtcgtaggtactacgttacgtacttccgaaccgtgtaacgtacctaataccgaggtaacgtcggggttagacgggtcggtacggtaggtcggtttaacgggttttaggttttaccttagttacgtataacggttacgtaaacctttaattaccgtacgtaacgttccgggtttaactttcccgtttaaacgttccgggtttccggggaacgggttaacggtaccgggtaacggttaccggggtaactaccggtaaacggttaaacccggtacgttacggggtcgtaacgttacccgtaccgtacctttacgtacccgg

SEQ ID NO: 212177 - DNA, 723 bp, Homo sapiens
  misc_feature: GYAE6OF02GLVHJ.43.86.H09.1.454.CMB.1.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
tcagtgtgagtagtcacgaccggtgctcgatttagtgctatagacttgggtttgggactgatcaggactcctcagttcaccttctcacaatgaggctccctgctcgagctcctggggctgctaatgctctggcccaggatccgggtgggatgttgtgtagtcgtactcgtagtcctccgacttcctacccgtgccctcacccgttggcancccggctacagtcctcgtagcgtgtacgttaganaacgtccttagtcctagttgatacgaactcttagtacgtaagttgtacttacgacgtagacggcggtaccaggaacctaacgtacccgtaaccggaggtaccttaacgttaacttttacggttacggtttaaccgtaaccggacgtttccggtacgtaccgtacgtacggttaactacgttacgaaccggtggtacgtcgggtcgttacgacgtctaggttacgtaactttccgaaacgtcttaaccgaactaagtaccgtaacgttccgggaaggttacccgggaagtccgttaagggaacgggtttgtttaagggttttacgtttacgtcgttgtaacctaggtactacgtaacttacgtacgtcgtacgtcctttacggtccttacggttcgaccgtacgggtaatcgggactttacgaccggttaacgtaaccgtaggttacggtagttcccgagttcccgacgttccttaccgg

SEQ ID NO: 212178 - DNA, 777 bp, Homo sapiens
  misc_feature: GYAE6OF02GG2IN.43.86.H09.1.454.CMB.1.raw
tcagtgtgagtagtcacgaccggtgctcgatttagtgctatagacttgggtttgggggactgatcaggactcctcagttcaccttctcacaatgaggctccctgctcagctcctggggctgctaatgctctgggtcccaggatccggtgggatgttgtgatgactcagtctccactcctccctgcccgtcacccgttggcacggccggcctccactcctcctgcgtaggtctagtagaacgtcctacgtacacggttgacgtacggaaacctaccttacgttagtaagttggtacttcgagtcgaaggacggtaccaacggacctaattcccgtaccgtaacgggcctaacctttaaagttttaacgttaaacgggtttacccgtaaaccgggtccgtttaccggttccgggggtacccctaaggtaccgtaagttacgttacccggaagggaccggtacgtaacgggttggggttaacccgtcgggtacctaccggttacggttaacctttaccgaaaccgttacgtacgaaacctaacgtaccggagggtaccgggaggggttacgggaacgggttccgtaagggtacggttaggttttacggggttttaagtttttacgtacgtcgtacttacgtaccggtaacttaaccttcgaacgttcgttccgtaccgttccttacgttacgttacgggaccggtacgggaccgtagggtcgaacgttacgtaaccgtacggtagttacggtcgtacgtaccgcccgtacgttgttaccg

SEQ ID NO: 212179 - DNA, 959 bp, Homo sapiens
  misc_feature: GYAE6OF02GW9S6.43.86.H09.1.454.CMB.1.raw
  modified_base (168)..(168): a, c, t, g, unknown or other
  misc_feature (168)..(168): n is a, c, g, or t
  modified_base (191)..(191): a, c, t, g, unknown or other
  misc_feature (191)..(191): n is a, c, g, or t
tcagtgtgagtagtcacgaccggtgctcgatttagtgctatagacttgggtttggggactgatcaggactcctcagttcaccttctcacaatgaggcctccctgctacagctccgtgggctgctaatgctcgtcggtcccaggacgttcgggtgggtattgttgtgtntacgtctcgtacgttccctaccnccttccgtccctccggtcccctaccgtacccgttgggccgaccggcccgtaccctcctacttccgtccgttcgaccgttaacggtttacctaaggttaacgaaccgttccgttaaccgttaacgtacgttacgaacgttaacgtaaccgtaaccttaacgtaacgtaaggttacgtacttacgacgtacgacggacgacggacgaaccgtaaccttaccgaccgaacggtacgtaacgtttaacgtttaacgtttaaccggtttaaccgtaacccggttacgttcccggttaaccgggtccgtaacgtaaccgtagtaccgtaacggtaacggtccggtaccgggtaaggcggttttttttacggcggttaccgtcttacgttaccgttaacctaaccgtacggttaacgtaaccgtaacgtacggacggtacgggtaacgggttacgggtaggtccgggttaaagggtagggtttaacggttttaggttttaccggttttaacgttaccggttacgtagtttaacgtaacggttaccctttaaacccgttaaccgttaaccgttaaccggttaccccgtttaccggttttacccgtttacccggttttaaacccgggttacccgggttaacccggggtaacccgggttaacgggttaaccgggtaacgttaaacccggttaaccgggtaaaacgttaacccggttaaggttaacccgggttaacggtcccgggttacccgaaccgtttacccgttacgtttaccccg

SEQ ID NO: 212180 - DNA, 651 bp, Homo sapiens
  misc_feature: GYAE6OF02JG4SF.43.86.H09.1.454.CMB.1.raw
  modified_base (179)..(179): a, c, t, g, unknown or other
  misc_feature (179)..(179): n is a, c, g, or t
  modified_base (192)..(192): a, c, t, g, unknown or other
  misc_feature (192)..(192): n is a, c, g, or t
  modified_base (253)..(253): a, c, t, g, unknown or other
  misc_feature (253)..(253): n is a, c, g, or t
  modified_base (528)..(528): a, c, t, g, unknown or other
  misc_feature (528)..(528): n is a, c, g, or t
  modified_base (534)..(534): a, c, t, g, unknown or other
  misc_feature (534)..(534): n is a, c, g, or t
tcagtgtgagtagtcacgaccggtgctcgatttagtgctatagacttgggtttggggctgggagacgagccccagcactggaagtcgccggtgtttccattcggtgatcagcactgaacacagaggactcaccatggagtttgggctgagcgtgggttttcctcgttgctcttttaagnggtgtccagtgtnaggtgcagctggtggagtcgtgggggagtacgtggtccagccgtgggaacgtcccctgacncgtctcctgtgccagccttacgtcggtacttccaacctttactaaattaagttacgtcggactagttacgccgtaccggtccgggtcccgccgaggcctcggtgggaacgaggggtcgtgggtacggtggggtcgtacgtaactttagtaacgtcgtaattcgtaggtagtaaggtaagtaacggtaaagtacgtaacgacacgtacctcgggtagacggtccgaacttcaccatccacggtaagactaacgtacgagcgactctagtatacctnaacganaaagtacgacgaacgtcaacgtacgaacgacggaccgagtaccgtacgttaatttacgtacgttaggtcgtacgaggaacggtaggtaacgggttacggggagttcccgtaaccggg

SEQ ID NO: 212181 - DNA, 759 bp, Homo sapiens
  misc_feature: GYAE6OF02ILONE.43.86.H09.1.454.CMB.1.raw
tcagtgtgagtagtcacgaccggtgctcgatttagtgctatagactttgggtttgggggactgatcaggactcctcagttcaccttctcacaatgaggctccctgctcagctcctggggctgctaatgctcgtgggtcccaggatccggtggggatgttgtgatgactcagtctccactctccctgcccgtcacccgttgggcagccgcctccatctcctgcaggtctagtagaaacgtcctcgtacacgttgagtaggaaaccaccttacttagaatttggattcagcaagcggccacggcctaatcctaccgaaggccgtaccttaaatttaagttaaacggttttccgtaaaccgggtaccttcggttcgggggtacccaggaacacgtacgttacacggccggacgtaggttcgggttctggacctacgttaggtacttttcaaccgtacgttacgaaactaacttccgaaggtaccggaaggggttacgggtaacgggtcggttacggggtaaacgggttaggtttaggggttttttaacgggttttttaacgtttaacgtttcggtacctaaggtttacgtaaccgttaaacttaccgaacccttacggttacccggtacccttttaccggtttacccgttaacggtttttccgggacccggtaacggggtaaccgtaaggggtaagtaaccggtaacgtaaccgtaaacgtacgttcggtacggtccgtacggaacctacgtacgttaccgg

SEQ ID NO: 212182 - DNA, 787 bp, Homo sapiens
  misc_feature: GYAE6OF02JYEJX.43.86.H09.1.454.CMB.1.raw
  modified_base (120)..(120): a, c, t, g, unknown or other
  misc_feature (120)..(120): n is a, c, g, or t
  modified_base (159)..(159): a, c, t, g, unknown or other
  misc_feature (159)..(159): n is a, c, g, or t
  modified_base (163)..(163): a, c, t, g, unknown or other
  misc_feature (163)..(163): n is a, c, g, or t
  modified_base (174)..(174): a, c, t, g, unknown or other
  misc_feature (174)..(174): n is a, c, g, or t
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
  modified_base (293)..(293): a, c, t, g, unknown or other
  misc_feature (293)..(293): n is a, c, g, or t
  modified_base (630)..(630): a, c, t, g, unknown or other
  misc_feature (630)..(630): n is a, c, g, or t
tcagtgtgagtagtcacgaccggtgctcgatttagtgctatagacttggggtttggggctgggagacgagcccagcactggaagtcgccggtgtttccattcggtgatcagcactgaacncagaggactcacatggatttgggctgagctgggtttccncgtncttctttaagngtcgtccagtgtcaggtgacaggctggtggacgtcgtgggggancgtcggtaccagccgtgggaacgtcctgacnccttctccgtgtcgacacgccttacgtggaacttccgaccttanaacgttattacgtcggactagttcgaccgacggttccggtaccgtacccgagggtacccttcccggtaggggacccgtaaaggggggtctaggggtacgggttcggggtacggtaacctaaccgtttagtaaccgttccgtaatccggtagggtaacggttaagggtaaataaacggtaaaacgttacccggtaacgtacgaacgggtccgttacggtaaggacgggtaacctcgttaacccgacttacgccgtaacgacgggtaactaactacgacgaccgtccttaacgtccttagtaccgttacgaacgtaacaaacggttcgaaaacgttccnccggttaaaccgaccgtaaaccggagggtaaaccggttccgtaacgtttaaaccggtttcgttttaacgtacggttacggttacggaaccgttaaccggggaaaggttttccgggaacggggttttagggggaaaccccgtttcggtttaacccggg

SEQ ID NO: 212183 - DNA, 151 bp, Homo sapiens
  misc_feature: GYAE6OF01AYTJL.1.1.A01.1.454.CMB.1.raw
  modified_base (150)..(151): a, c, t, g, unknown or other
  misc_feature (150)..(151): n is a, c, g, or t
tcagacgagtgcgtcacgaccggtgctcgatttagacgtctcatctcgcgggaccaaggtggagatcaaacgaactgtggctgcaccatctgtcttcatcttcccgccctcctcacgcactcgtctgagcgggctggcaaggcgcatagnn

SEQ ID NO: 212184 - DNA, 149 bp, Homo sapiens
  misc_feature: GYAE6OF01EEJ33.1.1.A01.1.454.CMB.1.raw
  modified_base (149)..(149): a, c, t, g, unknown or other
  misc_feature (149)..(149): n is a, c, g, or t
tcagacgagtgcgtcacgaccggtgctcgatttagacgtctcatctcgcgggaccaaggtggagatcaaacgaactgtggctgcaccatctgtcttcatcttccgccatctgaacgcactcgtctgagcgggctggcaaggcgcatagn

SEQ ID NO: 212185 - DNA, 151 bp, Homo sapiens
  misc_feature: GYAE6OF01D7XR8.1.1.A01.1.454.CMB.1.raw
  modified_base (151)..(151): a, c, t, g, unknown or other
  misc_feature (151)..(151): n is a, c, g, or t
tcagacgagtgcgtcacgaccggtgctcgatttagacgtctcatctcgcggggaccaaggtggagatcaaacgaactgtggctgcaccatctgtcttcatcttcccgccatctgaacgcactcgtctgagcgggctggcaaggcgcatagn

SEQ ID NO: 212186 - DNA, 170 bp, Homo sapiens
  misc_feature: GYAE6OF01C6KP2.1.1.A01.1.454.CMB.1.raw
  modified_base (151)..(170): a, c, t, g, unknown or other
  misc_feature (151)..(170): n is a, c, g, or t
tcagacgagtgcgtcacgaccggtgctcgatttagacgtctcatctcggcggggaccaaggtggagatcaaacgaactgtggctgcaccatctgtcttcatcttcccgccatctaacgcactcgtctgagcgggctggcaaggcgcatagnnnnnnnnnnnnnnnnnnnn

SEQ ID NO: 212187 - DNA, 203 bp, Homo sapiens
  misc_feature: GYAE6OF01CEPU5.1.1.A01.1.454.CMB.1.raw
  modified_base (164)..(203): a, c, t, g, unknown or other
  misc_feature (164)..(203): n is a, c, g, or t
tcagacgagtgcgtcacgaccggtgctcgatttagacgtctcatcggttcgttccccctggcaccctcctccaagagcgacctctgggggcacagcggccctgggctgcctggtcaaggtctacttccacgcactcgtctgagcgggctggcaaggcgcatagnnnnnnnnnnnnnnnnnnnnnnnnnnnnnnnnnnnnnnnn

SEQ ID NO: 212188 - DNA, 287 bp, Homo sapiens
  misc_feature: GYAE6OF01BHLQC.1.1.A01.1.454.CMB.1.raw
  modified_base (198)..(198): a, c, t, g, unknown or other
  misc_feature (198)..(198): n is a, c, g, or t
  modified_base (275)..(275): a, c, t, g, unknown or other
  misc_feature (275)..(275): n is a, c, g, or t
  modified_base (280)..(287): a, c, t, g, unknown or other
  misc_feature (280)..(287): n is a, c, g, or t
tcagacgagtgcgtcacgaccggtgctcgatttagacgtctcatcagggccactggcatcccagccaggttcagtggcagtgggtctgggacagacttcactctcaccatcagcaggctagagcctgaagattttgcagtttattactgtcaacaccgtagcaactggccctccttcggccaagggacacgactgganattaaacgaactgtgctgcaccatctgtcttcatcttcccgcctctcacgcactcgtctgagcgggctggcaaggcncatgnnnnnnnn

SEQ ID NO: 212189 - DNA, 482 bp, Homo sapiens
  misc_feature: GYAE6OF01DX6FO.1.1.A01.1.454.CMB.1.raw
  modified_base (210)..(210): a, c, t, g, unknown or other
  misc_feature (210)..(210): n is a, c, g, or t
  modified_base (235)..(235): a, c, t, g, unknown or other
  misc_feature (235)..(235): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (447)..(482): a, c, t, g, unknown or other
  misc_feature (447)..(482): n is a, c, g, or t
tcagacgagtgcgtcacgaccggtgctcgatttagacgtctcatcagggccagtcagagtgttagcagctacttagcctggtaccaacagagacctggccaggctcccaggctcctcatctatgctgcatccaacagggccactggcatcccagccaggttcagtgcagtggtctgggacagacttcactctcaccatcagcagctaganctagatatttgactaatttattacngtacaaactagttattaacttacgtaccccttagtgggtaccttacggccgaagggggaaccaaggggtacgaacgtaccaaacccggatgtcggctgactaccattctcgttactccatccttaccgctagttccagtaacctcaccgttcgtcgtaggaccgggcgggtacgtacggaccgaacgggtccaacgtagtacgntagcangnnnnnnnnnnnnnnnnnnnnnnnnnnnnnnnnnnnn

SEQ ID NO: 212190 - DNA, 145 bp, Homo sapiens
  misc_feature: GYAE6OF02HO5WL.1.1.A01.1.454.CMB.1.raw
  modified_base (145)..(145): a, c, t, g, unknown or other
  misc_feature (145)..(145): n is a, c, g, or t
tcagacgagtgcgtcacgaccggtgctcgattagacgtctcatctcgcggaccaaggtggagatcaacgaactgtggctgcaccatctgtcttcatcttccgccatctgaacgcactcgtctgagcggctggcaaggcgcatagn

SEQ ID NO: 212191 - DNA, 151 bp, Homo sapiens; identical to SEQ ID NO: 212185
  misc_feature: GYAE6OF02HNDMO.1.1.A01.1.454.CMB.1.raw
  modified_base (151)..(151): a, c, t, g, unknown or other
  misc_feature (151)..(151): n is a, c, g, or t

SEQ ID NO: 212192 - DNA, 161 bp, Homo sapiens
  misc_feature: GYAE6OF02HSXTN.1.1.A01.1.454.CMB.1.raw
  modified_base (160)..(161): a, c, t, g, unknown or other
  misc_feature (160)..(161): n is a, c, g, or t
tcagacgagtgcgtcacgaccggtgctcgatttagacgtctcatcggtcttcccctggcaccctcctccaagagcacctccgagagcacagcggccctgggctgcctggtcaaggactacttccacgcactcgtctgagcgggctggcaaggcgcatagnn

SEQ ID NO: 212193 - DNA, 151 bp, Homo sapiens
  misc_feature: GYAE6OF02JAMBF.1.1.A01.1.454.CMB.1.raw
  modified_base (151)..(151): a, c, t, g, unknown or other
  misc_feature (151)..(151): n is a, c, g, or t
tcagacgagtgcgtcacgaccggtgctcgatttagacgtctcatctcgcggggaccaaggtggagatcaaacgaactgtggctgcaccatctgtcttcatcttcccaccctcctcacgcactcgtctgagcgggctggcaaggcgcatagn

SEQ ID NO: 212194 - DNA, 617 bp, Homo sapiens
  misc_feature: GYAE6OF01AFUT3.51.5.A05.1.454.CMB.1.raw
  modified_base (613)..(614): a, c, t, g, unknown or other
  misc_feature (613)..(614): n is a, c, g, or t
tcagcgatcgtatacacgaccggtgctcgatttagatagatagacagggggtgctttctgagagtcatggacctcctgcacaagaacatgaaacacctgtgttcttcctcctctggtggcagcctccagagtgggtcctcgtcccaggtgcagcgtacggcaggtggggcgcgaggacttggttagaacgcccgtcgggacgacccttcgtcccctcagctgcgctgtatatcggtcggtccttcgaggttggttactacgtggagtcgtggactccgccacgtccccgaggggacgggctggagtggagtagggcgaatcaatcagtaggtggagacaccgactaccaacccgtcctcatgagtcgagtcacatcgtacaggtcggactccgtaccaacgccctaccaaccgaacgggcccacgtccggtcccttccccgtcggaccctaccctccctaccgaacgacgcctaccgtcggtcggggccacgacggcccggccgtcgggctcggccgtcggtaccgaacggtaccttaccgttcccgtacggtacgcctaccgtcgtcggacgggccgggtcgtacgggaccgaacgggccgactaagtacgnngcg

SEQ ID NO: 212195 - DNA, 520 bp, Homo sapiens
  misc_feature: GYAE6OF01BUT3P.51.5.A05.1.454.CMB.1.raw
  modified_base (425)..(425): a, c, t, g, unknown or other
  misc_feature (425)..(425): n is a, c, g, or t
  modified_base (517)..(518): a, c, t, g, unknown or other
  misc_feature (517)..(518): n is a, c, g, or t
  modified_base (520)..(520): a, c, t, g, unknown or other
  misc_feature (520)..(520): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaagggctggagtggatagggcgaatcaatcatagtgagacaccgactacaacccgtcctcatgagtcgagtcaccatgtcagtgactcgtccaagacctccaccaagggcccatcggtcttccccctggccaccctcctccaagacgccacctcnggggccacaggccgcccgtgggcctcggccctcggtcaacggacctacttcctcgtacgccactcgtgagcgggctggcaacggcgacatgnngn

SEQ ID NO: 212196 - DNA, 508 bp, Homo sapiens
  misc_feature: GYAE6OF01CGJD9.51.5.A05.1.454.CMB.1.raw
  modified_base (401)..(401): a, c, t, g, unknown or other
  misc_feature (401)..(401): n is a, c, g, or t
  modified_base (456)..(456): a, c, t, g, unknown or other
  misc_feature (456)..(456): n is a, c, g, or t
  modified_base (471)..(471): a, c, t, g, unknown or other
  misc_feature (471)..(471): n is a, c, g, or t
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaaagaaatctgtctttttggaccatcagaggccaggccaggcccctgtattggtcatctatgaggacaccaagcgaccctcggaatccctgagagagtcgctggctccaggtcagggacaagtcggaccaccttgactatcactcgggacccagatggacgatgaaggtnactacatgttatcgacagacagcagtggtagtcgaggggtcttcgggcggaaggngaagcgtgaccgtcngacgtcagcccgaaggtcctacgcccctggcactccg

SEQ ID NO: 212197 - DNA, 573 bp, Homo sapiens
  misc_feature: GYAE6OF01BM33I.51.5.A05.1.454.CMB.1.raw
  modified_base (569)..(570): a, c, t, g, unknown or other
  misc_feature (569)..(570): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtggtccttcagtggttactactggagctggatccgccagtccccgagggaagggctggagtggagtagggcgaatcaatcagtagtggagacaccgactacaacccgtccacatgacgtcgagtcaccatcgtcagtggactcgtaccaagacctccaccgaacgggcccacgtccggtccttcccccgtggtcccaccctcctaccaacgacgcctaccgtcgtcggggccacgacgccggcccgtcggccgtcggccgtcggtaccgaacggtaccttacgttcccgtcgtacgcctaccgtcgtcggacggcgggtctcgggaccaacgggtcgacgaagtcggnngcg

SEQ ID NO: 212198 - DNA, 633 bp, Homo sapiens
  misc_feature: GYAE6OF01CAFEH.51.5.A05.1.454.CMB.1.raw
tcagcgatcgtatacacgaccggtgctcgatttagatagatagacaggggtggcctttcgtcgagagtcatggaccttcctgcacaaggaacatagaaacaccgtgtggttcgttcctacctcctcggtggcagcgtcccagattcgggtcctgtcccaggtcgcagctacggcagtgggcgccagggacctgttgaagccctcggagaccctgtccctccacgctgcgctggtaccgtatcggtgggtccttccagttggttactacgtggagctggacttccgaccagtccccgaaggaagggctggagtggatagggcgaactcgaatcgacgtaggtcggacgaacaccgactacaacccgtcctcatgagtcgagtcaccctatggtccagtcggacttcgtccaacggaccctacccacctaacggggcccacgtcccgggttccttaccccccgtcggtccctaccccgtcctacccaacggacgcctaccctcgtcggggcaccgagccgggaccctgggtccttcggtcccttgggtccaacgggtcctacgttccgtcgtacgccgaccgtcgtcggagccgggtcgtcgggtccggaagggccggactaagtcgcgtgtacg

SEQ ID NO: 212199 - DNA, 512 bp, Homo sapiens
  misc_feature: GYAE6OF01BC0KZ.51.5.A05.1.454.CMB.1.raw
  modified_base (248)..(248): a, c, t, g, unknown or other
  misc_feature (248)..(248): n is a, c, g, or t
  modified_base (509)..(510): a, c, t, g, unknown or other
  misc_feature (509)..(510): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactgganctggatccgccagtccccagggaagggctggagtggatagggcgaatcaatcatagtggagacaccgactacaacccgtcctcatgagtcgagtcaccatgtcagtgactcgtccaagacctcacaaggcccatcgtcttcccctggcaccctcctccaagacgccacctcgtcggggcacgagccggccctgggctcgcccgtggtcaacggtactacttcctcgtagccactcgtgagcgggctggcaaggcgcatagnngc

SEQ ID NO: 212200 - DNA, 512 bp, Homo sapiens
  misc_feature: GYAE6OF01DCDK9.51.5.A05.1.454.CMB.1.raw
  modified_base (510)..(512): a, c, t, g, unknown or other
  misc_feature (510)..(512): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaagggctggagtggatagggcgaatcaatcatagtggagacacgactacaacccgtccctcatgagtcgagtcacatgtcagtgactcgccaaagacctccaccgaagggcccatacggtcctcccccgtcggcaccctcctccaagacgcacctcgtgggggcacagcggcctgggctgcctggtcaaggactacttcctcgtagcactcgtcgaggcggcgtggcgaaggcgcatagnnn

SEQ ID NO: 212201 - DNA, 531 bp, Homo sapiens
  misc_feature: GYAE6OF01AS5TE.51.5.A05.1.454.CMB.1.raw
  modified_base (506)..(506): a, c, t, g, unknown or other
  misc_feature (506)..(506): n is a, c, g, or t
  modified_base (513)..(513): a, c, t, g, unknown or other
  misc_feature (513)..(513): n is a, c, g, or t
  modified_base (528)..(529): a, c, t, g, unknown or other
  misc_feature (528)..(529): n is a, c, g, or t
tcagcgatcgtatacacgaccggtgctcgatttagatagatagacagggggtggctttctgagagtcatggacctcctgcacaagaacatgaaacacctgtggttcttcctcctcctggtggcagctcccagatgggtcctgtcccaggtgcagctacgggcagtgggggcgcaggactgttgaagccctcgggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagacctccaccgaagggcccatccggtccttccccctcggccaccctccctccaacgacgcaccctcgtcggggccacgagccggccctgggcctcgcctggtccaaggactaccttcctcgtagccactcgtgnggcggcngggcacggcgcatgnngc

SEQ ID NO: 212202 - DNA, 532 bp, Homo sapiens
  misc_feature: GYAE6OF01CK976.51.5.A05.1.454.CMB.1.raw
  modified_base (220)..(220): a, c, t, g, unknown or other
  misc_feature (220)..(220): n is a, c, g, or t
  modified_base (406)..(406): a, c, t, g, unknown or other
  misc_feature (406)..(406): n is a, c, g, or t
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagcccaccctcagtgtcagtgtctccaggacaaacggccaagatcacctgctttgganatgcgttgaccaaaagaatctgtctttttggaccatcagaggccaggccaggcccctgtattggtcatctatgaggacaccaagccgaccctccggaactcccgtagagagacgtcgctggctccgaggtcgagggacaagtcgccacttgactatcacgtcggaccagatggacagtagaaggtnactacacttgttactcgacagacagctaggtggtagtcgaggggtctcgggcgggagggacgacgcgtggaccgtcgtaggacgtcgacgacccgaaggtcctccggccccctggtcctcgtcccg

SEQ ID NO: 212203 - DNA, 602 bp, Homo sapiens
  misc_feature: GYAE6OF01CMTPE.51.5.A05.1.454.CMB.1.raw
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagttggttactactggagctggatccgccagtccccgagggaaggggctggagtggatagggcgaatcaatcatagtggagacaccgactaccaacccgtccctcatgagtcgagtcacatgtcaggtggactcgtaccaacgaccctccaccgaacgggccccagtccggtccttcccccgtggcccctaccctccctaccaacgacgccaccgtccgtcggggccacgacggccgggcccgtggggcctcggccgttcgggtaccaacgggtaccttaccttcccgtccggtacgccctaccgttccgtcggacgggccggggtccgttacggggaccgaacgggggtccgacaagttaacggngngng

SEQ ID NO: 212204 - DNA, 574 bp, Homo sapiens
  misc_feature: GYAE6OF01DO45S.51.5.A05.1.454.CMB.1.raw
  modified_base (551)..(551): a, c, t, g, unknown or other
  misc_feature (551)..(551): n is a, c, g, or t
tcagcgatcgtatacacgaccggtgctcgatttagatagatagacagggggtgggctcaggaggcagagctctgggaatctcaccatggcctggaccctctcctgctccccctcctcactttctgcacagtctctgaggcctcctatgagctgacgcagccaccctcagtgtcagtgtctccaggacaaacggccaagatcacctgctttggagatgcgttgaccaaaagaaatctgtctttttggtaccatcagaggccaggccaggcccctgtattggtcatctatgaggacaccaagccgaccctccggaatccctagagagagtcgcgtggctccgagggtcaggggaacaagtcggacctaccgttgactactcgacgtcggggacccagagtacgggacagtaggaaggtcaactaccattgtttaacttcgacagacagcaggtgggtagcggtaggggtcttcgggcggtagggacgaagcgtaggacccgtcgtggacgtcgacgccccgaagggccctacccggcccccttacgggtaccncccgttcgttccggttccccccg

SEQ ID NO: 212205 - DNA, 742 bp, Homo sapiens
  misc_feature: GYAE6OF01BTOPA.51.5.A05.1.454.CMB.1.raw
  modified_base (205)..(205): a, c, t, g, unknown or other
  misc_feature (205)..(205): n is a, c, g, or t
  modified_base (738)..(738): a, c, t, g, unknown or other
  misc_feature (738)..(738): n is a, c, g, or t
tcagcgatcgtatacacgaccggtgctcgatttagatagatagacagggggtgcgtttctgagagtcatggacctcctgcacaagaacatgaaacacctgtggttcttcctcctcctggtggcagctccagatggtcctgtcccaggtgcagctacggcagtgggcgcgaggactgttgaacgccctggagtacccttgtccctnagctgcgctgtatactcggtcggttccttcgagttcggttactacgtggagctggtactccgcgacgtcccgagggagggctggagtggagtagggacgtaatcaagtcaagtaggtgaacgaccaaccgtacctaaccgaaccccgttcccacgtaacgtggtaacgttacgaacgtacccgaacctaagttcgtaccgaacggttaccggtacctttaccggaccctaaaaccggtcccctaacctaacccggtaaccggggtaccctaccgtttaccgggttcccctttaccccccggtcgggaccccttaccccgtaccgtaaccgtaaacggaccgaccctaaaccggtccggtacggggcccaaacggtcggccccgggtccggtttccgggccgttccggaccggtttaccgggtaaccgtaaaccgggttcccttaacccgttcccgtaacggttaccgccgtttaacgtccggtaggtaaccgggtcgggtaccgtgggaccgtaaggcccgacgtacgtagcngacg

SEQ ID NO: 212206 - DNA, 525 bp, Homo sapiens
  misc_feature: GYAE6OF01AMM9F.51.5.A05.1.454.CMB.1.raw
  modified_base (523)..(524): a, c, t, g, unknown or other
  misc_feature (523)..(524): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtcctcatgagtcgagtcaccatgtcagtggactcgtccaagacctccacaagggcccatcggtcttccccctggccaccctcctccaacgacgccaaccctcgtcgggggccacgacgccggccctgggcctggccctgggtccaagggtactacttcctcgtagccactctgaggcgggctggcaaggcacatgnnc

SEQ ID NO: 212207 - DNA, 544 bp, Homo sapiens
  misc_feature: GYAE6OF01EB5S4.51.5.A05.1.454.CMB.1.raw
  modified_base (278)..(278): a, c, t, g, unknown or other
  misc_feature (278)..(278): n is a, c, g, or t
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaaagaaatctgtctttttggaccatcagaggccaggccaggcccctgtnttggtcatctatgaggacacaagcgaccctcggaatccctgagagagtcgctggctccgaggtcagggacaagtggcctacgttgactatcacgtcgggacccagatcgggaacgtataggaaggtgaacctacctaacttgttaatcgacagacagcagtggtagtcgtagggggtcttcgggcggagggacgaacgcgtaggaccggtcgtggacgtcgaacggcccgaaggtcctccggcccccgttcgggtccacgttcccg

SEQ ID NO: 212208 - DNA, 579 bp, Homo sapiens
  misc_feature: GYAE6OF01BF3GR.51.5.A05.1.454.CMB.1.raw
tcagcgatcgtatacacgaccggtgctcgatttagatagatagacagggggctgtgggctcaggaggcagagctctgggaatctcaccatggcctcggacccctctcctgcctccccctcctcactttctgcacagtctctgaggcctcctatgagctgacgcagccaccctcagtgtcagtgtctccaggacaaacggccaagatcacctgtctttggagatgcgttgaccaaagaatctgtcttttggaccatcagacggccaggccacggcccctgtagttcggtacatctagtggacggaccaaccgaagccgacccgtaccggaactcccgtagagacgacgtcgcgtcggctcgaggtcgaagggacaagtcggaccctacttgactatcacgtcgggaccagagtggacgagtacggaaggtcaactactacttgttactcgacagacagcgtaggtggtagtcggaggggttctacgggcggagggacgaagtcgtacggtaccggtcgtaggacggctaccggacccgaacggtcccgtccggtacccccgtcggtccctccgttacccg

SEQ ID NO: 212209 - DNA, 648 bp, Homo sapiens
  misc_feature: GYAE6OF01CX331.51.5.A05.1.454.CMB.1.raw
  modified_base (643)..(643): a, c, t, g, unknown or other
  misc_feature (643)..(643): n is a, c, g, or t
tcagcgatcgtatacacgaccggtgctcgatttagatagatagacagggggtgctttctgagagtcatggacctcctgcacaacgaacatgaaacacctgtggttcttcctcctcctggtggcagcctcccagatgggtcctgtcccaggtgcagctacggcagtgggcgcaggctgttgaagccctcggagaccctgtcccctcagcctgcgctgtatatcgtggtccttcagtggttactacgtggagctggactccgaccacgtccccgagggaacgggcctggagtggatagggcgaatcgaatcatacgtaggagaccaccgactaccaaccccgtccctacagtgagtcgagtcaccgagtgtacagtcggtactcgtaccaacgaccctccaaccgacgggccctaacgtcccggttccttccccccgtcggccctaccccgttacctacccgtaacgtacgtaccgtacccgttcgtacgggggcctaaccgacggtcccgggtacccgtacgggtaccgtcggcccgttcgggtaccgtaacgggtacccttaccgttcccgttacgtacggaccgtaccgttccgtacggacggtccgggtcgttcgggaccgaacgggccgacgtagtacgntgtcg

SEQ ID NO: 212210 - DNA, 550 bp, Homo sapiens
  misc_feature: GYAE6OF01BN047.51.5.A05.1.454.CMB.1.raw
  modified_base (547)..(548): a, c, t, g, unknown or other
  misc_feature (547)..(548): n is a, c, g, or t
  modified_base (550)..(550): a, c, t, g, unknown or other
  misc_feature (550)..(550): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagaccctccaccgaagggcccagtccggtccttccccctcggcccaccctccctccaacgacgccaccctcgtcggggccacgacggccggcccgtgggcctcggccgtcgggtcgaacggacctacttcccgtcgtacgccactcgtggagcgggcgtcgggaccaacggcgacatcgnngn

SEQ ID NO: 212211 - DNA, 613 bp, Homo sapiens
  misc_feature: GYAE6OF01BELFN.51.5.A05.1.454.CMB.1.raw
  modified_base (169)..(169): a, c, t, g, unknown or other
  misc_feature (169)..(169): n is a, c, g, or t
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (611)..(611): a, c, t, g, unknown or other
  misc_feature (611)..(611): n is a, c, g, or t
tcagcgatcgtatacacgaccggtgctcgatttagatagatagacagggggtgctttctgagagtcatggacctcctgcacaagaacatgaaacacctgtggttcttcctcctctggtggcagctcccagatgggtcctgtcccaggtgcagctacggcaggtggggcncaggactgttgaagccctggacgaccctggtccctnagctgcgctgtatatcgtggtccttnagtggttactactggagctggactccgccagtcccgaggggaagggctggagtggagtagggcgaatcaatcagtaggtggagacaccgactaccaacccgtcctacatgacgtcgagtcacagtcgtcaggtcggactcgtaccaacgtaccctccgaaccgaacgggccctaacgttccggttcccttcccccgtcggccctaccccttacctacccgaagaccgtacctacccgtcggtacggggaccaaccggacggcccggtccgtgggcctcggccgtacggtacgaacggtacccttactccgtaagtccagtcgacgtacggacgggcggggtacctacggggaccgtaacgggccgacgtaagtacgcgancg

SEQ ID NO: 212212 - DNA, 584 bp, Homo sapiens
  misc_feature: GYAE6OF01E0W8X.51.5.A05.1.454.CMB.1.raw
  modified_base (401)..(401): a, c, t, g, unknown or other
  misc_feature (401)..(401): n is a, c, g, or t
tcagcgatcgtatacacgaccggtgctcgattttagatagatagacagggggctggtgggctcaggaggcagagctctgggaattctcaccatggcctggacccctctcctgctccccctcctcactttcctgcacagtctctgaggtcctcctatgagtctgacgcagccaccctcagtgtcaggtgtctccagggacaaacggccaagatcaccgtgctttggagatgcgttgccaaagaaatctgctttttgggtaccatcagtaggccaggccaggcccctgtagttcggtcatctatgaggacacaagcgacctcggaatccctgtagagagtcgctcggctccgaggtcgaggggacaagtcggccctaaccttgactatcacgtcgggaacccngatgggacgatagaaggtcaactaccacttagttattcgaacagacagacaggtaggtagtcgagggggttcttcgggacgggagggacgaaacggtcgtcggtaacccggtccgtagggacgtccgacggacccgtaaagggtccgtaccggtaccccccggttcggtccgcggtttcccgg

SEQ ID NO: 212213 - DNA, 753 bp, Homo sapiens
  misc_feature: GYAE6OF01DVLZN.51.5.A05.1.454.CMB.1.raw
  modified_base (170)..(170): a, c, t, g, unknown or other
  misc_feature (170)..(170): n is a, c, g, or t
  modified_base (207)..(207): a, c, t, g, unknown or other
  misc_feature (207)..(207): n is a, c, g, or t
  modified_base (750)..(751): a, c, t, g, unknown or other
  misc_feature (750)..(751): n is a, c, g, or t
  modified_base (753)..(753): a, c, t, g, unknown or other
  misc_feature (753)..(753): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcaggtggggcncaggactgttgaacgccctcggacgaccctgtccctnagctgcgctgtatacgtcggtggttccttcgaggttcggttactacgtggagtcgtggactcccgccgacggtccccgaggggaacgggctgggaggtggagtagggcgaatcaatcagtagtaggaacgaccaaccgactacccgaaccccgtccctacagtacggacgtacgacgtaccacgtagtcgtacgaggtcggaccttccggtaccaaacgtacccctaccgaaccggaacgggcccctaacgttcccggttcccctttaccccccgcgggtaccccctacccccgttaccctaacccgtaaacggcccgtacccgtaacccggttcccggggtaccgggggacccaaccgggtaccgggccccggggtaccccggttcggggtacccttccgggtaccccggtttacgggtaacccgttaaaccggggttacccctttaacccggtttcccggtacggttaaccgtcccgtaccgttcggacgggacgggtccggggtaccgtacgggaccgaacgggtccgactaaggtacgnngn

SEQ ID NO: 212214 - DNA, 558 bp, Homo sapiens
  misc_feature: GYAE6OF01ED38Z.51.5.A05.1.454.CMB.1.raw
  modified_base (219)..(219): a, c, t, g, unknown or other
  misc_feature (219)..(219): n is a, c, g, or t
  modified_base (324)..(324): a, c, t, g, unknown or other
  misc_feature (324)..(324): n is a, c, g, or t
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaaagaatctgtctttttggtaccattcagaggccaggccaggcccctgtattggtcatctagtgaggacacaacgcgacccctcggaatcccngagagagtcgctacggctccgaggtcgagggacaagtcggaccacttgactatcactcgggacccagatgggacgataggaaggtcgactaccactgttactcgacagacagcaggtggtagtcgaggggttcttcgggacgggacgggacgtaaggcgtacggaccgttccgtaggacgtcgacgtacccgaacggtccgtccggacccccgttcggtcctccgtttccccgg

SEQ ID NO: 212215 - DNA, 579 bp, Homo sapiens
  misc_feature: GYAE6OF01C8GIR.51.5.A05.1.454.CMB.1.raw
  modified_base (340)..(340): a, c, t, g, unknown or other
  misc_feature (340)..(340): n is a, c, g, or t
  modified_base (576)..(577): a, c, t, g, unknown or other
  misc_feature (576)..(577): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctggagaccctgtccctcagctgcgctgtatatcgtggtccttcagttggttactacgtggagctggactccgccagtccccgagggaagggctggagtggagtagggcaatcaaatcaagtagtggacgacaccgaactaccaacccgtccctnatgagtcgacgtcacatcgcaggtcgactcgtaccaacgaccctaccaaccgaacgggcccacgtccggtcccttcccccgcggtcccaccctcccgtaccaagaccgccacccgtcggtcggggaccacgacgcccggcccgtgggcctcggcctggaccaaggtacctacttccgtcgtacgcctacgtcgtcggaggccgggtcgtcgggaccgaacggccgactagtacggnngc

SEQ ID NO: 212216 - DNA, 565 bp, Homo sapiens
  misc_feature: GYAE6OF01CJFTS.51.5.A05.1.454.CMB.1.raw
  modified_base (561)..(562): a, c, t, g, unknown or other
  misc_feature (561)..(562): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggattgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtcctcatgagtcgagtcaccatgtcagtgactcgtaccaagaccctccaaccgaacgggcccacgtcggtccttccccctcggcccaccctccctaccaacgacgcctacccgtcgtcgggggcacgacgccggcccgtcgggctcggccgttacggtccgaacggtacttaccttccgtcgtacgcctactcgtcggaggcgggcgtcgggacgtaacgggccgacgatacgnngcg

SEQ ID NO: 212217 - DNA, 584 bp, Homo sapiens
  misc_feature: GYAE6OF01CA0ZG.51.5.A05.1.454.CMB.1.raw
  modified_base (248)..(248): a, c, t, g, unknown or other
  misc_feature (248)..(248): n is a, c, g, or t
  modified_base (578)..(578): a, c, t, g, unknown or other
  misc_feature (578)..(578): n is a, c, g, or t
  modified_base (582)..(582): a, c, t, g, unknown or other
  misc_feature (582)..(582): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactgganctggatccgccagtccccagggaaggggctggagtggatagggcgaatcaatcatagtggagacaccgactacaacccgtccctcatgagtcgagtcaccatgtcaggtgactcgtccaagcctaccaccaagggccactcggtcttcccctggccaccctcctccaagcgcaccgtccgtcggggccacgacgccgggcccgtggggtcctcggtcccgttcgggtaccgaacgggtaccttaccttacccgtaccgttacggtcctaccgtccgttcggacggtacccggggtcgtacgggacgtaacggggccgacgtaagtacggngtcncg

SEQ ID NO: 212218 - DNA, 591 bp, Homo sapiens
  misc_feature: GYAE6OF01DAYR0.51.5.A05.1.454.CMB.1.raw
  modified_base (446)..(446): a, c, t, g, unknown or other
  misc_feature (446)..(446): n is a, c, g, or t
  modified_base (578)..(578): a, c, t, g, unknown or other
  misc_feature (578)..(578): n is a, c, g, or t
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtctttttggtaccatcagacggccaggccacggcccctgtacttggtcatctatgagacaccaagccgaccctcggaactcccgtagagagtagtcgctcggctccgaggtcagggacaagtcggccaccttgactacgtacacgtcgggacccagtacgtacggacgataggaaggtcgactaccacttgttattccgatacganacgcgaggttaggtacgttcggagggggttcttcggggacgggaggggacgtaaggccgtcggtaacccggtccgaggtaccgtcgaccgacccgtaacgggtcccgttcccggaccccctttccgggtccncccgtttaccccg

SEQ ID NO: 212219 - DNA, 610 bp, Homo sapiens
  misc_feature: GYAE6OF01B3G4E.51.5.A05.1.454.CMB.1.raw
  modified_base (341)..(341): a, c, t, g, unknown or other
  misc_feature (341)..(341): n is a, c, g, or t
  modified_base (604)..(604): a, c, t, g, unknown or other
  misc_feature (604)..(604): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactacgtggagctggatcccgccacgtcccccgaggggaaggggctgggagtggagtaggggcgaatcaatcataggtgagacacgactaccaacccgtcccncatgagtcgacgtcaccatgtcagtcggactcgtccaacgaccctaccaccgaacgggccctacgtccggttcccttccccccgtggcccctacccctccctaccgaacgacgtcccacccgtcgtcggggaccacgacggccggcccgtggggcctcggccgttacggaccgaacggtaccttaccttcccgtccggtaacgcctaccgtcgttcggacgggccgggtcgtcgggtacgaaccgggtccggtacgaagtcgngtcgcg

SEQ ID NO: 212220 - DNA, 700 bp, Homo sapiens
  misc_feature: GYAE6OF01DPKQO.51.5.A05.1.454.CMB.1.raw
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagcccaccctcagtgtcagtgtctccaggacaacggcaagntcactgctttgantgtcgttgaccaaagaatcgtgttcgttttggtaccatcaggagccacggccacggccctgtattcggtcatctatcggaggaccaaccgaacgccgtacccgtaccggactcccgtgagagacgtcgcgtcggctacgaggtcgaagggaacctaagtccggacctaccgtttacgaacttacgtcctaacggtaccgggaccccaaggtacgtacgggaacgtaaggtacggtaaaggtacgtaaccttaaccgtaccgtttaggtttaactaaccgtaccgaacggacgtaacggtacgtagggtttacgggtaacgggtacgggttacggggggttccgttacggggacgggtaacgggacgggaacgtcggtaccgtacccgggtacgtacgggacgttacccgaacggtcccggaaacggtcccgttcccggtccccccggtacggtaccctcccgttaccggttccccgttacccccccgg

SEQ ID NO: 212221 - DNA, 760 bp, Homo sapiens
  misc_feature: GYAE6OF01C3GHC.51.5.A05.1.454.CMB.1.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctctatgagctagacgcagcccaccctcagtgtcagtcgtcctccgaaggaaccaaacggccaaagactccaccttgtactttggagtatcggtcgttagaaccaaaagaacttctagttcttttttacggaacctataccgaaggaacggcccgaaggcccgaaccggtccccgttaggttacgtttcgggtacctacttaccttagtacggaacggaaccaaccgaacggaccccgtaaccccgttaccggaaacctccccgtaaggacgacggtacggtccgtacgtcggtaccctacggaacggtacgaacgggaactaacggtccggtaccctaaccgtttaggaacctacgttacccgaacggttaccgggaacccctaggtaacggtacgggaaccgtagtaacgggaaacggtaccgtaacccttaaccgttacgttagtttacgttaccgaactagaccgtagtacgtaggttacgggttaggtacgggtacggggtccgttacggggaggtacgggaaccgtaggtcccgtaggtacccgtcgtagggtacgtaccgaccggaccgtaccgtccgtacccgccccgttcggtcctcgttaccccg

SEQ ID NO: 212222 - DNA, 712 bp, Homo sapiens
  misc_feature: GYAE6OF01B0DR6.51.5.A05.1.454.CMB.1.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagactcacctgctttggagatgcgttgaccaaagaatctgtcttttgaccatcagacgcgagccacgccctgtattcggtcatctatgaaggaccaccgaagccgacccgtacggaactcccgtagagacgtacgtccgcgtcggcctaccgaggtacgaagggaacaacgtcggaccctaccgttagaactactccgacggtacgggtaacccagacgttcgggaactagtacggaaaggtcgaaccgtacctacgtttacgtttaacgttaccgaacgtaacgacgaacggtacgtaacgggttcgggtaacggttaccggggtagggggtttacccgggttaccgggggtaacggggaacgggggtacggtaaacggtccggttaccggtaccccgttaccggttacgggtacggttacccgaaccgggacccgaaaccgggttcccgtaccccggtaccccccgtttacgggtacccctaccgtttccccggttcccggttacccccccgg

SEQ ID NO: 212223 - DNA, 574 bp, Homo sapiens
  misc_feature: GYAE6OF01EWJGN.51.5.A05.1.454.CMB.1.raw
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggactccgccagtccccagggaagggctggagtggatagggcgaatcaatcatagtggagacaccgactacaacccgtccctcatgagtcgagtcaccatgtcaggtgactccgtccaaagaccctccaccgaacggcccacgtccggtccttcccccgtcggccctacccctcctaccaacgacgcctaccgtcgtcgggggccacgacgccggcccgtgggctcggccgtcggtaccgaagacctaccgttccgtcgtacgccaccttcgtacggaggccggggcgtacgggaccgaacgggtccgacgtaagtacgngngn

SEQ ID NO: 212224 - DNA, 781 bp, Homo sapiens
  misc_feature: GYAE6OF01A83ZT.51.5.A05.1.454.CMB.1.raw
  modified_base (169)..(169): a, c, t, g, unknown or other
  misc_feature (169)..(169): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcncaggactgttgaagccctggagaccctgtccctcagctgcgctgtatatcgtggtccttcagtggttactacgtggagctggactccgccacgtccccgaggggaacgggctggagtggagtagggcgaatcgaatcgaagtaggtggaacaaccgaccgaacctaaccgaaccccgtccctacgacttgacgtcgagtccaaccgatcggtacaggttcgaccttaccgtaccaaacgtacccctaccgaacccggaaccgggccctaacgttcccgggttacccctttccccccgtcgggtaccccctaaccccgttcccgttaaccgaaaccggtacgtaccccgtaacccggttccggtaccgggggtacccaaccggacccgggacccgggtcccccggttggggtacccgttccgggtacccccgggtttacgggttaacccggtaaaacgggggttacccctttaaccccggttttacccggtaccgggtttaaaccgcccggtaaacccgttccggttaaaccggggtcggggttacccggggtccggttaaccggggtaacccggaaacggggtccctaaccgggtaaagtaccggtagccga

SEQ ID NO: 212225 - DNA, 638 bp, Homo sapiens
  misc_feature: GYAE6OF01BQTDZ.51.5.A05.1.454.CMB.1.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagcccaccctcagtgtcagtgtctccaggacaaacggccaagatcacctgcttggagtatgcgttgaccaaaagaatctgtcttttggacatcagacggccaggccacggccccttgtacgttggtcattctagtggacggaacaccgaacgccgacccgtaccggaactcccgtagacgagtacgtcgcgtcggctaccgagggtcgaacgggactaacgtcggaccctacgttacgaactactccgtaaccgtcgggaacccagtagtacgggacgagtaggaacggtcgaacctaccgtacgttagttactacgaacgaacgacgagtcgtaaggttaggtacggtacgggtcggggttcgtacggggacgggtagggaacgacgtcgtaccggtaccggtcgtaggacgtccgaccggtacccggaacggtcccgtacccgtaccccccgtcgttcccgtccgtttccccgg

SEQ ID NO: 212226 - DNA, 599 bp, Homo sapiens
  misc_feature: GYAE6OF01A2QZ8.51.5.A05.1.454.CMB.1.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaaagaatctgtctttttggaccatcagaggccaggccaggccctgtattggtcatctatgagacacaagcgaccctcggaactccctagagagagtcgctggctcgaggtcgagggacaagtcggcctaccgttgactatccacgtcgggacccaggactgggacgtagtaggaaaggtcgaacctacctacgttgtttaacttccgaacacgacagcgtaggtggtagtcggtagggggttccgttacggggacgggtaagggacgaaggtcgtacggacccggttccgtaggacggtaccgacggtacccgaacgggtcctacccggtcccccgttcggtacctaccgttcccgttccgttacccccccg

SEQ ID NO: 212227 - DNA, 658 bp, Homo sapiens
  misc_feature: GYAE6OF01EP1Q5.51.5.A05.1.454.CMB.1.raw
  modified_base (169)..(169): a, c, t, g, unknown or other
  misc_feature (169)..(169): n is a, c, g, or t
  modified_base (205)..(205): a, c, t, g, unknown or other
  misc_feature (205)..(205): n is a, c, g, or t
  modified_base (359)..(359): a, c, t, g, unknown or other
  misc_feature (359)..(359): n is a, c, g, or t
  modified_base (654)..(654): a, c, t, g, unknown or other
  misc_feature (654)..(654): n is a, c, g, or t
  modified_base (656)..(656): a, c, t, g, unknown or other
  misc_feature (656)..(656): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcncaggactgttgaacgccctcggagaccctgtccctnagctgcgctgtatatcggtggtccttcagttggttactacgtggagcgtggactcccgccacgtccccgaggggaacgggctagggagtggagtaggggcgaatccaagttcaagtaggtggacgaccaaccgaactaaccaaccccgtcctanatgacgtcgagtcacatgtcaggtcgactcgaccaacgtccctaccaccgaacgggccctacgttcccggtcccttcccccgtacggcccctaccccgtaccctaccgaaacgaccgaccctacccgtccggtaccggggccaaccggacggtcccgggtcccgtcgggacctcggcccgttacggtaccgtaaaccggtaccgtttacccgttcccgtacggttaccgcctacccgttcgtacgggacggtcccggggtcgtacgggaccgaaccgggaccgacgtaagtacgngngc

SEQ ID NO: 212228 - DNA, 636 bp, Homo sapiens
  misc_feature: GYAE6OF01CXQ3O.51.5.A05.1.454.CMB.1.raw
  modified_base (175)..(175): a, c, t, g, unknown or other
  misc_feature (175)..(175): n is a, c, g, or t
  modified_base (241)..(241): a, c, t, g, unknown or other
  misc_feature (241)..(241): n is a, c, g, or t
  modified_base (344)..(344): a, c, t, g, unknown or other
  misc_feature (344)..(344): n is a, c, g, or t
  modified_base (374)..(374): a, c, t, g, unknown or other
  misc_feature (374)..(374): n is a, c, g, or t
tcagcgatcgtatacacgaccggtgctcgatttagatagatagacagggggctgtgggctcaggaggcagagctctgggaatctcaccatggcctggacccctctcctgcctcccccctcctcacttttctgcacagtctctgaggcctcctatgagctgacgcagcccaccctnagtgtcagtgtcctccaggacaaacggccaagatcacctgctctggagatgcattgaccaaaccgntatgctttattggtaccagacaagacgccggccacggcccctgtggttgtgatgtaataaagacacgtgagacggccctacgagggactccgtgagcgattcncgtgctcgaggtacgagggtacaaccggtnaacgtagttcggacctagtccgtagggtacggacgttacccgaggacgaagggacggtaacggagggctaagaactttagtttacgttcgtaaccaagtacaaacgtacgaacctaccgtatttacggttaacttagttacgtaccgtttaacggacgttggacccgtaaaccgtaacggttcccgtaacccggttccggttacgggtaccgtaaccccggtacccgaaccgggacccccctaaaacccgtacgttaccccg

SEQ ID NO: 212229 - DNA, 689 bp, Homo sapiens
  misc_feature: GYAE6OF01CORNN.51.5.A05.1.454.CMB.1.raw
  modified_base (169)..(169): a, c, t, g, unknown or other
  misc_feature (169)..(169): n is a, c, g, or t
  modified_base (563)..(563): a, c, t, g, unknown or other
  misc_feature (563)..(563): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagcctccagatggtcctgtcccaggtgcagctacggcaggtggggcncgaggactggttgaacgtccccgtcggacgaccctcgtcccctcgagccgtgccgtcttgtatagtcggtggttccttgaggttggttacctacgtggtacgcgtaggactcccgccgacggtaccccgaaggggaagggctagggaggtaggtagtaaggggcctaaagtacgaagtcagttaggaggacgaaccaccggtaacctaaacccgtacccccgtaccctcgtaacgtaggtaaccgtacgtaacgttaccgaacccgtaattcggtactacggttcgtaaccgttccgtaaccgaaacgtaccctacccgacgtaaacggcccctagtcccgttccgtacccccgtggtcccctacctccgacctaagaccgtctaaccgtcggngggccaccgagccgggtcccgtagggcctcggacccgtggtaaccaaggttccctaccttccgtagaccgcctaacgtccggtaggacggtcgggtcgtcggaccgtacggccacagtaggcngng

SEQ ID NO: 212230 - DNA, 877 bp, Homo sapiens
  misc_feature: GYAE6OF01C8I0A.51.5.A05.1.454.CMB.1.raw
  modified_base (114)..(114): a, c, t, g, unknown or other
  misc_feature (114)..(114): n is a, c, g, or t
tcagcgatcgtatacacgaccggtgctcgatttagatagatagacaggggggctgtgggcctcaggaggcagagctctgggaatctcaccgactggcctggacccctctccgtncctcccctcctcactttctgtccagtcgtctctgacggcctcctatgagctacgacgccacgcctaccctcgtagtcgtcgtacgttcgtcctaccgaacggaacaaaccgggccaaagtactacctaccgttaggttccggtttagggacgacgtcggtacggtttacgtaaccgtaaaacggtaactttcggttacggtttaccgtttttacgggtaacctacgttaccgaacggaaccgggaacccgtaacggggaccccgaaccccgggtacccgttacgtttacgtttacggttaccgtactttaccggttacgtcggtaaaccggtaaccaacccggaaacggtcccggtaaccccgtaccggtaaccgtcccgtagggtacggtacgtacggtccggtacggtcggtaccgtaccggtacggggtacgaacgggtaataacggtaccggtacccttacgtactaacgtacgtaaccgtaccgtaccggtaccgtacgtacggtaccgggaagtaacggtttaacggtaaaccggtacgtaaccttaaccgttaacgttacgttacgttaccgaacgtacggtaacgtacggtcgtttaaccggtacgggtttacgggtaccgggttacggggttacggtacggggagggtacgggaaaccgtaggtaaccggtacggtccggttacggtacgacggtaccgtaccggtaccgtacgtcccgtaccctacccggttccgtacccgtccgttaccccg

SEQ ID NO: 212231 - DNA, 635 bp, Homo sapiens
  misc_feature: GYAE6OF01BX5Z7.51.5.A05.1.454.CMB.1.raw
  modified_base (203)..(203): a, c, t, g, unknown or other
  misc_feature (203)..(203): n is a, c, g, or t
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
  modified_base (632)..(632): a, c, t, g, unknown or other
  misc_feature (632)..(632): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctggagaccctgtccctnagctgcgctgtatatcggtggtccttcagttggttactacgtggagctggactccgccacggtcccgaggggaacgggctgggagtggagtagggacaatcaatcatagtggagacaccgactaccacccgtcctnagtgacgtcgagtcacgntgcaggtcgactcgtcaacgcctaccgaaccgacggccagtccgtaccttcccccgtgccctaccctcctaccaagaccgcctaccgtcggtacggggacctaacggacggcccgggtacccgtcgggtacccgtcggtcccgtacgggtaccgtaaacggttacccttaccgtttccccgtacggttaccgacccgttaaccgtccggttacgggaccgggtccgggtccgttacggggaacccgtaaacggggcccgtacgtaaggacgtcgngcg

SEQ ID NO: 212232 - DNA, 630 bp, Homo sapiens
  misc_feature: GYAE6OF01ALHRA.51.5.A05.1.454.CMB.1.raw
  modified_base (455)..(455): a, c, t, g, unknown or other
  misc_feature (455)..(455): n is a, c, g, or t
  modified_base (627)..(627): a, c, t, g, unknown or other
  misc_feature (627)..(627): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcgggacgaccctgtccctcacgctcgcgctgtatatcggtgggtcctgagttggttactacgtggagcgtggactcccgccgacggtccccgaggggaacggggctggagtggagtacgggacgaagtcaatcgagtaggtggacgacgaccgaacctaccaaccccgtcctacgagtgacgtcgacgtcactatcgtacacggtcgacctaccgtaccaacgtaccctaccgaacgaacgggcccacgttccgttcccttcccccgnggcccctacccgtaccctaccgaacgaccgaccctacccgtcggtcgggtacccacgacgggcccgtcccggtcggtccgtcggcccgtacggtacaacggttacctaccgttacctcggtacgtccgtacgtcgtcgacggtccgggctcggacgacggtcgacgtagcgncga

SEQ ID NO: 212233 - DNA, 816 bp, Homo sapiens
  misc_feature: GYAE6OF01DV13G.51.5.A05.1.454.CMB.1.raw
  modified_base (490)..(490): a, c, t, g, unknown or other
  misc_feature (490)..(490): n is a, c, g, or t
  modified_base (813)..(813): a, c, t, g, unknown or other
  misc_feature (813)..(813): n is a, c, g, or t
  modified_base (816)..(816): a, c, t, g, unknown or other
  misc_feature (816)..(816): n is a, c, g, or t
tcagcgatcgtatacacgaccggtgctcgatttagatagatagacagggggtgctttctgagagtcatggacctcctgcacaagaacatgaaacacctgtggttcttcctcctcctggtgcagctccagagtggtcctgtcccaggtgcagcgtacggcgaggtggggcacgagggtacttggttacgaacgtccccgttacgggaacgtccccttcggttccccctgacggtccgttggccggtcctttaggttaacttcgttccgggttacggggttcccctttagagggtttcggttaacctacggttggggacgtccgttcgggaccgttcccgaccgacccggtaccccgggaaggggaacggggcgtaggggagttacggggagtaacgggggctaaactacgtaacgttacgagtaaggtcggaacgaaccgtaacccgactaacccctacccgtccctgaacgtgacgtcgagtaccacgtntgtcgtaggcggtacctcgtacccaacggtaccctaccgaaccgggaacggtccctacggttccccggttaccccttcccccgacggttccccaccccgttacccgtaaccgaacggtacccgcctacccggtcgggtaccgggaccctaccggaccgggtcccggtccggtcgggaccgttcggtaccgggtacggttaacccgaagggttacccctttcccggttaccgtaccggtcgtaaacccgtcggttaacggtacggtcccggggttacggcccgggttacggaacccgggttacgggacccgtaggaactcgggncgn

SEQ ID NO: 212234 - DNA, 668 bp, Homo sapiens
  misc_feature: GYAE6OF01CA67O.51.5.A05.1.454.CMB.1.raw
  modified_base (214)..(214): a, c, t, g, unknown or other
  misc_feature (214)..(214): n is a, c, g, or t
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccgaggacaacggcaagatcacctgctttgganatgcgttgaccaaaagaaatctgtctttttaggaccatcagaggccaggccaggccctgtattggtcatctatgaggacacgagccgacccgtccggaactccctagacgagacgtcgcgtggcctccgaggtcgagggacaagtcggacctacgttgaactatcgacgtacgggaccctaggacgtacgggacgaagttacgggaaacggtacgaaccgttacccgtattacggtttaacttaccggaacagaaccgagtaccgtaggtcgggtagtacgggtacgggggttcgttacggggcgggtaaggggacgtaacggtcgtacggtacccggttcgtaggtaccgttaccggaaccggtccccggtaaacgggtccccgtacccgggtacccccccgttaccgggttacccgtacccgtttcccggttaccccggtttccccccccgg

SEQ ID NO: 212235 - DNA, 617 bp, Homo sapiens
  misc_feature: GYAE6OF01EUI5Q.51.5.A05.1.454.CMB.1.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagcccaccctcagtgtcagtcgtctccgaggacaaacggccaagatcacctgctttaggagagtgcgttgaccaaagaaatctgtcttttaggacctatcagaggccaggccacggccctgttatgcatctatgagacacagccgacctcgaactcccgagagagagtcgcgtggcctccgaggtcgaacgggaacaagtcggacctaccgtagactatacgtacgtcggaaccagacgtaggaagtagtagaaggttacgaactaaccgtagttcgttaacttaccggactaacggacgtaggcgtaggttaggtacgtacgggtacggggttacgttccgggggaacggtaggggaaccgtaacgtcgaccggttacggtcccgtagggaaccggtccgaacggaacccgaaggtccctacccggtcccccgtcggttccgtaccgttcccgg

SEQ ID NO: 212236 - DNA, 849 bp, Homo sapiens
  misc_feature: GYAE6OF01BQO4J.51.5.A05.1.454.CMB.1.raw
  modified_base (167)..(167): a, c, t, g, unknown or other
  misc_feature (167)..(167): n is a, c, g, or t
  modified_base (842)..(842): a, c, t, g, unknown or other
  misc_feature (842)..(842): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctccagatgggtcctgtcccaggtgcagctacggcagtgggcncaggactgttgaagccctcggagaccctgtccctcagctgcgctgtatatcgtggtccttgagtgttacacgtggagctggatccgccagtcccgaggggaagggctggagtggagtagggcgtaatcaatcagtaggtaggaacgaaccaaccgaacctaacccgtaaccccgtccctacaacgtcgtaacgtacgtacgttaccaaccctaagttcgtacgaggtcggtaaccgtccgtacccaaacgtacccctaccgaacccgaacggggtacccctacggttcccggttaccgtttcccccccgtacgggtacccctaacccccgttacccgttaacccgaaacggaacccggtaccctaaacccccggttacccgggttaaccggggggggtacccaaacccgggtaaccgggtaccccgggaccccccgggttacgggggtacccccggttccggtacccccgggttaccggggtttaaccccggaaaaccggggtttaaccccgttaaccccggttttaccccgtttacccgggttaaacccggtaccccgttaaaccccggtttacccggtttaacccggggaacgggtaccccgggggttacccgggtacgggggttaaccccgaaaaaccgggggtcccggaaccgtaaaccggttaaccgggngacgtcg

SEQ ID NO: 212237 - DNA, 661 bp, Homo sapiens
  misc_feature: GYAE6OF01BHZS1.51.5.A05.1.454.CMB.1.raw
  modified_base (169)..(169): a, c, t, g, unknown or other
  misc_feature (169)..(169): n is a, c, g, or t
  modified_base (346)..(346): a, c, t, g, unknown or other
  misc_feature (346)..(346): n is a, c, g, or t
  modified_base (617)..(617): a, c, t, g, unknown or other
  misc_feature (617)..(617): n is a, c, g, or t
  modified_base (653)..(653): a, c, t, g, unknown or other
  misc_feature (653)..(653): n is a, c, g, or t
  modified_base (657)..(659): a, c, t, g, unknown or other
  misc_feature (657)..(659): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctccagatgggtcctgtcccaggtgcagctacggcaggtggggcncaggactggttgaagccctggacaccctgtcccctgagcctgcgtcttgtatagtcggtgggttcccttgaggttcggttactacgtggacgtcgtggactcccgccgaccggtccccggaaggggaacggggtcgtagggaggtaggagtagggacgtaatacgaatcgagtaggnggacgaccaccgacctaccaaccccgtcctacagtcgacgtacgacgtaccaccgtagtcgtacgtacgtacggtacctaccgtaccaaacgtacccctacccgaaccggaccgggaccctacgttccccggttacccttcccccggtacgtacccctaccccgtccctaaccgaacgtccgaccgtacccgtcggtacggggcctaacggacggtcccggccggtcgggccttaccggcgtacggtacgaacgtcctaccttcgacgtcncctacgtcgcggtacggcggtagcgacgacggcganacgnnngc

SEQ ID NO: 212238 - DNA, 933 bp, Homo sapiens
  misc_feature: GYAE6OF01CKYZI.51.5.A05.1.454.CMB.1.raw
  modified_base (176)..(176): a, c, t, g, unknown or other
  misc_feature (176)..(176): n is a, c, g, or t
  modified_base (928)..(928): a, c, t, g, unknown or other
  misc_feature (928)..(928): n is a, c, g, or t
tcagcgatcgtatacacgaccggtgctcgatttagatagatagacagggggtgctttctgagagtcatggacctcctgcacaagaacatagaaacacctgtggttcttcctcctcctggtggcagcctccagagtcgggtcctgtcccgaggtgacagctacggcgaggtggggcncgaggtactgtagaacgcccgtcggacgtaccctgtacccctcgaggtcctgcgtcttagtacttacgtcggttcggtccttacgtaggttcggttacgtacggtggtacgtcgtacggacctcccggaccgtaccggtaccccgggaagggggtaacgggtcgtagggtaggtggtaaggtacggggacgtaaacgtacgtaaacgtcgaaggtacggtacggaacgtaacccgtaaccggtaaccctaaaccccggtaacccccgttcctacgtaacggtacggtaaccggtccgtaacgtacccaaccgtagttcggtacgtacgggtaccgtacccgttacccggtaaacccaaaccggtacccccgtaacccggaacccggtaacccgggtaccccttaaccggttcccccgggtttcccccgtttaccccccgggtccggtaacccccttacccccgttaaccccgaaccgtaaaccggtacccggtaccccgttaaccccggtccggggtaaccggggacccctaacccggggacccgggtaccccggggttcccgggtcccggggtacccgttaccggtacccgggttaaccgggtaaccccgtaaacgggtttacccctttaccccggtttacccggtacccggttaccgtaaccccggttacggttcccggtacggggtacccgggttaccggggtcggtaacccgggaacccgggtacgggtaccgaccggtaagacgtcnggtac

SEQ ID NO: 212239 - DNA, 952 bp, Homo sapiens
  misc_feature: GYAE6OF01A3834.51.5.A05.1.454.CMB.1.raw
tcagcgatcgtatacacgaccggtgctcgatttagatagatagacagggggtgctttctgagagtcatggacctcctgcacaagaacatgaaacactgtggttcttcctcctcctggtggcagctccagagtcgggtcctgtcccgaggtgcagctacggcgaggtggggcgcgaggactggttacgaacgcccgtcggacgaccctcgtccctcgagctggccgtcgttagtactacgttcggtcgggttccttcgtaggttcggtttaactacgtgggacgtcgtacggtacctcccggaccgtaccggtaccccggaagggggaacggggtcgtacggggtaggtagggaaggtacggggacgtaaacgtcgtaaacgttcgtaagttaacggtacgggaaccgaaccgtaacccggtaacctaaacccggtaaaccccccgttcccgtaacgtaacggttacggtaacggtaccggtaacgttacccaaaccgttacgttacggtaccgtaagggttaccggtaaccgttacccggtaacccgtaaaaccggtaccccttaaaccccggaaacccgggtaacccggggtccccttaaccgggtttcccccgggtttacccccgtttacccccccggtacgggaccccccctttaacccccggttacccgttaaacccggaaaccggtaccccgtacccggttaaccccgggtttccgggggacccgggggtaacccaacccgggacccggggtccccgggtcccgggttacggggtacccttccggggtaccccggttaagggtaacccgtaacgggttaccccttacccggtttacccgtacggtacccggttaccccttaacgggttacccggtaggggtaccccgggtcccgggggtaccgttacgggaaccggttaaaccgggccgtagaacggtcgactggac

SEQ ID NO: 212240 - DNA, 732 bp, Homo sapiens
  misc_feature: GYAE6OF01BZ8HV.51.5.A05.1.454.CMB.1.raw
  modified_base (724)..(724): a, c, t, g, unknown or other
  misc_feature (724)..(724): n is a, c, g, or t
  modified_base (727)..(727): a, c, t, g, unknown or other
  misc_feature (727)..(727): n is a, c, g, or t
  modified_base (729)..(729): a, c, t, g, unknown or other
  misc_feature (729)..(729): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcaggtggggcgcgaggactggttgaacgcccgtcggacgtaccctgtccctcagctgcgctgtatatcgtggtccttcgagttggttactacgtggacgcgtacggtacgtcccgaccgtaccggtaccccggaaggggacgggtcgtagggaggtagggaaggtacggggacgtaaagtacgtaacgtacgtaagttaaggtagggaaccgaaccgtaacccgtaaccgtaacccgtaacccccgttcctacgtacgtacgtacggtacgaacgtacctaccgtagtacgtcgtacgtcggtaccgtaccgtaaccgaaccgtacccgtacccgaaccggaccggcccgtaccgttacccgttcccgttccccgtacgtacccctacccgtacccgtaccgaacgaccgtccgtaccgtacggcgggaccaccggccggcccggtccggtcggtccgtccggtaccgtacgggtaccgtaacggtacccttaccgttaccgtacgtaccgtccgtacgtcggtacggtaccgggcggtccggacggtacggcggtacgacgtanagngngcg

SEQ ID NO: 212241 - DNA, 662 bp, Homo sapiens
  misc_feature: GYAE6OF01AS5OS.51.5.A05.1.454.CMB.1.raw
tcagcgatcgtatacacgaccggtgctcgatttagatagatagacaggggggtgggctcgaggaggcagagctctgggaatctcaccatggcctggaccctctcctgcctccccctcctcactttctgcacagtctctgaggcctctatgagctgacgcagcccacctcagtgtcagtgtctcaggacaaacggccaagatccacctgtctttggacgatgcgttgaccaaagaatctgtcgttttagaccatcagacggccgagccgacggccctgtacgttggtcatctagtgacgacaacacgaccgaccctaccggaactcccgtagagagacgtcgcgtcggacctaccggaggtcgaagggactaacgtcggaccctacttcgaactactacgacgtaccgggaccctaggagtacgggacgtagtaggtaaacggtactaaccgttaactacgttacgtttaacgtcgtaacacgaacgacgagtaggttagggttaacgggttacgggtacggggggtttaccgtacgggggacggggaaaggggtaacgaacggtacgtaccggttacccgttcggacggacgttcgaacggaccccgaaggtaccccgtcccgtccccggtcgtacccaccttccgttcccggttccccccg

SEQ ID NO: 212242 - DNA, 755 bp, Homo sapiens
  misc_feature: GYAE6OF01CML8A.51.5.A05.1.454.CMB.1.raw
  modified_base (751)..(751): a, c, t, g, unknown or other
  misc_feature (751)..(751): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggacgaccctagtccctcacgctgcgctgtatagtcggtcggtccttcagttggttactacgtggagcgttggactccgccacggtccccgaaggggaacggggtctggaggtggagtagggcgaaatcaaatcaagtagtggagacaccgaactaccgaaccccgtccctcatgagtacgagtacaccgtatcgtacaggtcggtaactaccgtacccaacggtacccctacccgaaccgacgggcccctaacggttcccggttaccccttaccccccgtcgggacccctacccccgtacccttaacccgaaaccgaccgtacccgtaaccccgttccgggttaccggggggaccctaaccggaccgggtacccccggggcccccggttcgggggtacccttccgggtaccccggttacggggtaaccggtaaacccgggtaaccctttacccggtttaccccgtaccggttacgacccggtaccgtccggtttacgggacggtacccgggggtccgtaccggggaaccggtaacggggcccggtaacgtacggtaaggcgngtcg

SEQ ID NO: 212243 - DNA, 984 bp, Homo sapiens
  misc_feature: GYAE6OF01C2351.51.5.A05.1.454.CMB.1.raw
  modified_base (130)..(130): a, c, t, g, unknown or other
  misc_feature (130)..(130): n is a, c, g, or t
  modified_base (134)..(134): a, c, t, g, unknown or other
  misc_feature (134)..(134): n is a, c, g, or t
tcagcgatcgtatacacgaccggtgctcgatttagatagatagacagggggctgtgggctcaggaggcagagctctgggaatctcaccatggcctggacccctctcctcgcctccccctctctactttcngcanagtctctgaggcctcctatgacgctagacgcacgcccaccgtctagtgtctagttcgtcctacgaaggaacaaaccggcaagactcaccgttgtacgtttggatacgtcggtcgttacgaaccgtaaaaaggtactttcgttacggttacctttttttacggggaacctaacgttaccgtaacgggaaccggtacccggaaccggggacccgtaaaccccggtacccccggtttagtttacggttttacggtaccgttaacttaccgttaaggttaccggaaccgggaaaccctaacccggaaaccggtacccggtaacccccgtaccgggtaaaccttcccccggtaaggaccggtacgggtaccgtacggtaccggtccgttaaccggtaccggtacgggtacggaaacggtaaccggtacgtaccccggtacccgttaacggtaaccgttaaccgtaccgttacccgtaacggtacccgggtaaacgtacggtaacgggtaacgtaaggtacggtaaggttaaccggtaaccgttaacccgttaacgtttaaccggtttaaaccggtttaacgttaacccggaacgtaaccggtaacggtacggttaaacggttacggggttaaacgggtttaccgggttacgggggttaccgggttacgggggtaccgggggtaacggggttaaaccgggaacgggttacccggtaacccgggtacccgggtaaccggtaccgggttaccggttaaacccggtcccggaaaccggtaccccgggtaacccgttccccgggttaaccccggttcccccggtttaaaccgtcccggtttacccccgtttaacccccgg

SEQ ID NO: 212244 - DNA, 658 bp, Homo sapiens
  misc_feature: GYAE6OF01CQEQT.51.5.A05.1.454.CMB.1.raw
  modified_base (218)..(218): a, c, t, g, unknown or other
  misc_feature (218)..(218): n is a, c, g, or t
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctcaggacaaacggccaagatcacctgctttgganatgcgttgaccaaaagaattctagtcgtttttggtaccatacagacggaccacggccgacggcccctagtacttggtactattctagtgacggaccaaccgaacgccgaccccgtaccggaactcccgtagagacgtacgtcgcgtcggcgtccgaggtcgaacggacaagtcggacctacgtgactatacgacgtcggacccagacgtaggaacgagtacggaaggtactaactaacccgtacgttacgttaacgttacgaacgtacggaacacggtacgtagggttagggtacggtcgggtacggggttccgttacggggacgggaacggggacgaacggccggtaccggaccggttaccgagtaacggttcgaccggtacccggtaaacggtcccgttacccggtccccccggttacggtccctacccgttccccgg

SEQ ID NO: 212245 - DNA, 809 bp, Homo sapiens
  misc_feature: GYAE6OF01DLJVI.51.5.A05.1.454.CMB.1.raw
  modified_base (803)..(803): a, c, t, g, unknown or other
  misc_feature (803)..(803): n is a, c, g, or t
  modified_base (805)..(805): a, c, t, g, unknown or other
  misc_feature (805)..(805): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatcgggtcctgtcccaggtgcagctacggcagtggggcgcaggactgtgaacgccctcggacgaccctgtccctcagctgcgctgtatatcgtcgggtccttcgagttggttacacgtggacgtcgtggactcccgcacgtaccccggaaggggaacggggtctgggagtaggagtagggacgtaactcgaaatccgtaagtacggtacggaacgtaaccgaacccgtaaccgtaaaccccgtaaccccgttaccctaccgacgtacggtacgtaccggtaacgtacctaaccgtagttacggtacgttacggtcgggtaccccttaccggtaaccccgtaaaacggtaccccccgttaaccccgaacccgggtaaacccggggtaccccctaacggttccccgggtttccccctttaccccccggtacgggtaccccccttacccccgttacccaaacccgtaccggtaccgacccgttaaccccggtcgggtccggggaccgtaccgaccgggccccgggtacccggtcgggtcccgttcggacccggttcggtaaccgtaaccgggttaacccctttacccgttccggttacccggttaacgcccgttaaccgtccggttacggaccgggccgggtccgtaccgggaccgtacgggaccacgtagtacngnacgg

SEQ ID NO: 212246 - DNA, 869 bp, Homo sapiens
  misc_feature: GYAE6OF01DSG8A.51.5.A05.1.454.CMB.1.raw
tcagcgatcgtatacacgaccggtgctcgatttagatagatagacgaggggggtgggctcaggaggcagagctctgggaatctcaccatggcctggacccctctcctgcctccccctcctctactttctgcacagtcctcgtagacggccttacctatggacgctcgacgcacgcccacctcgaggtcgtcaggtcgtcctaccgaagggaaccaaaccgggccaaagaccttaccaccgttcgtacgtttaggagtacgttcggtaccggttacgaaaccgtaaaaggtaacttcgttacgttttacgtttttacggaacctacgtcggaacggtacgggaccgaccgggacccgtaccggtcccgttaggttacgttcggtacctagttaccgtaaggtaggtaaccgaaccgaaccggtaaccgaccccgtacccggtaaccgtacccttacccggtagaacggtacgacggtccgtcggtacggcccgttacgtacggtaacggaaacgggtactacgggacccgtaaccgtaccgttattaaccgtacgtacccgttaacgggtaccggtaaccgagtagggtaccggaaggttaagtacgggtaacggtacctaccgttaaaccgtacgtttacgttaacgtaccaacggtaacgaacgacgggtaggttaagggtttcggggtaacggtcgggggttaccggggttccgggtacgggaacgggggtaacgggtaacgcggttacccggtacggtacccggggttcaacgggtccgtacccggacccggaacccggtacggtcccccgtaccccggttacccgtaccggtaaccctttcccgtccccgtttcccgtccccccg

SEQ ID NO: 212247 - DNA, 874 bp, Homo sapiens
  misc_feature: GYAE6OF01DVJIW.51.5.A05.1.454.CMB.1.raw
  modified_base (125)..(125): a, c, t, g, unknown or other
  misc_feature (125)..(125): n is a, c, g, or t
tcagcgatcgtatacacgaccggtgctcgatttagatagatagacagggggtgggctcaggaggcagagctctgggaatctcaccatggcctggacccctctcctgctccccctcctcactttcngcacagtctctggacggcctctatgagctgacgcacgcccaccctcgagtgtcagtcgtctccgaggaaccgaaaccggcaaagactccaccgttgtacgtttaggagtagtcgtaccggttacgaaccgtaaaagttaacttcgttacgtttacgtttttacggacctaagtccgaaggtaccggaccgacgggacccgtaccggtaccccgttaggttacgttcggtacctacgtacgttacggtacggaacggtaacccaacccggaaccggtaccccggtaaccccgtaacggtaaccgtccccgtaaggaacggtacggtaccggtccggtccgtaccggtaccgtaccggtagggtaaccggaacgggtaacctaacggttcccggaacccttaaccgttacggtaaccttacgtaccgtacgggaaccgggtaacctaagggtacggtacgggaacggttagtaaacgggtaacgttaccggtaaccttaaccggttaacgtttaaggtttaaccgtaacgtaacgaacggtacaacgggtacgggttacggggtacggggttaacgggtacggggttaccgggggttaccggttacgggggacggggtaacgggacgttaaccggtcggtaaccggtaccggtacgggtaggtccgtaccggaaccgtcccggtaacccgggtccctaccccgggtccccgtacgttacccttacccgttcccgtccccgtttaccccccg

SEQ ID NO: 212248 - DNA, 995 bp, Homo sapiens
  misc_feature: GYAE6OF01D48T8.51.5.A05.1.454.CMB.1.raw
  modified_base (789)..(789): a, c, t, g, unknown or other
  misc_feature (789)..(789): n is a, c, g, or t
tcagcgatcgtatacacgaccggtgctcgatttagatagatagacgagggggtgctttctgagagtcatggacctcctgcacaagaacatgaaacactgtggttcttcctcctcctggtgcagctccagagtcgggtcctgtccaggtgcagctacggcgaggtggggcacgaggacttggttacgaacggcccgtacgggaacgtcccttggtcccctacgcggtccttggccgcgttagttattacggtccggttcgggttccctttcgtaggttacgggtttactaacgtggacgtcgtacggacttccccggaccgtacccggtaccccggaaggggggaacgggcgtaggggaggttcggaacgggtacggggtaacgaaactacgtaaacgtcgtaaggttaacgggaggtaaaccgaacccgtaaaccccgtaacgtttaaacccccggaaaccccgtccccgtagtaacgtacgggtaaccgttccggaaacggttcccaaacccggttgtttacggtacccgggttaagggtaccggttcccgttaaccgggtaaccctaaaccggtaaccccgtaaccccggaaaccccgggaaacggttcccccggttaaccgtttccccccggggttaacccccctttccccgggccggtaaccccccgtttaaaccccctccccgtttaaacggaaaccccgggtacgttaccccccggtacccggttaacgggttccgggggacccaaacccgggttcccggggccccgggtttaacccccgggnggggtttccccgtaccgggtcccgggttaacccggttaaccggggttaaaaccgggtcccctttttaccccgggttacccgtaacccggggtttacgtaaaccccggttaaccgttccgggaacgggggtaccggggttcccgggtacgggttacccgggggaagaaccccgggggtctaaaacccggtttagcggtaatcgaacg

SEQ ID NO: 212249 - DNA, 842 bp, Homo sapiens
  misc_feature: GYAE6OF01AS67R.51.5.A05.1.454.CMB.1.raw
  modified_base (129)..(129): a, c, t, g, unknown or other
  misc_feature (129)..(129): n is a, c, g, or t
  modified_base (159)..(159): a, c, t, g, unknown or other
  misc_feature (159)..(159): n is a, c, g, or t
  modified_base (183)..(183): a, c, t, g, unknown or other
  misc_feature (183)..(183): n is a, c, g, or t
tcagcgatcgtatacacgaccggtgctcgatttagatagatagacagggggtgctttctgagagtcatggacctcctgcaacaagaacatagaaacacctgtcggttccttcctcctccgtggtggcancctccagagtgggtccctgtcccgaggtcncagccgtacggcgacggtggggcncgaggtactgttagaacgcccgtacggaccgtacccttcgtcccctacgagccgtcgctacgttagtattacgtccggtcggttacccttagtagttacggttaactacgtcggacgtcgtcggtaacctacccgaccgtaccggtaccccggaagggggtacgggacgttaggaacggtaggtaaggtaacggggaacgtaaactacgtaaaacgtactaacggtaagggtacggaaccgtaaacccgaacccggtaaaccccgttaaaccctaaccccccggttacctaacgtaaacgtacggttaacggaccgtaacgtaaccctaacgtaagtcgtaacggtaacggtaacggtacccgttaacccgtaaccaaacgtaccccgaacccgtaaccggaaccgggttcctaaccggtttccccgggttacccgttcccccgtacgggacccccttacccgtacctaaccgaacgtccgaccgttaaccggtcgggtaacggccgaacggacccggtacccgacggttaccggtacgtccggtacccgtaggtacccgaaggttaaccttaccgtaccgtacgaccgtcctaagttccggaggtacccgggaggttccgaccggaacggacggtacccgagtaacgagtcgagtacg

SEQ ID NO: 212250 - DNA, 501 bp, Homo sapiens
  misc_feature: GYAE6OF02H1JCA.51.5.A05.1.454.CMB.1.raw
  modified_base (499)..(501): a, c, t, g, unknown or other
  misc_feature (499)..(501): n is a, c, g, or t
tcagcgatcgtatacacgaccggtgctcgatttagatagatagacaggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtcctcatgagtcgagtcaccatgtcagtggactcgtccaagacctccaccaagggccatcggtcttcccctggcaccctcctccaagagcacctctggggcacagcggcctgggctgcctggtcaaggactacttcctcgtagcactctgagcgggctggcaaggcgcatagnnn

SEQ ID NO: 212251 - DNA, 514 bp, Homo sapiens
  misc_feature: GYAE6OF02GJW3U.51.5.A05.1.454.CMB.1.raw
  modified_base (247)..(247): a, c, t, g, unknown or other
  misc_feature (247)..(247): n is a, c, g, or t
  modified_base (511)..(512): a, c, t, g, unknown or other
  misc_feature (511)..(512): n is a, c, g, or t
  modified_base (514)..(514): a, c, t, g, unknown or other
  misc_feature (514)..(514): n is a, c, g, or t
tcagcgatcgtatacacgaccggtgctcgatttagatagatagacaggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactgganctggatccgccagtccccagggaagggctggagtggatagggcgaatcgaatcatagtggagacaccgactacaacccgtccctcatgagtcgagtcaccatgtcagtggactcgtccaagacctccaccaagggcccatcggtcttccccctggccaccctcctccaacgacgcacctctgggggccacgagcggccctgggctcgcctggtcaaggactacttcctcgtacgcactctgagcgggctggcaggcgcatacgnngn

SEQ ID NO: 212252 - DNA, 511 bp, Homo sapiens
  misc_feature: GYAE6OF02IYCDK.51.5.A05.1.454.CMB.1.raw
  modified_base (397)..(397): a, c, t, g, unknown or other
  misc_feature (397)..(397): n is a, c, g, or t
  modified_base (419)..(419): a, c, t, g, unknown or other
  misc_feature (419)..(419): n is a, c, g, or t
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgccaaagaaatctgcttttggtaccatcagaggccaggccaggcccctgtattggtcatctatgaggacacaagccgaccctccggaatccctgagagagtcgctggctccgaggtcagggacaagtggccacttgactatcacgtgggacccagatgggacatgaaggtnactacatgttattcgacagacngacagtggtagtcgaggggttcttacgggcggagggacgagctgaccggtctgacgtcacgcccaaggcctacgccccctggtcccagtccg

SEQ ID NO: 212253 - DNA, 518 bp, Homo sapiens
  misc_feature: GYAE6OF02HBEDK.51.5.A05.1.454.CMB.1.raw
  modified_base (516)..(518): a, c, t, g, unknown or other
  misc_feature (516)..(518): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtcaagcctccaccaagggcccatcggtcttccccctggcaccctcctccaagacgcacctctcggggcacgagccggccctgggcctcgcctcggtcaacggactacttcctcgtacgcactcgtgacgcgggctcggcaacggcgcagtagnnn

SEQ ID NO: 212254 - DNA, 539 bp, Homo sapiens
  misc_feature: GYAE6OF02GQO12.51.5.A05.1.454.CMB.1.raw
  modified_base (537)..(538): a, c, t, g, unknown or other
  misc_feature (537)..(538): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagttggttactactggagctggatccgccagtccccagggaggggctggagtggatagggcgaatcaatcatagtggagacaccgactacaacccgtcctcatgagtcgagtcacatgtcagtgactcgtcaagacctccacaaggcccatcgtccttcccctcggccaccctcctaccaacgacgccaccgtccgtcgggggccacgacgccggcccgtggggcctcggccgtcggtaccgaacgggtaccttacttcccgtcgtacgcacgtcgtgacggcggtcgtggcgacggcgcagtagnnc

SEQ ID NO: 212255 - DNA, 527 bp, Homo sapiens
  misc_feature: GYAE6OF02GWBO3.51.5.A05.1.454.CMB.1.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggaccatcagaggccaggccaggcccctgtattggtcatctatgaggacaccaagcgaccctccggaatccctgagagagtcgctggctccaggtcagggacaagtcggccaccttgactatcacgtcgggacccagatggacgagtgaaggtgactaccactgttatcgacagacagcagtggtagtcgagggggtcttcgggcgggagggacgaagcgtagaccgtccgtggacggtcacggcccaaggcctcggccccctcggtccacttccgtcgttcccc

SEQ ID NO: 212256 - DNA, 510 bp, Homo sapiens
  misc_feature: GYAE6OF02GH7VF.51.5.A05.1.454.CMB.1.raw
  modified_base (508)..(510): a, c, t, g, unknown or other
  misc_feature (508)..(510): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagacctccaccaagggcccatcggtcttccccctggccaccctcctccaacgacgcacctctggggcacagcggccctgggctgcctggtcaaggactacttcctcgtagcactctgacgcgggctggcaaggcgcatagnnn

SEQ ID NO: 212257 - DNA, 516 bp, Homo sapiens
  misc_feature: GYAE6OF02IIOY8.51.5.A05.1.454.CMB.1.raw
  modified_base (415)..(415): a, c, t, g, unknown or other
  misc_feature (415)..(415): n is a, c, g, or t
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaaagaatctgctttttggtaccatcagaggccaggccaggcccctgtattggtcatctatgaggacaccaagcgaccctcggaatccctgagagagtcgctggctccaggtcagggacaagtggccaccttgactatcactgggacccagatggacgatagaaggtgactaccactgttattcganagacagcagtggtagtgaggggttcttcgggcggagggacgaaggctggaccggtctggacgtcgacgcccgaaggccgtcgcccccgtggtccacttccg

SEQ ID NO: 212258 - DNA, 506 bp, Homo sapiens
  misc_feature: GYAE6OF02JH214.51.5.A05.1.454.CMB.1.raw
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (493)..(493): a, c, t, g, unknown or other
  misc_feature (493)..(493): n is a, c, g, or t
tcagcgatcgtatacacgaccggtgctcgatttagatagatagacagggggtgggctcaggaggcagagctctgggaatctcaccatggcctggaccctctcctgctcccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagccgaccctccggaatccctgacgagagtcgctggctccgaggtcagggacaatggccacttgactatcactgggacccagatggacgatgaaaggtgactaccactgttattcgacagacagcagtggtagcgaggggtcttcgggcggaggagaagctgaccgtcngngtcagcccaaggctcgccccgtcggtcncgtctcgtccccg

SEQ ID NO: 212259 - DNA, 518 bp, Homo sapiens
  misc_feature: GYAE6OF02HI197.51.5.A05.1.454.CMB.1.raw
  modified_base (332)..(332): a, c, t, g, unknown or other
  misc_feature (332)..(332): n is a, c, g, or t
  modified_base (516)..(517): a, c, t, g, unknown or other
  misc_feature (516)..(517): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaacgccctcggagaccctgtccctcagctgcgctgtatatcgtgggtccttcagtggttactactggagctggatccgccagtccccagggaagggctggagtggatagggcaatcaatcatagtggagacaccgactacaacccgtccctnatgagtcgagtcacatgtcagtggactcgtccaagccctcaccaagggcccatcggtcttcccctggccacctcctccaagacgccacctcgtggggcacgacgccggccctgggctcgccgtggtcaaggacctacttcctcgtacgcctactcgtgacgcgggctcggcacggcgcagtagnnc

SEQ ID NO: 212260 - DNA, 498 bp, Homo sapiens
  misc_feature: GYAE6OF02I29SF.51.5.A05.1.454.CMB.1.raw
  modified_base (480)..(480): a, c, t, g, unknown or other
  misc_feature (480)..(480): n is a, c, g, or t
  modified_base (496)..(498): a, c, t, g, unknown or other
  misc_feature (496)..(498): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaagggctggagtggatagggcaatcaatcatagtggagacacgactacaacccgtcctcatgagtcgagtcaccatgtcagtgactcgtcaagacctcacaaggccatcgtctcccctggcacctcctccaacgcgcacctcgtggggcacgacgcgcctgggctcgcctggcaacgactacttcctcgtacgcactcgtgacggcggcnggacacggcgcatagnnn

SEQ ID NO: 212261 - DNA, 587 bp, Homo sapiens
  misc_feature: GYAE6OF02HHNOE.51.5.A05.1.454.CMB.1.raw
tcagcgatcgtatacacgaccggtgctcgatttagatagatagacgaagggggtgctttctgagagtcatgggacctcctcgcacaagaacatgaaacacctgtggttcttcctcctcctggtggcagctccagatcgggtcctgtcccaggtgcagctacgggcagtggggcgcaggactgttgaagccctggagaccctggtccctcgagcctcgcgcctggtagtatcggtgggtccttcagttggttacttactggagctggactccgccagtccccgagggaacgggctggagtggatagggcgaatcaatcaataggtggacgacaccgactaccaacccgtcctacatgagtcgagtcaccatgtacaggtggactcgtaccaagtccctccaacgaagggcccagttcggtccttccccgtggcctaccctcctccaagacgctaccgtcgtcggggcacgacggccggccgtgggcctcggcctcggtacaacgtcctaccttccgtacgtacgcctacgttccgtcggacggccgggcctcgggaccgtaacggggccgacgaacgtacggcgcgcg

SEQ ID NO: 212262 - DNA, 521 bp, Homo sapiens
  misc_feature: GYAE6OF02GYMEL.51.5.A05.1.454.CMB.1.raw
  modified_base (519)..(521): a, c, t, g, unknown or other
  misc_feature (519)..(521): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagacctccaccagggcccatcggtcttccccctggccaccctcctcccaacgacgcacctcgtcgggggcacgagccggccctgggcctcggcctgggtcaaggacctacttccctcgtacgcactctgacgcgggctggcacggcgcatgnnn

SEQ ID NO: 212263 - DNA, 548 bp, Homo sapiens
  misc_feature: GYAE6OF02ICPRT.51.5.A05.1.454.CMB.1.raw
  modified_base (367)..(367): a, c, t, g, unknown or other
  misc_feature (367)..(367): n is a, c, g, or t
  modified_base (461)..(461): a, c, t, g, unknown or other
  misc_feature (461)..(461): n is a, c, g, or t
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaatctgctttttggtaccatcagaggccaggccaggcccctgtattggtcatctatgaggacaccaagccgaccctcggaatcccctgagagagtcgctggctccgaggtcagggacaagtggccaccttgactntcactcgggacccagatcgggacgtagtaggaaggtgaacctaccacttgttattccgaacagacagcaggtggagtcgaggggttcttcgggnggaagggtacgagtcgtacggtacccgtcgtaggacgtccgaagccccgaagggcctaccggcccccgtggtcccacgtttccccgg

SEQ ID NO: 212264 - DNA, 522 bp, Homo sapiens
  misc_feature: GYAE6OF02I3KQ0.51.5.A05.1.454.CMB.1.raw
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaaagaaatctgtcttttggaccatcagagccaggccaggcccctgtattggtcatctatgaggacacaagcgaccctccggaatccctagagagagtcgctggctccgaggtcagggacaagtggccacttgactatcacgtcgggacccagacgtggacgatggaaggtcgactaccagttgttacttcgacagacagcagtggtagtcgaggggtcttcgggcggagggacgagcgtagaccgtcgtagacgtcagacccgaaggtcctccgccccgtggtaccacttccg

SEQ ID NO: 212265 - DNA, 513 bp, Homo sapiens
  misc_feature: GYAE6OF02GIEQH.51.5.A05.1.454.CMB.1.raw
  modified_base (511)..(513): a, c, t, g, unknown or other
  misc_feature (511)..(513): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtcctcatgagtcgagtcaccatgtcagtggactcgtccaagacctccaccaagggcccatcggtcttccccctggccaccctcctccaacgacgcacctcgtcggggcacgacgccggccctgggctcgcctggtcaaggactacttcctcgtagcactctgagcgggctggcaggcgcatagnnn

SEQ ID NO: 212266 - DNA, 537 bp, Homo sapiens
  misc_feature: GYAE6OF02GOROC.51.5.A05.1.454.CMB.1.raw
  modified_base (534)..(536): a, c, t, g, unknown or other
  misc_feature (534)..(536): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaagggctggagtggatagggcgaatcaatcatagtggagacaccgactacaacccgtcctcatgagtcgagtcaccatgtcagtggactcgtccaagcctccaaccaacgggcccatccggtccttccccctcggccaccctcctaccaagacgccacctcgtcggggccacgacgccggccctgggcctcgcccgtgggtccaacggacctacttccgtcgtacgcactctggacgcgggctcggcgaacggcgacagtacgnnng

SEQ ID NO: 212267 - DNA, 540 bp, Homo sapiens
  misc_feature: GYAE6OF02F20E2.51.5.A05.1.454.CMB.1.raw
  modified_base (538)..(540): a, c, t, g, unknown or other
  misc_feature (538)..(540): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctgggagtggatagggcgaatcaatcatagtggagacaccgactacaacccgtcctcatgagtcgagtcaccatgtcagtgactcgtccaagaccctccaccgaaggcccatcggtccttcccctggccaccctcctccaagacgccacctcgtcggggccacgacgccggcccgtgggcctcggcccgtggtaccaacgggacctaccttcctcgtacgcacctcgtggacgcggggtctggcgaacgggcgctagtacgnnn

SEQ ID NO: 212268 - DNA, 534 bp, Homo sapiens
  misc_feature: GYAE6OF02GGRDQ.51.5.A05.1.454.CMB.1.raw
  modified_base (531)..(532): a, c, t, g, unknown or other
  misc_feature (531)..(532): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaagggctggagtggatagggcgaatcaatcatagtggagacacgactacaacccgtcctcatgagtcgagtcacatgtcagtgactcgtccaagacctccacgaacggcccatcgtctcccccgtgccaccctcctccaacgacgcaccgtctggggccacgacgccggcccgtgggcctcgcccgtggtaccgaacggtacctacttcctactaccgatccgccgtggacggccgggcgtcggccgaaggccgcagtagnncg

SEQ ID NO: 212269 - DNA, 556 bp, Homo sapiens
  misc_feature: GYAE6OF02JCVGP.51.5.A05.1.454.CMB.1.raw
  modified_base (205)..(205): a, c, t, g, unknown or other
  misc_feature (205)..(205): n is a, c, g, or t
  modified_base (408)..(408): a, c, t, g, unknown or other
  misc_feature (408)..(408): n is a, c, g, or t
  modified_base (554)..(556): a, c, t, g, unknown or other
  misc_feature (554)..(556): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagcccctcggagaccctgtccctnagcctgcgctgtatatcgtgggtccttcagtggttactactggagctggatccgccagtccccagggaagggctggagtggatagggcgaatcgaatcatagtggagacaccgatacaacccgtcctcatgagtcgagtcaccatgtcagtggactcgtccaagacctccaccaagggcccaagtcgtcctccccctggaccnccctcctccaagacgccaccgtcgtcggggccacgagccggcccgtggggcctcgcccgtggtaccgaacgggaccttaccgttccgtaccgtacggtccacgtaccgtggacggtcgggctcgggacgacggccgacagtacggnnn

SEQ ID NO: 212270 - DNA, 525 bp, Homo sapiens
  misc_feature: GYAE6OF02G3AGH.51.5.A05.1.454.CMB.1.raw
  modified_base (522)..(523): a, c, t, g, unknown or other
  misc_feature (522)..(523): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtggtccttcagtggttactactggagctggatccgccagtccccagggaagggctggagtggatagggcgaatcaatcatagtggagacaccgactacaacccgtcctcatgagtcgagtcaccatgtcagtggactcgtaccaagacctccaccaggcccatccggtcttccccctggccacctcctaccaacgacgcacctcgtggggcacacgccggccctggctcgcctggtcaaggtctaccttccgtcgtacgctacctcgtcgaggtcgggcgtcggcgacggcggcagtaggnngc

SEQ ID NO: 212271 - DNA, 532 bp, Homo sapiens
  misc_feature: GYAE6OF02G0QS0.51.5.A05.1.454.CMB.1.raw
  modified_base (530)..(532): a, c, t, g, unknown or other
  misc_feature (530)..(532): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtcctcatgagtcgagtcaccatgtcagtggactcgtccaagacctccaccaacgggcccatccggtccttccccctggccaccctccctcccaacgacgccacctcgtcggggccacgacgccggcccgtgggcctcggccgtcggtcaacggactacttccgtcgtagcactcgtgacggcgggctcggcaggcgcagtagnnn

SEQ ID NO: 212272 - DNA, 499 bp, Homo sapiens
  misc_feature: GYAE6OF02HNQK0.51.5.A05.1.454.CMB.1.raw
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (496)..(497): a, c, t, g, unknown or other
  misc_feature (496)..(497): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtcccctcagcctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtgactcgtccaagcctccaccaaggcccatcgtctccccngcncctccncacgngcactcngggcacagcgccnggcngcctggtcaaggctactcctcgtagcactcgtgacgcgggctcgggcagggcgacgatagnncg

SEQ ID NO: 212273 - DNA, 567 bp, Homo sapiens
  misc_feature: GYAE6OF02IO4IL.51.5.A05.1.454.CMB.1.raw
  modified_base (564)..(565): a, c, t, g, unknown or other
  misc_feature (564)..(565): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtcccctcagctgcgctgtatatcgtgggtccttcagtggttactactggagctggatccgccagtccccaggggaaggggctggagtggatagggcgaatcaatcatagtggagacaccgactacaacccgtccctcatgagtcgagtcaccatgtcagtggactcgtccaagacctccaccaagggcccatccggtccttcccccgtggcctaccctcctccaacgacgccacccgtcgcggggcaccgacggccggcccgtggggcctcggccgtcgggtaccgaacgggtaacctacctttccgtcgttaacgcctaactccgtggacggtccgggcgtcggacgaacgggccgacgagtagnncg

SEQ ID NO: 212274 - DNA, 570 bp, Homo sapiens
  misc_feature: GYAE6OF02G3A4Q.51.5.A05.1.454.CMB.1.raw
  modified_base (567)..(568): a, c, t, g, unknown or other
  misc_feature (567)..(568): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaaccccgtcctcatgagtcgagtcaccatgtcagtggactcgtccaagacctccaccaaggcccatcggtccttccccctggccaccctcctccaacgacgccaccctcgtcgggggccacgacggccggcccgtcgggccttcggcccgttgggtaccaaacgggtaccttaccgtttcccgtcgttacgcctacctccgtggacggccggggtccgtcgggccgaacgggccgaccgagtaggnngc

SEQ ID NO: 212275 - DNA, 505 bp, Homo sapiens
  misc_feature: GYAE6OF02HM6PH.51.5.A05.1.454.CMB.1.raw
  modified_base (394)..(394): a, c, t, g, unknown or other
  misc_feature (394)..(394): n is a, c, g, or t
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
  modified_base (503)..(505): a, c, t, g, unknown or other
  misc_feature (503)..(505): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaagggctggagtggatagggcgaatcaatcatagtggagacacgactacaaccgtcctcatgagtcgagtcaccatgtcagtggactcgtccaagacctcaccaaggcccatcggtcttccccnggccacctcctccaagacncacctcnggggcacagccggccctgggctgcctggtcaagactacttcctcgtagcactcgtgacgcgggcgtggcgaggcgcacgtagnnn

SEQ ID NO: 212276 - DNA, 503 bp, Homo sapiens
  misc_feature: GYAE6OF02GK2UT.51.5.A05.1.454.CMB.1.raw
  modified_base (399)..(399): a, c, t, g, unknown or other
  misc_feature (399)..(399): n is a, c, g, or t
  modified_base (465)..(465): a, c, t, g, unknown or other
  misc_feature (465)..(465): n is a, c, g, or t
  modified_base (501)..(502): a, c, t, g, unknown or other
  misc_feature (501)..(502): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgatacaacccgtcctcatgagtcgagtcaccatgtcagtgactcgtcaagcctcacaaggcccatcgtctcccctgcacctccnccagacgcacctctcggggcacgacgcggccctgggcctcgcctggtcaacgctacttcctcgtanctactcgtgacgcgggctggacgacggcgcagtcgnnc

SEQ ID NO: 212277 - DNA, 540 bp, Homo sapiens
  misc_feature: GYAE6OF02H7T01.51.5.A05.1.454.CMB.1.raw
  modified_base (486)..(486): a, c, t, g, unknown or other
  misc_feature (486)..(486): n is a, c, g, or t
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaaagaaatctgtctttttggtaccattcagaggccaggccaggcccctgtattggtcatctatgaggacaccaagccgaccctccggaactccctgagacgagtcgctggcctcgaggtcagggacaagtggacctacttgactatcacgtcgggacccagactggacgatgaaggtcgactacacttgttattcgacagacagcagtggtagcgtaggggtcgttcgggcggtagggacgaagcgtcgaccgtcgcgngtccgagcccgaaggcctccggccccgtcggtcctacgttccgtcgttcccccg

SEQ ID NO: 212278 - DNA, 516 bp, Homo sapiens
  misc_feature: GYAE6OF02F1KK6.51.5.A05.1.454.CMB.1.raw
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagcccaccctcagtgtcagtgtctccaggacaaacggccaagatcacctgctttggagatgcgttgaccaaaagaaatctgtcttttggaccatcagaggcaggccaggcccctgtattggtcatctatgagacaccaagcgacccgtccggaactcccgtagagagagtcgctggctccgaggtcgaggacaatcgcctacttgactancacgtcggacccagagtcgganagtgaaggtcactacacgttgttactcgacagacagcgagtggtagtgaggggttctcggcggtaggacgagcgtacggaccgtcgtgacgtcacgccgacgctccgccctcggtcacgtccg

SEQ ID NO: 212279 - DNA, 563 bp, Homo sapiens
  misc_feature: GYAE6OF02G00N1.51.5.A05.1.454.CMB.1.raw
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactaccaacccgtccctcatgagtcgagtcaccatgtcagtggactcgtccaagacctccaccgaagggcccacgtccggtccttcccccgtcggcctaccctccctaccaacgacgccacctcgtcggggcacgacgccggcccgtcgggccgtcgccgtcgggtccaacggtaccttaccgttccgtcgtacgcctacctcgtcggacggccgggcgtcggacgaacgggccgcgacgtagngnc

SEQ ID NO: 212280 - DNA, 588 bp, Homo sapiens
  misc_feature: GYAE6OF02I2SCG.51.5.A05.1.454.CMB.1.raw
  modified_base (204)..(204): a, c, t, g, unknown or other
  misc_feature (204)..(204): n is a, c, g, or t
  modified_base (586)..(586): a, c, t, g, unknown or other
  misc_feature (586)..(586): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctnagctgcgctgtatatcgtgggtccttcagtggttactacgtggagctggatccgccagtccccagggaagggctggagtggatagggcgaatcaatcataggtggacgacaccgagtaacaaccccgtcctacatgagtcgagtcaccatgtcagtggactcgtaccaagacctccaaccgacgggccacgtccgtccttcccccgtaggcctaccctccctaccgaacgacgtccaacccgttcgtaccgggggtccaacgtacggccggtccccgtgggacccttcggcccgtggtaccgaacgggtacctacgttcccgtacgtacgccgtactcggtcggacgccgggtctcgggacgtaacggcgtaccagtaggcngc

SEQ ID NO: 212281 - DNA, 571 bp, Homo sapiens
  misc_feature: GYAE6OF02GSHBF.51.5.A05.1.454.CMB.1.raw
  modified_base (169)..(169): a, c, t, g, unknown or other
  misc_feature (169)..(169): n is a, c, g, or t
  modified_base (568)..(568): a, c, t, g, unknown or other
  misc_feature (568)..(568): n is a, c, g, or t
  modified_base (571)..(571): a, c, t, g, unknown or other
  misc_feature (571)..(571): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcncaggactgttgaagccctcggagaccctgtccctcagctgcgctgtatatcgtgggtccttcagtggttactactggagctggatccgccagtccccagggaagggctggagtggatagggcgaatcaatcatagtggagacaccgactacaacccgtcctcatgagtcgagtcaccatgtcagtggactcgtccaagaccctccaccgaacgggcccagtccggtccttcccccgtggcccaccctcctaccaacgacgccaccctcgcggggccacgacgccggcccgtgggcctcggcctgggtacaacgggtcctaccttccgtacgtacgcctaccgtcgttcgggacggtccggggtcgtacgggacctaacgggccgtaccgaaggtacggncgn

SEQ ID NO: 212282 - DNA, 546 bp, Homo sapiens
  misc_feature: GYAE6OF02GHCSI.51.5.A05.1.454.CMB.1.raw
  modified_base (543)..(546): a, c, t, g, unknown or other
  misc_feature (543)..(546): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtcctcatgagtcgagtcaccatgtcagtgactcgtccaagacctccaccaagggcccatccggttttccccctgggccaccctcctcccaacgacgccaccttcgtcgggggccacgacgccggcccgtcgggccgttcggcccgtgggtaccaacgggtaccttaccgttccgtcgtacgccacgtctggacggcgggctggcaaggcgcatagnnnn

SEQ ID NO: 212283 - DNA, 645 bp, Homo sapiens
  misc_feature: GYAE6OF02GASNV.51.5.A05.1.454.CMB.1.raw
  modified_base (217)..(217): a, c, t, g, unknown or other
  misc_feature (217)..(217): n is a, c, g, or t
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagcccaccctcagtgtcagtcgtctccaggacaaacggccaagatcacctgctttgganatgcgttgaccaaaagaatctgtcttttggaccatcagacggccaggccacggccctgtagttggcatcgtatggaggacaccaagccgaccctcggaactccctgacgagacgtcgcgtggcctcgaggtcgaagggacacgtcggaccaccgttgaacctataccacgtcgggacccaaggtacgtaggaacgtagtaggaaacgggtacgaaccttaccgagttacgtttaacgtacgtaacgaagtaacgacgacggtagtagggtacggttcgggtacggggggttcttacgggggacggaacggggacgaaacggccgtacggtaccggtccgtagggaaccgtcgaaccggacccgtaacgggtcccgtacccggtcccccgttccggtacctacccgttcccgtacccggtttacccccc

SEQ ID NO: 212284 - DNA, 617 bp, Homo sapiens
  misc_feature: GYAE6OF02IBDK7.51.5.A05.1.454.CMB.1.raw
  modified_base (308)..(308): a, c, t, g, unknown or other
  misc_feature (308)..(308): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactacgtggagctggatccgccacgtcccccgagggaacggggctggagtggagtagggcgaatcaagtnatagtggagacaccgactaccaacccgtcctcatgagtcgagtcaccatgtcagtgactcgtccaagaccctccaaccgaacggcccagttccgggtcctttccccccgcgggtccctaccccgttccctacccgaaacgacgccacccgtcgtcgggggccacgacgaccgggcccgtcgggtaccgtcgcccgtcgggttaccgaaacgggttaccttacgtttaccccgtcgttacgcctaccgtccgttacggcggtacccggggtcgtacgggacgaacgggtccgacgtacgtaggtcagtcg

SEQ ID NO: 212285 - DNA, 530 bp, Homo sapiens
  misc_feature: GYAE6OF02FKUMW.51.5.A05.1.454.CMB.1.raw
  modified_base (406)..(406): a, c, t, g, unknown or other
  misc_feature (406)..(406): n is a, c, g, or t
  modified_base (528)..(530): a, c, t, g, unknown or other
  misc_feature (528)..(530): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtcctcatgagtcgagtcaccatgtcagtgactcgtccaagacctccaccaaggcccatccggtcttccccctcggaccnccctcctcccaacgacgccaccctcgtgggggccacgacgccggcccgtgggcctgccctggtacaacggactaccttcctactaccgatcgctggagcgggcgtggcgaggcgacgatagnnn

SEQ ID NO: 212286 - DNA, 516 bp, Homo sapiens
  misc_feature: GYAE6OF02FH4LN.51.5.A05.1.454.CMB.1.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaaagaaatctgctttttggtaccatcagaggccaggccaggcccctgtattggtcatctatgaggacaccaagcgaccctccggaatccctgagagagtcgctggctccaggtcagggacaagtggccacttgactatcacgtgggacccagatggacgatgaaggtgactaccactgttatcgacagacagcagtggtagtcgaggggtcttcgggcggagggacgaagcgtagaccgtcgtgagtcacggccaacggctcgccccgtcggtcaccgtctcgttacccc

SEQ ID NO: 212287 - DNA, 606 bp, Homo sapiens
  misc_feature: GYAE6OF02HA7KC.51.5.A05.1.454.CMB.1.raw
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaaagaatctgtctttttggaccatcagaggccaggccaggcccctgtattggtcatctatgaggacaccaagccgacccctccggaactcccgtgacgagagtcgcgtggctccgaggtcgagggacaagtcggccctaccgttgacttactctacgtcgggacccagtagtcgggacgagtacggaaggtcgaccgtacctattgtttacttacgacacggacacgactagggttgggtacgtcggtagggggttccgttcgggacgggtaagggaaccggaaggtccgtaacggtacccgggtccgtggtaccggtacgaccgacccggtaacggccgtcccggtcccccgttcgggtaccctaccgttccccg

SEQ ID NO: 212288 - DNA, 708 bp, Homo sapiens
  misc_feature: GYAE6OF02FR6Z7.51.5.A05.1.454.CMB.1.raw
  modified_base (285)..(285): a, c, t, g, unknown or other
  misc_feature (285)..(285): n is a, c, g, or t
  modified_base (336)..(336): a, c, t, g, unknown or other
  misc_feature (336)..(336): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcaggtggggcgcaggactgttgaagccctcggagaccctggtccctcagctggcgctgtatatcgtgggtccttcagttggttactacgtggagctggatccgccagtccccagggaagggctggngtggatagggcgaatcaatcatagtggagacaccgactacaacccgtcctnactgagtcgatcacatcgtcagtggactcgtaccaagaccctccaaccgaacgggccctagtccggtccttccccccgtggccctaccctccctacccgaacgcgtaccgtaacccgtcgtacggggggacctaaccgacgggtcccggggaccccgttcggggggtccttaccgggtaccccgttcggggttacccgtaaacgggggtaacccctttaaacccggttttcccctttacccggggttaaccggtaccccgttaaccccgtttaccggttccgggaacggggtccccgggggggtaccgttcgggggtaaccccggaaaccgggggtccggtaacccggaaccggttaacgggtccgaagcgg

SEQ ID NO: 212289 - DNA, 668 bp, Homo sapiens
  misc_feature: GYAE6OF02IPJXT.51.5.A05.1.454.CMB.1.raw
  modified_base (493)..(493): a, c, t, g, unknown or other
  misc_feature (493)..(493): n is a, c, g, or t
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctcaggacaaacggcaagatcacctgctttggagatgcgttgaccaaaagaactcgtgtcgtttttggtaaccatcagacggccgacggccgacggtcccctaggtacgttggtctatctatggacggacaaccgaagccgaccctacggaactcccgtagagagtagtcgcgtcggctccgaggtcgaagggacaacgtcggacctaccgttacgacctatcgtaccgtcgggacccaaggtaacgtacggaacgtaagtaggaaacggtcgtaacctaccgacgtttagttaccgttacgaactaaggaacncggacgtaagggtcggttaaggtccggaacgggggtttccgtacggggtacggggaaggggtaccgtaacggtcggtaaccgtaccggttccgtaggacggtaccgaaccggtcccgaacggtaccgtcccggtacccccgttccggtacctaccgttccgtcccgttacccccg

SEQ ID NO: 212290 - DNA, 623 bp, Homo sapiens
  misc_feature: GYAE6OF02F9GU7.51.5.A05.1.454.CMB.1.raw
  modified_base (282)..(282): a, c, t, g, unknown or other
  misc_feature (282)..(282): n is a, c, g, or t
  modified_base (619)..(619): a, c, t, g, unknown or other
  misc_feature (619)..(619): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtggtccttcaggttggttactacgtggagctggatccgcagtccccagggaacgggctggnggtggagtagggcgaaatcgaagtcataggtaggacgtacaccgactacaaccccgtcctcatcgacgtcgagtcacatgtcgagtcggaactcgtaccaacgaccctaccaaccgaacgggccctaacgttccggtccttcccccgtggccctacccgtccctaccgaacgacgtccgaccctccggtcggggcctaaccgaccggccgtccccggtgggcctcggtacccgtggtaccaacgggtacctaccttcccgtacgtccgacctaccgtccggttcgacgggtccggtacgtccgggacgtaacggggccgccgtaacgtacggtaccngtcg

SEQ ID NO: 212291 - DNA, 742 bp, Homo sapiens
  misc_feature: GYAE6OF02FKN31.51.5.A05.1.454.CMB.1.raw
  modified_base (170)..(170): a, c, t, g, unknown or other
  misc_feature (170)..(170): n is a, c, g, or t
  modified_base (740)..(740): a, c, t, g, unknown or other
  misc_feature (740)..(740): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcaggtggggcncaggactgttgaagccctcggagaccctgtccctcagctgcgcttgtatatcggtggtccttgaggttggttactacgtggagtcgtaggactcccggaccaccggtccccgaggggaacgggggctagggtaggtacgggagtagggacgtaaatcgaaagtcgagttaggtacgggaacgaccgaaccggaaccttaacccgaacccccgttccctacacgtacggtacgtcggtaacgtaccaacctgttacggtacgtacggtacggtaccgttccgtaacccgaaaccgtaccccgtacccgaacccggaaaccgggcccctaggttccccggttaccccctttcccccggtccggacccctacccccgtaccctaaccgaaccggacccgtacccgtaacccgtcgggtacgggggcccaaccgaccgggccgggtcccgtacgggccgtcggtcccgttagggtaaccaacgtacccttaccgttaccgtacgtacgcctaaccgttcggtacggaccggccggggttacgacgggaccgtaacggccgtaagtagtgcgtancg

SEQ ID NO: 212292 - DNA, 644 bp, Homo sapiens
  misc_feature: GYAE6OF02IYV0C.51.5.A05.1.454.CMB.1.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccacctcagtgtcagtgtctccaggacaaacggccaagatcacctgctttggagatgcgttcgaccaaagaatctgtcttttggaccatcagcggccaggccacggcccctgtatggtcatctatgaggacaccgaagcgacccctcggaactcccgtagagagacgtcgacgtcggctccgaggtcgaagggtacagtcggcctacgttgacttatcacgtcgggacccagtagtcggacgtaagtcggaaggtcgaaccgtaccacgttcgtttaattacggaacgtaacgacgtacgcgtaagggtcggtaagttacgggtagggggttccgttcggggacgggtaagggaaccggtaaggccgtacggtacccgttacgtacggtacggtaccgaaccgggtacccgtaacgggcccttaccgggccccccgtttacgggtacccgtaacccggttcccgtttccccggttaccccccgg

SEQ ID NO: 212293 - DNA, 538 bp, Homo sapiens
  misc_feature: GYAE6OF02GKOPH.51.5.A05.1.454.CMB.1.raw
  modified_base (169)..(169): a, c, t, g, unknown or other
  misc_feature (169)..(169): n is a, c, g, or t
  modified_base (535)..(537): a, c, t, g, unknown or other
  misc_feature (535)..(537): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcncaggactgttgaagccctcggagaccctgtccctcagctgcgctgtatatcgtgggtccttcagtggttactactggagctggatccgccagtccccgagggaacggggctggagtggagtaggcgaatcaatcatagtggagacaccgactacaacccgtcctcatgagtcgagtcaccatgtcagtgactcgtacaacgacctaccaccgaacgggcccaagtccggtaccttcccccgtaggcccaccctcctaccaacgacgccaccgtcgtcggggcacgacgccggcccgtgggctcgcctggcaagtctaccttcgtgtcgctacgtcgtggacgcgggctcggacacggcgacagagnnng

SEQ ID NO: 212294 - DNA, 693 bp, Homo sapiens
  misc_feature: GYAE6OF02ILG4M.51.5.A05.1.454.CMB.1.raw
  modified_base (202)..(202): a, c, t, g, unknown or other
  misc_feature (202)..(202): n is a, c, g, or t
tcagcgatcgtatacacgaccggtgctcgatttagatagatagacagggggtgggctcaggaggcagagctctgggaatctcaccatggcctggaccctctcctgcctccccctcctcactttctgcacagtctctgacggcctcctatgagctgacgcacgcccaccctcagtgtcagtgtctccaggacaacggccaagntcactgtcttggacgatgtccgttgaccaaaagtaactcgtgttctttttacggacctatacaggacggccacggccgacggccccttgttagttcggtctaacttctaagtggaaggaccaaccgaacggacccgtaccccgtacccggtaaacttcccgacggtagaacggagtccggcgtcggcccttaccgagggtccgaagggtaacacgtacggaccctacgtcggtactactccgtacgaccgggtacccagtaacggtgggaaccgtagtaggaaacggtcgaacctaacctacttgtttaacgttcgaacgacgtagaacgcgtaggtggttacggcgggtacggggttcggtacgggacggggtacgggtacgaacgtacggtaccgtccggtacgtcggtacggttacgaaccggtccccggagggtaccctcccgggtaccccttcgggtaccctccgttccgttacccggtacccccg

SEQ ID NO: 212295 - DNA, 656 bp, Homo sapiens
  misc_feature: GYAE6OF02IJ2YT.51.5.A05.1.454.CMB.1.raw
  modified_base (367)..(367): a, c, t, g, unknown or other
  misc_feature (367)..(367): n is a, c, g, or t
  modified_base (648)..(648): a, c, t, g, unknown or other
  misc_feature (648)..(648): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctccagatgggtcctgtcccaggtgcagctacggcaggtggggcgcgaggactggttgaacgccccgtcgggacgaccctcgtccctcaggctgcgctgtatctcggtggtccttcgagttggttactacgtgggacgtcgtggacgtccgccgaacgtccccgaaggggaaggggctgggagtggagtaggggcaagtcaaatcaagtagtggacgacgaccgaacgtaccaaccccgtccncagtgacgtcgagtaccacgatcgtcagtcggtactcgtacccaagaccctaccaaccgtacgggaccctacgtccggtccgttacccccgtcgacccgtacccttcccgtaccgaacgtaccgcctaaccgttccggtacgggggacccacggcggtacccggtcccgtcgggtccgtccggtaccgtcgggtaccgtaacggtacccgtacgttcccgttacggtactaccgcgttaccgtcggtacggcggtcgtacggcgtaacggcgacacgttanccgtatcg

SEQ ID NO: 212296 - DNA, 621 bp, Homo sapiens
  misc_feature: GYAE6OF02GGUHU.51.5.A05.1.454.CMB.1.raw
  modified_base (208)..(208): a, c, t, g, unknown or other
  misc_feature (208)..(208): n is a, c, g, or t
  modified_base (618)..(618): a, c, t, g, unknown or other
  misc_feature (618)..(618): n is a, c, g, or t
  modified_base (621)..(621): a, c, t, g, unknown or other
  misc_feature (621)..(621): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcaggtggggcgcaggactgttgaacgcccctgggacgaccctgtccctnagctgcgctgtatagtcgtgggtccttcgaggttggttaactacgtgggagtcgtggactcccgccacgtccccgaaggggacggggctgggaggtggagtaggggacgtaatcaatcgagtaggtggaacgacgaccgactaccaaccccgtcctacagtcgacgtcgactcacatcgtctaggtacgactcgtaccaacgtaccctaccaaccgacgggccctacgtccggtcccttcccccgcggaccctacccctccgtaccgaaacgccgacctacccgtcggtcgggaccacgccggccgcccgtcgggctccgccgtcggcgaacgtcttaccttccgtacgtacgtccacttcggtacggacggtccgggcgttcgggaccgacggggccaacgtagtacgncgn

SEQ ID NO: 212297 - DNA, 646 bp, Homo sapiens
  misc_feature: GYAE6OF02H9HOM.51.5.A05.1.454.CMB.1.raw
  modified_base (644)..(644): a, c, t, g, unknown or other
  misc_feature (644)..(644): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctcgtccctcagctgcgctgtatagtcgtggtccttcagttgttactacgtggagcgtggactccgccgacgtcccgagggagggcgtggagtggagtagggacgaatacaatcagtaggtgagacaccgactacaacccgtcctacagtgacgtcgacgtcacatgtacgagtcgtacgtcgtaccgaacgaccctaccaccgaacgggcccacgtcccggtccttccccgcggtaccccaccctccctaacccgaacgacgaccctacccgtaccggtcggggaccacgacggccggcccgtcgggtcctcggtaccgtcggtaaccgtaaacgggtacccttaccgttacccgttaccggtacgtacccgaacccgtttacgttaccgggaccggcccgggggtacgttaccgggaaccgtacgggcgacccggtaatacggtacngc

SEQ ID NO: 212298 - DNA, 581 bp, Homo sapiens
  misc_feature: GYAE6OF02HQ2VW.51.5.A05.1.454.CMB.1.raw
  modified_base (169)..(169): a, c, t, g, unknown or other
  misc_feature (169)..(169): n is a, c, g, or t
  modified_base (204)..(204): a, c, t, g, unknown or other
  misc_feature (204)..(204): n is a, c, g, or t
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcncaggactgttgaagccctcggagaccctgtccctnagctgcgctgtatatcgtgggtccttcagtggttactactggagctggatccgcagtcccagggagggctggagtggatagggcgaatcaatcatagtggagacaccgactaccaacccgtcctcatgagtcgagtcaccatgtcagtcggactcgtacaagtaccctaccaaccgaacggcccaacgttccgggtccttcccccgtggccctaccctcccttacccgaaagacgaccacccgttcgacgggggtccaacgacggccgggcccgtcgggacctcggcccgtcgggtaccaaacggtacctaccgttcctacgtacgcctacgtcgtggacggtcgggctcgggcgaacggccgctaagtcgngntcg

SEQ ID NO: 212299 - DNA, 566 bp, Homo sapiens
  misc_feature: GYAE6OF02GYZ6J.51.5.A05.1.454.CMB.1.raw
  modified_base (172)..(172): a, c, t, g, unknown or other
  misc_feature (172)..(172): n is a, c, g, or t
  modified_base (182)..(182): a, c, t, g, unknown or other
  misc_feature (182)..(182): n is a, c, g, or t
  modified_base (418)..(418): a, c, t, g, unknown or other
  misc_feature (418)..(418): n is a, c, g, or t
  modified_base (454)..(454): a, c, t, g, unknown or other
  misc_feature (454)..(454): n is a, c, g, or t
tcagcgatcgtatacacgaccggtgctcgatttagatagatagacagggggctgtgggctcaggaggcagagctctgggaatctcaccatggcctggacccctctcctgctcccccctcctcactttctgcacagtctctgaggcctcctatgagctgacgcagccaccctnagtgtcagtntctccaggacaaacggccaagatcacctgctttggagatgcgttgaccaaagaaatcgtgtctttttggtaaccatcagacggccaggccacggcccctagtagttcggtcatctatgaaggacaaccgaagccgaccctccggaactcccgtagagagacggtcgctggcctccgaggtcagggacaagtcggaccaccttagacttatcacgtcgggacccagactggactagnggaagtcacctactgtgttactcgacgacgacgagngtagtaggtacgtcggaggggttcgtcgggaggtagggacgaagtcgtcgaccggtcagacgtccgacggaccgacggtccgtaccgtcccccgtacggttccacgttcccg

SEQ ID NO: 212300 - DNA, 278 bp, Homo sapiens
  misc_feature: GYAE6OF02IGXKX.51.5.A05.1.454.CMB.1.raw
  modified_base (169)..(169): a, c, t, g, unknown or other
  misc_feature (169)..(169): n is a, c, g, or t
  modified_base (183)..(183): a, c, t, g, unknown or other
  misc_feature (183)..(183): n is a, c, g, or t
  modified_base (187)..(187): a, c, t, g, unknown or other
  misc_feature (187)..(187): n is a, c, g, or t
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (250)..(250): a, c, t, g, unknown or other
  misc_feature (250)..(250): n is a, c, g, or t
  modified_base (264)..(278): a, c, t, g, unknown or other
  misc_feature (264)..(278): n is a, c, g, or t
tcagcgatcgtatacacgaccggtgctcgatttagatagatagacagggggtgctttctgagagtcatggacctcctgcacaagaacatgaaacacctgtggttcttcctcctctggtggcagctcccagatgggtcctgtcccaggtgcagctacggcaggtggggcncaggactgttgaancccnggagccctgtccctnagctgcgntgtatacgtcgtggttctcaaggttggttaactactggancttgggatcccggnnnnnnnnnnnnnnn

SEQ ID NO: 212301 - DNA, 642 bp, Homo sapiens
  misc_feature: GYAE6OF02GID3F.51.5.A05.1.454.CMB.1.raw
  modified_base (169)..(169): a, c, t, g, unknown or other
  misc_feature (169)..(169): n is a, c, g, or t
  modified_base (206)..(206): a, c, t, g, unknown or other
  misc_feature (206)..(206): n is a, c, g, or t
  modified_base (348)..(348): a, c, t, g, unknown or other
  misc_feature (348)..(348): n is a, c, g, or t
  modified_base (641)..(641): a, c, t, g, unknown or other
  misc_feature (641)..(641): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcncaggactgttgaagcccctggacgaccctgtcccctnagctgcgctgtatatcgtgggtccttcaggttggttactacgtggagtctggactcccgccacggtccccgaaggggaacggggctggaggtggagtagggcgaatcaatcagtagtggagacaccgactacacccgtcctnatgacgtcgagtccaacatgtacaggtcgacctcgaccgaacgtacccctacgaaccgaacgggtccctaacgtcccggttccccttacccccgtcggcccctacccctcccgtaccgaacgtaccgaccgtacccgtccggtacgggggaccacgacgggcccggtcccggtagggcctccggtccgtacgggtaccgtaaacgggtacccttaccgttccctacggttacgacctaccgttcgtacggacgggtccgggtacgtcgggacgaacggcggacacgtagcgang

SEQ ID NO: 212302 - DNA, 683 bp, Homo sapiens
  misc_feature: GYAE6OF02I1B52.51.5.A05.1.454.CMB.1.raw
  modified_base (174)..(174): a, c, t, g, unknown or other
  misc_feature (174)..(174): n is a, c, g, or t
  modified_base (204)..(204): a, c, t, g, unknown or other
  misc_feature (204)..(204): n is a, c, g, or t
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagcccaccctcngtgcagtgtctccgaggacaaacggcaagntcacctgctttaggatatggcttacgaccaaaagtaacttcgtagttccgtttttcggaacctattcgaggacggccacggcccacgggtccccctggttaattggttacacttctagtggaacggaccaaccgaacggcccgaacccgtaccggaactccccgtaggagtacgacggtcgacgtcggtccttccgaggttcgagggtaacaagtcggaccctacgttacgtaacttacgtaccacggtcgggaccaaggtacgtacgggacgtagtacgggaaggttacggaaccttacctaaccgtttacgtttacgtaccgaacggtaacgtaacgcgtaacgtaggttaccgggttaaggtcgggtaacggggtttcgtacggggacgggtaacgggaaccggacgtacgtcggacccgtggtacgaggtccaacgtccgaacggcctacccggcccgtcgtacctccgttcccg

SEQ ID NO: 212303 - DNA, 534 bp, Homo sapiens
  misc_feature: GYAE6OF02H29EQ.51.5.A05.1.454.CMB.1.raw
  modified_base (169)..(169): a, c, t, g, unknown or other
  misc_feature (169)..(169): n is a, c, g, or t
  modified_base (203)..(203): a, c, t, g, unknown or other
  misc_feature (203)..(203): n is a, c, g, or t
  modified_base (339)..(339): a, c, t, g, unknown or other
  misc_feature (339)..(339): n is a, c, g, or t
  modified_base (510)..(510): a, c, t, g, unknown or other
  misc_feature (510)..(510): n is a, c, g, or t
  modified_base (531)..(532): a, c, t, g, unknown or other
  misc_feature (531)..(532): n is a, c, g, or t
tcagcgatcgtatacacgaccggtgctcgatttagatagatagacagggggtgctttctgagagtcatggacctcctgcacaaagaacatgaaacacctgtggttcttcctcctcctggtggcagctccagatgggtcctgtcccaggtgcagctacggcagtggggcncaggactgttgaagccctggagaccctgtccctnagctgcgctgtatatcgtggtccttcagtggttactacgtggagctggactccgccacgtccccgagggaacggggctggacgtggagtagggcaatcaatcagtagtggagacaccgactaaccaacccgtccanatgagtcgagtcacagtgtacagtgactcgtacaacgacctccaacgaggccacgtcgtccttccccgtggccaccctcgaccaagacgcaccgtcgtcgggcacgagccggccgtggctcgctaggtcaaggtactacttcctacgtacacactcgtgacggcggtacgnggacgaacggcgactagagtnncg

SEQ ID NO: 212304 - DNA, 798 bp, Homo sapiens
  misc_feature: GYAE6OF02F6SGE.51.5.A05.1.454.CMB.1.raw
  modified_base (169)..(169): a, c, t, g, unknown or other
  misc_feature (169)..(169): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcncaggactgttgaagccctcggacgaccctgtccctcagctgcgctgtatatcggtcggtccttcgagtcggttactacgtggacgtcgtggactccgccaccggtcccgaaggggacgggtctagggaggtggagtagggacgaatacgaatcgaagttaggtacgggaacgtaaccacccggtaacctaaccccgaaccccggttcccctacgtagtacggaacgttaccggaacgtaccctaaccgtagttcgtacgtaggtcggtaaccttccgtaacccgaaacgtacccctacccgaaacccggaaacggggtcccctaacggttccccggttaccccgtttccccccggtcgggtacccctaacccccgttccccttaacccggaaaccggaccggtacccgtacccggttccggggtacccgggggacctaacccggtacggggcccccgggttacccgttcgggggtcccttccgggtaccccggttacgggttaaccgaaacccggttacctttacccgtttcccgtacgttaccgccttaccggttacggtaccgggacgggtacccggggtccgtacggaacccgggtacggggacccttaggacgtacggccagtcg

SEQ ID NO: 212305 - DNA, 770 bp, Homo sapiens
  misc_feature: GYAE6OF02GVFBC.51.5.A05.1.454.CMB.1.raw
  modified_base (127)..(127): a, c, t, g, unknown or other
  misc_feature (127)..(127): n is a, c, g, or t
  modified_base (177)..(177): a, c, t, g, unknown or other
  misc_feature (177)..(177): n is a, c, g, or t
tcagcgatcgtatacacgaccggtgctcgatttagatagatagacagggggtgggctcaggaggcagagctctgggaatctcaccatggcctcggacccctctcctgcctccccctctctactttcngcacacgtctctggacgccctctatgagtctggacgcacgcccacccgtnagttcgtcagttcgtctaccgaggaacaaaccggcaaagactacgaccgtgtacgtttaggaagtactaggtcgttacaacgtaaaagtaacttcgtaggtttcgttttacggtacctaagtacgtaaggaccgaccgtacggccgtaccggtcccttagttacgttacgtactattacgtagttacggaacgaaccgaaccgtaaccgccgtaacccgtacgtaacctcccggtagaacggtacgtacgtcgtacgtccggtacgaccgaggtacgaacgggtactaaacgtccggaaccgttacgttacgaacttcgtaacccgtacgggtacccggaaccgtaggtaacggtacggaagtacggtacgggtaaagtaccgtaaccgttaccgtaacggtttgttaacgttacgaacgtacgacgaacgtcgtacggttacggtacgtacgggtacggttcggtacgggtacgggaacggtacgaacggtccgacggttaccgcgttacggaactaacggtccgtaacccgaccggtacgtaccccggttacccgtcggttaaccaccgtttaccgtaccccgttaccccg

SEQ ID NO: 212306 - DNA, 658 bp, Homo sapiens
  misc_feature: GYAE6OF02HE734.51.5.A05.1.454.CMB.1.raw
  modified_base (169)..(169): a, c, t, g, unknown or other
  misc_feature (169)..(169): n is a, c, g, or t
  modified_base (222)..(222): a, c, t, g, unknown or other
  misc_feature (222)..(222): n is a, c, g, or t
  modified_base (544)..(544): a, c, t, g, unknown or other
  misc_feature (544)..(544): n is a, c, g, or t
  modified_base (654)..(654): a, c, t, g, unknown or other
  misc_feature (654)..(654): n is a, c, g, or t
  modified_base (658)..(658): a, c, t, g, unknown or other
  misc_feature (658)..(658): n is a, c, g, or t
tcagcgatcgtatacacgaccggtgctcgatttagatagatagacagggggtgctttctgagagtcaatggacctcctgcacaagaacatgaaacacctgtggttcttcctcctcctggtggcagctccagatgggtcctgtcccaggtgcagctacggcagtggggcncgaggactgttgaacgccctcggagaccctgtccctcagctgcgtctgtattntcggttggtccttcgagttgttactacgtggagcgtggactccgccacggtccccgaaggggaagggcgtgggaggtggaacgtaggggacgaatcaatctataggtaggacgacacccgaactacccaaccccgttccactagtcgtagtcgacctcaacagttcgacgtaggtcggtactccgtaccaacggtaccctaccgaaccgtaacccgggccctacgtcccgggttccccttcccccggacggtacccctaccctcctaccgacgaccgacctacccggtcgggacggggcctacggccggacccgggtcccgnggggtcctcggccgttcgggcgtaaccggtactttcccgtaccgtacgtaccgcttacgttcggtacggacgggtcccgggtgtaccggacgtacggcgccgtagtacgnacgn

SEQ ID NO: 212307 - DNA, 607 bp, Homo sapiens
  misc_feature: GYAE6OF02FQYRR.51.5.A05.1.454.CMB.1.raw
  modified_base (168)..(168): a, c, t, g, unknown or other
  misc_feature (168)..(168): n is a, c, g, or t
  modified_base (203)..(203): a, c, t, g, unknown or other
  misc_feature (203)..(203): n is a, c, g, or t
  modified_base (346)..(346): a, c, t, g, unknown or other
  misc_feature (346)..(346): n is a, c, g, or t
  modified_base (603)..(604): a, c, t, g, unknown or other
  misc_feature (603)..(604): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtgggcncaggactgttgaagccctcggagaccctgtccctnagctgcgctgtatatcgtgggtccttcagtggttactacgtggagtctggactccgccaacgtccccgaaggggaacgggctagggagtggagtagggcaaatcaaatcaatagtggagacaccgactaccaacccgtcctanatgacgtcgagtcacatgtacagtgactcgtaccaaagccctaccgaacgaacggcccagtccggtccttccccgtcgtcccaccctcccgtaccgtaacgacgacctacccgtcgtcggggacctacgaccggtccggcccgtcgggccgtcggccgttacgggtacctaacggtaccttaccgttacccgtacgtaccgaccgtaccgtcgtacggacggtcgggaccgttcggacgaacggcgacgtagtacgnntcg

SEQ ID NO: 212308 - DNA, 668 bp, Homo sapiens
  misc_feature: GYAE6OF02IY4HH.51.5.A05.1.454.CMB.1.raw
  modified_base (176)..(176): a, c, t, g, unknown or other
  misc_feature (176)..(176): n is a, c, g, or t
  modified_base (229)..(229): a, c, t, g, unknown or other
  misc_feature (229)..(229): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
tcagcgatcgtatacacgaccggtgctcgatttagatagatagacagggggctgtgggctcaggaggcagagctctgggaatctcaccgatggcctggacccctctcctgccttcccctcctcacttttctgcacagtctctgaggcctcctagtgagctgacgcacgccaccctnagtgtcagttgtctccaggacaaacggcctaaagactcacctgtctttaggangttcgcgttacgaccaaaagattctcgtcttttggtacactcagacggcacgccgagtccctgtattggtcatctagtcgaggtaccacgaacgccgtaccctacggactccgtgagtacgntccgngcgtcgtccgaggtacgaggacaagtccgctacctagactacgtccgtacgtacggaccagtacgtaggaccgtaagtacgtaacggtcaaacccgtaccgttacgttaggtttacttacggaaacgttacggaactcgaaccggttaaggttcgggtaacggtcgggtaacggggtttcgttaccggggtaacggtacgggaacgtaacgggtccgttaacggtaccccggttagtcgtaacgttacccggaagaaccccgttacgggtcctaacccggggttccccaacgggttacctacccgttcccgg

SEQ ID NO: 212309 - DNA, 701 bp, Homo sapiens
  misc_feature: GYAE6OF02JB7UG.51.5.A05.1.454.CMB.1.raw
  modified_base (170)..(170): a, c, t, g, unknown or other
  misc_feature (170)..(170): n is a, c, g, or t
  modified_base (698)..(698): a, c, t, g, unknown or other
  misc_feature (698)..(698): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcaggtggggcncgaggactgttgaacgccctcggacgaccctgtcccctacgagctgccgctgtatatcggtggtcccttcgagttcggttactacgtggacgtcgtggactccgccacgtccccgaggggagggcgtggaggtggagtacgggcgaatcaatcagtacggtggacgaccgaccgactaaccaaccccgtccctacagtggacgtcgacgtcctaaccatgtcagtacggacctcggtaccaacgtaccctaccaaccgaccgggtacccacgttcccggtacccctttcccccgtcgggtacccctaccccttcccgtaaccgaaacggtaccgacccttacccggtccgggtcgggggacccaaccgtaccgggtcccgggtccccggtgggtcccgtcgggtaccccgttgggtaacccgaaccggtacctttaaccgttcccgtacggtaccgaccgtaaccgttccggtaggaacccgggtcggggtcctacggggaccgaacgggcccacgttaagcggtcgnacg

SEQ ID NO: 212310 - DNA, 851 bp, Homo sapiens
  misc_feature: GYAE6OF02I42GV.51.5.A05.1.454.CMB.1.raw
  modified_base (308)..(308): a, c, t, g, unknown or other
  misc_feature (308)..(308): n is a, c, g, or t
  modified_base (843)..(843): a, c, t, g, unknown or other
  misc_feature (843)..(843): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcaggtggggcgcgaggactgttgaacgcccgtcggacgaccctggtcccctcagctgcgctgtatatcggtcggtccttcgaggttggttactacgtggacgtcgtaggactcccggcctacggtccccggaggggacgggcgtacggnggtaggagtagggaccgaagtcgtaagtcgtaacgtaggtagggacgaccgtacccgaacctacccgtaaccccggttccctacgtaagtacgtagttaccgacgtaccgaacgtattacgtcgtaacggtcggtaaccgttaccgacccgaaacgtacccctacccgaacggaacccgggacccgtaacgttcccggttacccctttccccccggtacggtaccccgtaaccccgtaccccggttaacccgtaaacgggtaacccgtccccggtaaaccccggtttccgggtacccggggggtaacccttaaccgggcccggggtaccccgggtaccccgggtttacggggcccggttccccgggtacccgggttaccgggtaacccgtaaaaccggggtttaccccgttacccggttttaacccggtaccgggtaaccggttacccgttaacccggttccgggtaacggggtaacccggtcgggggttaacccgtacgggaaccggtaacgggtccgaacgtacgggtaacgnggacgtcg

SEQ ID NO: 212311 - DNA, 672 bp, Homo sapiens
  misc_feature: GYAE6OF02FPQPK.51.5.A05.1.454.CMB.1.raw
  modified_base (667)..(667): a, c, t, g, unknown or other
  misc_feature (667)..(667): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtgggcgcaggactgttgaagccctcggagaccctgtccctcagctgcgctgtatagtcgtggtccttgagtcggttaactacgtggacgtctggactcccgccgacggtcccccgaaggggaaggggcgtgggaggtggaagtagggcgtaagtcgaagtcaagtaggtggagacctaaccgactaaccaaccccgtcctctatgacgtcgagtccaccgtagtcgtacagtcggactccgtaccaacggtaccctcccgaaccgaacgggcccctagtcccggtttcccttcccccgtacggaccctaccccctcccgttacccaaccgaccacctaacccgtccggtaggggacccaacgaccgtcccgggccccgttagggcctcggtacccgttgggtacccgaaccggttaccttaacccgtttcgtaccggtaacgcctaaccgtcgtacggaccgggaccgggtcgtacgggacgtacggggccctagaccgtagcgntacgg

SEQ ID NO: 212312 - DNA, 851 bp, Homo sapiens
  misc_feature: GYAE6OF02GTEXV.51.5.A05.1.454.CMB.1.raw
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcaggtggggcgcagggactggtttgaacgccccgttcgggacgaccccttggtccccttcaggccttggccgcttggtaattacgtccggttgggttcccctttcgaggttcggttttaacctaacgttggggacgcgttagggacttccccggacctaccgtacccccggaagggggaaacgggggtccgttaggggacggttcggggaagttaagggggtaccgtaaacgtacgtaaactcgtaagttaaggtacgggaacgaaccgaacccggtaacctaacccgaaacccccggttcccctaacgtaccgtacggaacggttaccgaagtaccctaaccgtcgttacggtaccgtaaggtacgggtaacctacccgtaaacccgaaaccggtacccctacccgaacccggaaaccggggtaccccctaacggtccccggtttcccctttaccccccggtccgggtacccctaacccccgttcccgttaacccgaaccgtacccgtacccgtaacccgttcgggtaccggggacctaaccgaccgggtcccgggtcccgtgggtacccgtcggtcccggttacgggtaccgaacgttaacccttccgttaccgtacgtaccgtactaccgttcgacggtaccggtcgggaccgtcggaccggtaacggccgtacgtaacgtcgctagcg

SEQ ID NO: 212313 - DNA, 735 bp, Homo sapiens
  misc_feature: GYAE6OF02G6KN6.51.5.A05.1.454.CMB.1.raw
  modified_base (104)..(104): a, c, t, g, unknown or other
  misc_feature (104)..(104): n is a, c, g, or t
  modified_base (154)..(154): a, c, t, g, unknown or other
  misc_feature (154)..(154): n is a, c, g, or t
  modified_base (177)..(177): a, c, t, g, unknown or other
  misc_feature (177)..(177): n is a, c, g, or t
tcagcgatcgtatacacgaccggtgctcgatttagatagatagacagggggctgtgggctcaggaggcagagctctgggaatctcaccatggcctggacccctntcctgctccccctctcactttctgcacacgtctctggacgcctctatganctagacgcacgcccacctgagtntcagttcgtcctaccgaaggaacaaccggtcaaagtctacaaccgtgtaccgttagatagtcgacgttcgaaccgaaaagtacttcgttacgttacgtttttacggaacctacgttacgacggtaccggccgacggccgtacggtcccgttgtaacgttcgactactacgttacgtacgacggtacaccgtacggaccgtaccgtacgtactccgacgaggtcacgtcgacgtcggacgtacgtacggcgacggactcgacgtactacgtagtactgacgtacgacggacctaggaccgtacggtaacgtggttaacgtacggtaaccgtactaacggttcgttaacggttaccgtaccggaacgtacggacgtaacgtacgttacgggttcgttaacgtcgggttaaccgggttacggttaaccgggacggtttaacgggaaccggttacgtaccgggttaccgttacggtaaccggtttcggaaccgtttacggaaccggtacgtaaccggtcccgtacggtcccccggttaagttcccgtttaccggtaaccccg

SEQ ID NO: 212314 - DNA, 822 bp, Homo sapiens
  misc_feature: GYAE6OF02FQQLV.51.5.A05.1.454.CMB.1.raw
  modified_base (109)..(109): a, c, t, g, unknown or other
  misc_feature (109)..(109): n is a, c, g, or t
  modified_base (147)..(147): a, c, t, g, unknown or other
  misc_feature (147)..(147): n is a, c, g, or t
  modified_base (168)..(168): a, c, t, g, unknown or other
  misc_feature (168)..(168): n is a, c, g, or t
  modified_base (416)..(416): a, c, t, g, unknown or other
  misc_feature (416)..(416): n is a, c, g, or t
  modified_base (505)..(505): a, c, t, g, unknown or other
  misc_feature (505)..(505): n is a, c, g, or t
  modified_base (818)..(818): a, c, t, g, unknown or other
  misc_feature (818)..(818): n is a, c, g, or t
tcagcgatcgtatacacgaccggtgctcgatttagatagatagacagggggtgctttctgagagtcatggacctcctgcacaagaacatgaaacactgtggttcttccncctcctggtgcagctccagatgggtcctgtcccaggtncagctacggctaagtggggcncgaggacttggttacgaaacgcccgtacgggacgtaccccttcggttaccccacgacgtccgtcggccggtcttaggtaactacgttccgggttcggggttaccccttagtaggttcggttaacttacgtacggtacgtgttagggacctcccggtaccgtaacggttccccggaagggggaaacggggctagggtaacggttgggaaccgtaggggactaagtaccaaacgttcgaacgttaacggngggaaaccgtacacccggtaaacgtaccctaaacccccggttctaaacgtgtaacgtacgtacgaccgttaacgaactaggttacccgngttaaggtcggttacctacccggtaaccaaaccggtaccctacccgaaacggtaaaccgggcctaaccggtccgttacccgtaccccgtccgggaccctacccgtcctaaaccgaacgtacgtcccgtaccgtacgggtacccggacgtacgaccggtacccgggccggtcggttacgccggtacgttccggtaaccggttaacgggaaccttttaccgtaccgttaccgtaacgggtcccgttacgaccgggttggaaccgggtcggggtcggtacggaccggttaagggacccggtataaccgtaggtcgngaac

SEQ ID NO: 212315 - DNA, 843 bp, Homo sapiens
  misc_feature: GYAE6OF02HBJ1C.51.5.A05.1.454.CMB.1.raw
  modified_base (838)..(838): a, c, t, g, unknown or other
  misc_feature (838)..(838): n is a, c, g, or t
tcagcgatcgtatacacgaccggtgctcgatttagatagatagacagggggtgctttctgagagtcatggacctcctgcacaagaacatggaaacacctgtggttcttcctcctcctggtggcagctccagatgggtcctgtcccaggtgcagctacggcagtggggcgcaggactgttcgaagccctggacgaccctgtccctcgagctgcgctgtatagtcgtcggtccttcaggttcggttactactggacgtcgtggactccggcctaacggttcccccgaagggggaacggggtccgtaggggacggttagggaaggtaacggggaccgtaaacgtaccgaaagtctaacgttaaggttgggaacgtaccgaaacccggtacgtaaccccgaaaccccgttcccctacgtacgttacggacggttaccggacggttacccaaccgtacggttacggtacgtaacggttacgggacccgttacggtaccccgtaaaacggtaccccgttaacccgaacccgtaaaaccgggggtcccccaacggtttacccgggttcccctttacccccccgttacggggtccccctaaaccccgtttcccccgttaaaccgaaaaccggcccgtaacccttaacccggttaccgggtcgggggtaaccacccgttaacggccccgggtcccgtacggggtccgttaccggaccggttacgggtccggtaaaaccgttacccggtttaccgtttacccgtagttacgcccgttaaccggttcgttacgggacgggtccgggtacgtaccggggtacaaccgggttcacccggttagtaccggcntaccg

SEQ ID NO: 212316 - DNA, 860 bp, Homo sapiens
  misc_feature: GYAE6OF02FHWWX.51.5.A05.1.454.CMB.1.raw
  modified_base (169)..(169): a, c, t, g, unknown or other
  misc_feature (169)..(169): n is a, c, g, or t
  modified_base (309)..(309): a, c, t, g, unknown or other
  misc_feature (309)..(309): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagcctcccagatgggtcctgtcccaggtgcagctacggcagtgggcncaggactgtgaacgcctggacgaccctgtccctcagctgcgctgtatatcgtgggtccttcgaggttcgttactacgtggagctggactccgcctacggtccccgaggggaacgggctggtaggtggagtagggcgtaanacgaactcaagtaggtggagaccaccgaacctaccaacccggtccctagtacgtcgtaacggtccggaagtcccaacgtacgttacggtacgacggttcggaaccgttaccggttaccccgaaaacccgttaaccccgtacccgaaacccggtaaccgggggttaccccgtaacgtttccccggggtttaccccttacccccccgggtttacggggaccccccttaaacccccgtttccccgttaaaccgaaaccgggttacccgtaccccggttacccgttacccggggttaccggggggaaacccccttaccggtaaccgggtcccccgggtaacccccggggttcggggacccgtttacccgggtaacccgggttcgggttaacccgtaaaccgggtttaaccccttaaaccccgttttcccgtaccgggttaaccgtacccgtaacccgggttccggtttaaccggggtaaccggggccggggttacccggttacgggaccgggtaaaccgggtccctaacccgggtaagttaccggagttaccgcg

SEQ ID NO: 212317 - DNA, 580 bp, Homo sapiens
  misc_feature: GYAE6OF02GS85A.51.5.A05.1.454.CMB.1.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
tcagcgatcgtatacacgaccggtgctcgatttagatagatagacagggggtgggctcaggaggcagagctctgggaatctcaccatggcctggacccctctcctgctccccctcctcactttctgcacagtctctgacggcctcctatgagctgacgcagcccaccctcagtgtcagtgtctccaggacaaacggcaagntcactgtacttgatatgcgttcgaccaaagaactctagttcgttttagacctatacaggacggacaggccacggtccctgtagttcgtnatctagtagagacaacaagaccgacctcggaactcccgtagacgagagtcgcgtgctcgaggtacgaggacagcgcctactgtactacgtacgtacgtcggaaccagacgtcggagagtaggaaggtcaacgtacctagtgttactacgatacgacacgactaggtagacggtcgggtacgggttcgtacgggacgggaaggaccgaaggtccgagtaccgttcgaggtcaccgacgaccgtaaggtccgtaccgtcccgtacggtacctacgttccgtaccgttccccg

SEQ ID NO: 212318 - DNA, 922 bp, Homo sapiens
  misc_feature: GYAE6OF02GJ34B.51.5.A05.1.454.CMB.1.raw
tcagcgatcgtatacacgaccggtgctcgatttagatagatagacagggggtgctttctgagagtcatggacctcctgcacaagaacatgaaacacctgtggttcttcctcctcctggtggcagcctcccagatgggtcctgtcccaggtgcagctacggcaggtgggcgcaggtactggttgaacgcccgtcggacgaccctcgtccctcagctgcgctagtatacgtcgtcggtaccttgtaggtacgttactaggtggagtcgtacggtacgtcccgtaccgtaccggtaccccggaagggggaacgggtcggtgggaacggttacgggaaggttacggggaactaacgtacgtaaacgtcgaaggttaacggtaggaaacgtaacccgaacccggtaaaccttaaacccccgtaccccgttcccctaacgtaacggttaaccggacggttaccgacgttaacccaacgttcgtaccggttacgacggttacggaccgttaccgtaaccgtaaaccgtaaccccgtacccgaaacccggtaaacccggggacccttacccgggttaccccggttccccccgttttaccccccggacggttcccccctaaaccccggttacccctaacgggaacccggtacccgtaacccgtaacccgggtttcgggaccggggaccctaaaccgccgggtcccccgggtaaccggtccgggtacccttccgggtacccgtttacggggtaaacctaaacccgggttacccgttttaccccggtaacgggttacccgtaacccgggtaccctttaacccggttacccggggttcgggaaacccgggggggccccgggttaaacgggtaaccggggaaaacccccgggtggtaacccggtaaaccgggttaaacttgggaccctcggtaac

SEQ ID NO: 212319 - DNA, 738 bp, Homo sapiens
  misc_feature: GYAE6OF02I9R6E.51.5.A05.1.454.CMB.1.raw
  modified_base (169)..(169): a, c, t, g, unknown or other
  misc_feature (169)..(169): n is a, c, g, or t
  modified_base (252)..(252): a, c, t, g, unknown or other
  misc_feature (252)..(252): n is a, c, g, or t
  modified_base (731)..(731): a, c, t, g, unknown or other
  misc_feature (731)..(731): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcaggtgggcncgagactgtgaacgccctggagaccctgtccctgagctgccgctgtatacgtcgtcggttcctgagttcgttactacgtggancgtgctcccgctacgtccccggagggtacgggcgtacggtagtaggacgtagggacaacttacgaactcgaagtacggtagaacgacccgtaacccgtacctaacccggtaacccctccctagaacgtcggacgtcgacgtaccctacgtcgtggtacgtacggtacgtaccttcggacccgaacgtaccccgtaccgaaccgtacgggccctaaccggttcccggttcccttacccccggacggtcccctaccccttccgaaccgtaaccgccgtacccgtccggttcgggtaccggggaccttaccggacggccccggttcggtacggtccgttccggaccgttacgggtaaccttacgggttaaccctttccgggtaacccgttacggtaccgtaccgttacccggttacgggaacgggtttcccggacgggtccggtaacccgggaccggacggttaaccggcgtacgtaccggnacggtcg

SEQ ID NO: 212320 - DNA, 745 bp, Homo sapiens
  misc_feature: GYAE6OF02JSGW7.51.5.A05.1.454.CMB.1.raw
  modified_base (156)..(156): a, c, t, g, unknown or other
  misc_feature (156)..(156): n is a, c, g, or t
  modified_base (166)..(166): a, c, t, g, unknown or other
  misc_feature (166)..(166): n is a, c, g, or t
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (484)..(484): a, c, t, g, unknown or other
  misc_feature (484)..(484): n is a, c, g, or t
  modified_base (521)..(521): a, c, t, g, unknown or other
  misc_feature (521)..(521): n is a, c, g, or t
  modified_base (700)..(700): a, c, t, g, unknown or other
  misc_feature (700)..(700): n is a, c, g, or t
  modified_base (736)..(736): a, c, t, g, unknown or other
  misc_feature (736)..(736): n is a, c, g, or t
tcagcgatcgtatacacgaccggtgctcgatttagatagatagacagggggtgctttctgagagtcatggacctcctgcacaagaacagtgaaacacctgtggttcttcctcctcgtggtggcagcctccagagtgggtcctcgtacccaggtcgnagtctacggngaggtcggggcgtacagggaccttgttacgaccgtcccgtcgggacgacccttggtacccctnaggccgtcggtaccgntaggttacgtacttccgggtccggttacctttaccgaaggttcggttttaaccacgtggacgtcgacgtacgtcccgccacggttcccggagggacggtnaggtagngggtagtaaccgggcctaagtccgaagttcgtaaacggttgacgggacgaaacccggtaccttaaacgaacccggaccccttccggaataaccgttggacgtacccgtaggacccttaacgagttaccggtntaccgggacggacgtttcccgaaccacgttaaccccncgaaccggacgttaacccgtccgtccggtttacccgtaccccggtcgtccccggtacccctacggtaacccttaaacggccaaccgttcccgtaacgtcgggaacctcgacggtccgaccgttggacgccgacgtcgagtccgacgtaccttcggactacggtccaagtcgtacccggnggtaacccgtggtcccgaaggtcggcctaacggtcncgatccggc

SEQ ID NO: 212321 - DNA, 765 bp, Homo sapiens
  misc_feature: GYAE6OF02H6N60.51.5.A05.1.454.CMB.1.raw
  modified_base (763)..(763): a, c, t, g, unknown or other
  misc_feature (763)..(763): n is a, c, g, or t
tcagcgatcgtatacacgaccggtgctcgatttagatagatagacagggggtgctttctgagagtcatggacctcctgcacaagaacatgaaacacctgtggttcttcctcctcctggtggcagcctccagatgggtcctgtctcaggtgcagcgtacggcgaggtcggggcgcgaggtacttggttagacgcccgtcggacgaccctcgtcctcgagcgtgcgctagtatcgttcggtcgggttccttacgtaggttcggttactacgtggtacggtcgtaggtactcccggaccgtacggtaccccgaagggggacgggtcgtagggtacgtacgggtaagacggggtaccgtaaactaccgaagttaccgaagttacgggtacggaacggtaacccgtaacccgtaactaacccgaaccccgttcctacgtacgtacgacgtaccggtacgtcctaactacgtacgtacgtacggtcgtaccgtttaccgaacccgtaacgtacccgtacccgaacccggaaccgggtcccgtaaccgttccccggtttccccgttccccggtaccgtcccgtaccccgttacccgacgtacgaccgtcccgtaccgtccgggtacgggaccgtacggaccgggtccgggccgttacgggtcgtccgtccggttcggtaaccgtaagttacccgtacccgttaccgtcctacgtccgttacggtcgtcggccgacgggtccgaggccgtacggccgtacgtacgttacgncg

SEQ ID NO: 212322 - DNA, 840 bp, Homo sapiens
  misc_feature: GYAE6OF02HK89O.51.5.A05.1.454.CMB.1.raw
  modified_base (165)..(165): a, c, t, g, unknown or other
  misc_feature (165)..(165): n is a, c, g, or t
tcagcgatcgtatacacgaccggtgctcgatttagatagatagacagggggtgctttctgagagtcatggacctcctgcacaagaacatgaaacacctgtgttctctcctcctggtgcagctcccagatgggtcctgtcccaggtgcagctacggcaggtgggcncgaggactgtagaacgtcccgtcggacgtaccctgtccctcgagctacgcgtcttagtactacgtcggttcgggttcccttcgtacggttacggtttacctacggtggtacgtccgtagggacctcccggaccgtacccggtccccggaaagggggaacgggtcgtaggggacggttagggacggttaacggggaaccgtaagtaccgtaacgtaccggtaaggtaacgggtacggaaccggtaacccgaaacccggtaacccgttaaccccgtaaccccggttccctacgtaagttaccgggaacggttccgtaacgtacccgaaccgttagtcggtaacgtacgggttaccggtaaccgttaccggtaaccctaaaccggtccccgtaacccggaaaccggtaaccgggtacccctaaccgggtttcccggtttacccccgttaccccggtcggtacccccttaacccggtcccgaaccgtaaacggtccctaccggtacccgtcggggtaccggaccaaccgtccgggcccgggtcccgtagggttccctcgggtacgtacgtaaccgtaaccgttccgttacccgtcgtaaccgtaggtccctacgtccgggttaacgggcggtccgggtacgtacgggaccgtaacggtccgacgtaacgtggctagtcg

SEQ ID NO: 212323 - DNA, 793 bp, Homo sapiens
  misc_feature: GYAE6OF02HIXB9.51.5.A05.1.454.CMB.1.raw
  modified_base (151)..(151): a, c, t, g, unknown or other
  misc_feature (151)..(151): n is a, c, g, or t
  modified_base (208)..(208): a, c, t, g, unknown or other
  misc_feature (208)..(208): n is a, c, g, or t
tcagcgatcgtatacacgaccggtgctcgatttagatagatagacagggggtgctttctgagagtcatggacctcctgcacaaagaacatgaaacacctgtggttcttcctcctcctggtggcagctcccagatgggtcctgtcccaggtncagctacggcaggtgggcgcaggactggttgaacgccctcggagaccctggtccctnagctgcgactgtactatcgtgggtccttcgagttcggttactactgggatgtcggactcccgccacggttccccggaaggggaacggggtctacgggtaagttgggaagtaacggggacgtaaaactcgaaacttaccaagtaacggtgggaaccgtaaccgaacccggtaacctaaacccaaccccggttacccctaccgtaatcggaaggtaccgaaggttaccaacctaagttcgtacaggtacggaacctccgggtaaccctaaacggtacccctacccgaaacccggaaccgggtaccccgtaacggttacccggttaccccgtttaccccccgtacgggtacccctaaccccgtcccttaacccgaagtaccggacctaacccggtccggtacgggggtaccaacgtaccggaccgggtacccggttcgggaccgttacggtacccggtaaggggttaaaaccgggtaacccgtttaaccggtttacccctaccgggttaactcccgtacgttccccgttaagggaacgggaccgggttcggacggaccggtaacgggccggtaactacgagtcgatgc

SEQ ID NO: 212324 - DNA, 497 bp, Homo sapiens
  misc_feature: GYAE6OF01DKPJT.21.27.C05.1.454.CMB.1.raw
  modified_base (186)..(186): a, c, t, g, unknown or other
  misc_feature (186)..(186): n is a, c, g, or t
  modified_base (203)..(203): a, c, t, g, unknown or other
  misc_feature (203)..(203): n is a, c, g, or t
  modified_base (366)..(366): a, c, t, g, unknown or other
  misc_feature (366)..(366): n is a, c, g, or t
  modified_base (385)..(385): a, c, t, g, unknown or other
  misc_feature (385)..(385): n is a, c, g, or t
  modified_base (480)..(480): a, c, t, g, unknown or other
  misc_feature (480)..(480): n is a, c, g, or t
  modified_base (483)..(484): a, c, t, g, unknown or other
  misc_feature (483)..(484): n is a, c, g, or t
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccacctgttttcngtgtctccaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttcnctcaccatcagcgccctanagagtgaagatgttgctagtttattctgccagcaatataattactggcctgcgtcgacgttcggccacgggaccaaggtggaaatcaaagactgnggnngcacatctgtctc

SEQ ID NO: 212325 - DNA, 734 bp, Homo sapiens
  misc_feature: GYAE6OF01B5G4L.21.27.C05.1.454.CMB.1.raw
  modified_base (198)..(198): a, c, t, g, unknown or other
  misc_feature (198)..(198): n is a, c, g, or t
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (307)..(307): a, c, t, g, unknown or other
  misc_feature (307)..(307): n is a, c, g, or t
tcagtcgtcgctcgcacgaccggtgctcgatttagacgcgatcgaagggtttggggaggaactgctcagttaggacccagacggagccatggaagcccagcgcagcttctcttctcctgcttctctggctcccagacaccactggagtgattgtgatgacgcagtctccagccacctgtctgtgtctccgagggggancgccacctctcctgcacagccagtcagtctancgntgactggtacnctggtaccagcaagtaatctggccaggtcctaccgaggtccttaccgtcgtacttttaccggngacctacgttcccgaaccgtaggggtcccctaacggttcggtaccgttaccccgaaggtaccgttaggtttccgaaggttcggggaccggtttaggtaacgttttacggggaacttacggttacgttttttccgacgttaccgtaaccgtaagttccgaacggtcccgtacccttaacgacgtacgtagaaacgttacgttcggttacgtacgttaacggttttactttccgtacgtacccgtaaggtaccttaaacgttaacgttaacgtttaccgttcgggtacccttagggtaccgttaccggtaaccggtttaccggacccgtaacgggtacccgtaaacgggttacgtaaacgttaccgaaacggttacgttcgggtacgtaccgttacgtaccgtacgtagttccgttgttaccgttaccg

SEQ ID NO: 212326 - DNA, 499 bp, Homo sapiens
  misc_feature: GYAE6OF01BTQNW.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
  modified_base (483)..(483): a, c, t, g, unknown or other
  misc_feature (483)..(483): n is a, c, g, or t
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgngcatcccaccagggccactggtcgtcccagacaggttcagtggcggtggatttgggactagtagttttcnctcaccatcagcgccctanagagtgaagntgttgctagtttattctgccagcaatataattactggcctgcgtcgacgttcggccacgggaccaggtggaaatcgaaagactgngctgcacatctgtctc

SEQ ID NO: 212327 - DNA, 491 bp, Homo sapiens
  misc_feature: GYAE6OF01BDLP2.21.27.C05.1.454.CMB.1.raw
  modified_base (203)..(203): a, c, t, g, unknown or other
  misc_feature (203)..(203): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
  modified_base (475)..(475): a, c, t, g, unknown or other
  misc_feature (475)..(475): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggctaggctcccaggcctcctcatttaccgtgcatcccaccagggccactggtgtcccagacaggttcagtggcggtggatttgggacagtagttttcnctcaccatcagcgccctanagagtgaagatgttgctagtttattctgccagcaatataattactggcctgcgtcgacgttcgcacggacaggtgaatcaagactgngctgcacatctgtctc

SEQ ID NO: 212328 - DNA, 490 bp, Homo sapiens
  misc_feature: GYAE6OF01D9VYG.21.27.C05.1.454.CMB.1.raw
  modified_base (199)..(199): a, c, t, g, unknown or other
  misc_feature (199)..(199): n is a, c, g, or t
  modified_base (362)..(362): a, c, t, g, unknown or other
  misc_feature (362)..(362): n is a, c, g, or t
  modified_base (474)..(474): a, c, t, g, unknown or other
  misc_feature (474)..(474): n is a, c, g, or t
tcagtcgtcgctcgcacgaccggtgctcgatttagacgcgatcgaagggtttgggaggaactgctcagttaggacccagacggagccatggaagccccagcgcagcttctcttcctcctgcttctctggctcccagacaccactggagtgattgtgatgacgcagtctccagccaccctgtctgtgtctccagggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttcnctcaccatcagcgccctacagagtgaagatgttgctagttttattctgccagcaatataattactggcctgcgtcgacgttcggccacgggaccaggtgaatcaaagactgngctgcacatctgtctc

SEQ ID NO: 212329 - DNA, 518 bp, Homo sapiens
  misc_feature: GYAE6OF01EPUQU.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtcgtctcaccatcaccccagacacgtccaagaatcaggtctccctccacctaatgtctgtcactcccgacgacacggtctagtttatttgtgctaagaggatcgactattcggtgactacctccttgactcctgggccaggggtaacg

SEQ ID NO: 212330 - DNA, 520 bp, Homo sapiens
  misc_feature: GYAE6OF01ANN2W.21.27.C05.1.454.CMB.1.raw
  modified_base (203)..(203): a, c, t, g, unknown or other
  misc_feature (203)..(203): n is a, c, g, or t
  modified_base (377)..(377): a, c, t, g, unknown or other
  misc_feature (377)..(377): n is a, c, g, or t
  modified_base (398)..(398): a, c, t, g, unknown or other
  misc_feature (398)..(398): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggcctcctcatttaccgtgcactcccaccagggcccacgtggtcgtcccagacaggttcagtgggcggtggagtttgggactaggtagttttcnctcaccatccagccgccctanagagtagaagatgttgctagtttattctgcctagactaatataattactggacctgcgtcgtacgttcgacgaacgggacaaggtagaaatcgaaagactgtcggctcgacacatctgtctc

SEQ ID NO: 212331 - DNA, 505 bp, Homo sapiens
  misc_feature: GYAE6OF01D2QX5.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (368)..(368): a, c, t, g, unknown or other
  misc_feature (368)..(368): n is a, c, g, or t
  modified_base (387)..(387): a, c, t, g, unknown or other
  misc_feature (387)..(387): n is a, c, g, or t
  modified_base (488)..(488): a, c, t, g, unknown or other
  misc_feature (488)..(488): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatccacagggccactggtcgtcccagacaggttcaggtggcggtggatttgggactagtagttttcnctcaccatcagcgccctanagagtgaagattgttgctagttttattctgccagctaatataattactggcctgcgtcgacgttcgccgacgggaccaaggtaggaaatcgaaacgactgngctcgcacatctgtctc

SEQ ID NO: 212332 - DNA, 510 bp, Homo sapiens
  misc_feature: GYAE6OF01DAC2O.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (367)..(367): a, c, t, g, unknown or other
  misc_feature (367)..(367): n is a, c, g, or t
  modified_base (437)..(437): a, c, t, g, unknown or other
  misc_feature (437)..(437): n is a, c, g, or t
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgncatcccaccagggccactggtgtcccagacaggttcagtggcgtggatttgggactaggtagttttcnctcacctatcagccgtccctagagagtgaaagtatgttgctagttttattctgccagcaatataattacnggcctgcgtcgacgttcggaccgacgggaccaaggtagaaatcaaaggactcgtggctgcactatctgtcttc

SEQ ID NO: 212333 - DNA, 503 bp, Homo sapiens
  misc_feature: GYAE6OF01ERW8O.21.27.C05.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (368)..(368): a, c, t, g, unknown or other
  misc_feature (368)..(368): n is a, c, g, or t
  modified_base (486)..(486): a, c, t, g, unknown or other
  misc_feature (486)..(486): n is a, c, g, or t
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatcccaccagggccactggtcgtcccagacaggttcagtggcggtggatttgggactagtagttttcncgtcacctatccagccgccctagagagtgaagatgttgctagtttattctgcctagactaatataattactgcctgcgtcgacgttcggccagggaccaaggtgaaatcaaagactgngctgcacatctgtctac

SEQ ID NO: 212334 - DNA, 510 bp, Homo sapiens
  misc_feature: GYAE6OF01DA70H.21.27.C05.1.454.CMB.1.raw
  modified_base (208)..(208): a, c, t, g, unknown or other
  misc_feature (208)..(208): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggcctcccaggttcctcatctatgctgggtcccacgagggccactggcatcccagacaggttcagtggcaggtgggtctgggacagacttcactctcatcattagcagactggagcctgaagtatttcgctagtgttattactgtcagcagtatggaattcaccttctgtcgtcggaccaagggaccgaaggtagaaagtagaaacgtatggtcgactgacncngtc

SEQ ID NO: 212335 - DNA, 630 bp, Homo sapiens
  misc_feature: GYAE6OF01D60N5.21.27.C05.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccgaggcctcctctattttaccgngcactcccacgacggccacgtcggtcgacccgagtacgtacggttcaggtcgggtcggtaggtagtttcgggaactaggtttacgttttcctacgtacctaacctagtccgacgtcccgtaccctaagagtagtagaaagtagttgttagtacgttagttttacttcgtcgtaccgtaagtactaaattaacttaacgttacgtcggtccgtggtaccgttacgtaccggttaccggacccggtaacgggtaaccgtaaggtaacggtaaacgtacgtaaaacggacgttcggtacgactacgtacctacgtatcgtcgtcgttc

SEQ ID NO: 212336 - DNA, 567 bp, Homo sapiens
  misc_feature: GYAE6OF01CBV5Y.21.27.C05.1.454.CMB.1.raw
  modified_base (389)..(389): a, c, t, g, unknown or other
  misc_feature (389)..(389): n is a, c, g, or t
  modified_base (499)..(499): a, c, t, g, unknown or other
  misc_feature (499)..(499): n is a, c, g, or t
  modified_base (524)..(524): a, c, t, g, unknown or other
  misc_feature (524)..(524): n is a, c, g, or t
tcagtcgtcgctcgcacgaccggtgctcgatttagacgcgatcgaagggtttgggggcagagcctgctgacttctggctgaccagggcagtctaccggagctccagacaatgtctgtctccttcctcatcttcctgcccgtgctgggcctcccattggggtgtcctgtcaccagatcaaactacgagcgagtctggtcccaggacctggtgacggccctcgacgacgaccctttcacctccaccgtcgtcgaccatctaccggggaaaatcggtcacgtggcaacaagtggttcggaattggattaggcagtccccgtcgagaggccttgagtggcttgggaaggacctagttatacgtcccagtcggtatgaagactatgcagattcngtgagcggtcgtctcaccagtccacccctagacacgtccaaagaactcacggtcctaccctccacctaatcgtctgtcacctcccgacgacgacggctagtttattttgngcaagagggatcgactagttcggtnacctaccttccgttgaccttccgtcgggcctaggggttaaccg

SEQ ID NO: 212337 - DNA, 537 bp, Homo sapiens
  misc_feature: GYAE6OF01DU64F.21.27.C05.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (376)..(376): a, c, t, g, unknown or other
  misc_feature (376)..(376): n is a, c, g, or t
  modified_base (397)..(397): a, c, t, g, unknown or other
  misc_feature (397)..(397): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggcctcctctatttaccgngcatcccaccagggcccacgtggtcgtcccagacctaggttcaggtggcggtggatttgggacagtagttttcnctcaccatcagccgaccctanagagtgaagattgttgctagttttattcgtgtccagctaaattataattactggcctgccgttcgacgttccggaccgacgggacctaagggtagaaagtccgaaaagtactggtacgctagaccacattcctgtcttac

SEQ ID NO: 212338 - DNA, 579 bp, Homo sapiens
  misc_feature: GYAE6OF01DKQWP.21.27.C05.1.454.CMB.1.raw
  modified_base (428)..(428): a, c, t, g, unknown or other
  misc_feature (428)..(428): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcagaccctttcactcacctgtgacatctaccggggaaatgtcgctggcaacaatggttgaattggattaggcagtccccgtgagaggccttggagtggtcttggaaggtacctagttactacgtcccagtggtaatgaagtactagtgacagtattcgtgtgagtcggtcgtctcacctactcacccagacacgtacaagatcgagtcctcccncctactaatgtctgtcaccgtcccgacgaccgtacgtactagttttacgttttgacgtacgtaaggtacggtactacgtactagttaccggtcgtaccttacccgttccgttacgaccgttccgtcggggtacccgtaggggttaacccgg

SEQ ID NO: 212339 - DNA, 527 bp, Homo sapiens
  misc_feature: GYAE6OF01CVOGT.21.27.C05.1.454.CMB.1.raw
  modified_base (464)..(464): a, c, t, g, unknown or other
  misc_feature (464)..(464): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtcgtctcaccatcacccagacacgtccaagaatcaggtcctccctccacctaatcgtctgtcacctcccgacgacacggctagtttattttgngtcaagaggatcactattcggtgtactacctccttagacctcctcggggccgagggttaaccg

SEQ ID NO: 212340 - DNA, 514 bp, Homo sapiens
  misc_feature: GYAE6OF01EB1N4.21.27.C05.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
  modified_base (394)..(394): a, c, t, g, unknown or other
  misc_feature (394)..(394): n is a, c, g, or t
  modified_base (443)..(443): a, c, t, g, unknown or other
  misc_feature (443)..(443): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgngcatcccaccagggcccactggtcgtcccagacaggttcaggtggcggtggtatttgggactaggtagttttctctcactatcagccgccctanagagtgaagtatgtgactagtttattctgccagtacaattataattacnggtcctgcgtcgtacgttcggaccgacgggaccaggtagaaatcgaaagactggcgctgcacatctgtctc

SEQ ID NO: 212341 - DNA, 700 bp, Homo sapiens
  misc_feature: GYAE6OF01DOFQP.21.27.C05.1.454.CMB.1.raw
  modified_base (318)..(318): a, c, t, g, unknown or other
  misc_feature (318)..(318): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggacccgccacctctcctgcacacgccagtcagtctatcgctgacttggttacgccgtggtaccagacaagtaaactcgtcggaccaggcctcccgacggtcctcctctacgtttaccgngacctactcccgaccgacgggccctacgtcggtcgtacccaagaccgtaggttcgaggtgggcggttaggtagtttcgggaactaggttacgttttcctactaccaacctagtccgacgtcccgtacccgtaacgaggtaacgtagtaaagtagttcggtttacgtacgtttaagtttttacgtttcgtacgaccgtaagtaacttaaatttaacgttaaacgtttaccgtcgggtaccgttacgggacccgtttacggtaccggttccggacccggtaaccggggtaaccgtaaaggggttaacggtaaaacgtaaccgtaaaaccggtaacgttcgggtacggctacggtacctaaccgtactttccgttcgttccttac

SEQ ID NO: 212342 - DNA, 711 bp, Homo sapiens
  misc_feature: GYAE6OF01D1SYS.21.27.C05.1.454.CMB.1.raw
  modified_base (219)..(219): a, c, t, g, unknown or other
  misc_feature (219)..(219): n is a, c, g, or t
  modified_base (270)..(270): a, c, t, g, unknown or other
  misc_feature (270)..(270): n is a, c, g, or t
  modified_base (319)..(319): a, c, t, g, unknown or other
  misc_feature (319)..(319): n is a, c, g, or t
  modified_base (331)..(331): a, c, t, g, unknown or other
  misc_feature (331)..(331): n is a, c, g, or t
  modified_base (383)..(383): a, c, t, g, unknown or other
  misc_feature (383)..(383): n is a, c, g, or t
  modified_base (413)..(413): a, c, t, g, unknown or other
  misc_feature (413)..(413): n is a, c, g, or t
tcagtcgtcgctcgcacgaccggtgctcgatttagacgcgatcgaagggtttgggggacggaactgctcacgttaggacccagacggacgccatggaagccccacgcgcaggcttctcttcctcctgccttcttctggctcccagacacccactggagtcgatttcgtgactgacgtcagtctccagccgaccctgtctgtagtctccgaggggggacncgccaccctctcctgccacgagccagtcagtcctatcgctgacgtgttacncctggtaccagcagaactccgtaggaccaggtcctccgaggcctccgtntacgtttaccgngacactccgacgagggcctactggtaactcccagacgtaggttcagggtcgnggtgtagtttcgggacaggttacttttccnctaccactagtctacgcctaccctagagtacgtagaagtattcggttacgcttaagttttacttccgtacgccgtaaggtacctaaagtttaactttaaacgttttaccggtcgggttacccgttacggttacccggttacgggttaaccgggttcccgggtaacccggtaacccggggttaaacgtaaacggggttacgtaaaacgttaacccggttaaaacggtacggtttcgggtaccgggtaccttaccgggtaccctaacccgtacgtttacccgttcggtttcccttaaccg

SEQ ID NO: 212343 - DNA, 796 bp, Homo sapiens
  misc_feature: GYAE6OF01DTUK2.21.27.C05.1.454.CMB.1.raw
  modified_base (203)..(203): a, c, t, g, unknown or other
  misc_feature (203)..(203): n is a, c, g, or t
  modified_base (253)..(253): a, c, t, g, unknown or other
  misc_feature (253)..(253): n is a, c, g, or t
  modified_base (316)..(316): a, c, t, g, unknown or other
  misc_feature (316)..(316): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgcccaccctctcctgcacagccagtcagtctatcgctgactggttacncctggtaccagcaagaatcgtggaccaggcctccccgaggtcctcctactaacttttacccgngacctactacccaaccggagggcccctacggttcggtccgtaccccgaaggtaccgtagggtttaccaagggttcgggcgggttaggtacgttttcggggaacctagggtttactttttccgaccgttaccaacccgtagttcccggaacggtccccggtacccccgttaagaacgggtaacgggttacggaaacggttaacggtttcgggtttaacggtacccgtttaaggttttttaacgttttcccgtacggtaccctaaggtaaccttaaagtttaaacgttaaaccgttttaccgtacggggtcccttaaccggtaccggtttaccggtaccgggtttaccgggaacccggtaaaccggggtaacccgtaaacggggttaaacgggaaaaccgttaacccggtaaaacggtaaccgttgggaccggtaccgttacggacccgtaacctacgtttaccttcggttaccgtttaccg

SEQ ID NO: 212344 - DNA, 496 bp, Homo sapiens
  misc_feature: GYAE6OF01C7V9G.21.27.C05.1.454.CMB.1.raw
  modified_base (202)..(202): a, c, t, g, unknown or other
  misc_feature (202)..(202): n is a, c, g, or t
  modified_base (322)..(322): a, c, t, g, unknown or other
  misc_feature (322)..(322): n is a, c, g, or t
  modified_base (369)..(369): a, c, t, g, unknown or other
  misc_feature (369)..(369): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
  modified_base (480)..(480): a, c, t, g, unknown or other
  misc_feature (480)..(480): n is a, c, g, or t
  modified_base (494)..(494): a, c, t, g, unknown or other
  misc_feature (494)..(494): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccacgtggtntcccagacaggttcaggtggcggtggatttgggactagtagttttcnctcaccatcagcnccctangagtgaagatgttgctagtttattcgtgccagcaattataattactggtcctgcgtcgacgttcgccacgggacaggtgaaatcaagactgngctgcacatctgtntc

SEQ ID NO: 212345 - DNA, 672 bp, Homo sapiens
  misc_feature: GYAE6OF01C3KQJ.21.27.C05.1.454.CMB.1.raw
  modified_base (242)..(242): a, c, t, g, unknown or other
  misc_feature (242)..(242): n is a, c, g, or t
  modified_base (433)..(433): a, c, t, g, unknown or other
  misc_feature (433)..(433): n is a, c, g, or t
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtacctccgaggggggacccgcccaccctctcctgccacacgccagtcagttctanccgctgacgttggttacgccgtacggtaccagacaagtaaactcgtcggaccacggccctcccgacggtccttccgtactacgtttaccggtcgacctactacccgaccgacgggaccctacgtcggtcgtacccgagacgtacggttcgaggtcgggtcggtggtagtttgggactaggttacgttttcncctaccacctagtccgacgtcccgtaccctacgagtacggtagaagtacgttggttacgtacgttaaggttttacttccgtacgtaccgtacgtactaaagttaacttaaacgttaccgtcggtaccgttcggtaccggttacgtaccggttccgggaccgtaaccgggtaaccgtagggtacgtaaacgtaccgaaacgtacgtcggtacgtactacgtaccactattcctgttctac

SEQ ID NO: 212346 - DNA, 565 bp, Homo sapiens
  misc_feature: GYAE6OF01CW72R.21.27.C05.1.454.CMB.1.raw
  modified_base (240)..(240): a, c, t, g, unknown or other
  misc_feature (240)..(240): n is a, c, g, or t
  modified_base (389)..(389): a, c, t, g, unknown or other
  misc_feature (389)..(389): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccagggggggaccgcccaccctctcctgcacagccagtcagtctatcgntgactggttacgcctggtaccagcaagaaatctggccacggcctcccgaggcctcctctactttaccgtgctactccaccgagggcccacgtggtcgtcccagactaggttcaggtgggcggtggtagtttgggactagtacgttttcnctcacatcacgccgcctacgagtagtagaagtatgttgactagtttattctgacctagtactaaattaattaacttacgtggtcctgtcgttcgtacggttccggaccgtaacgggaaccgaagggtacgaaacgtacgaaacgtaacgtggtacgctacgaccacatctgttctc

SEQ ID NO: 212347 - DNA, 508 bp, Homo sapiens
  misc_feature: GYAE6OF01DKBYM.21.27.C05.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (330)..(330): a, c, t, g, unknown or other
  misc_feature (330)..(330): n is a, c, g, or t
  modified_base (365)..(365): a, c, t, g, unknown or other
  misc_feature (365)..(365): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctntcctgcacagccagtcagtctatcgctgactggttagcctggtaccagcagaaatctggccaggctcccaggctcctcatttaccgtgcatccaccagggccactggtgtcccagacnggttcagtggcggtggatttgggacagagttttcnctcaccatcagcgccctacagagttaagatgttgctagttttatttctgcccagtcaattataattactggcctgcgtcgacgttcggcgaacgggaccaaggtgaaatacgaaacgatggtggctgcacatctgtcttctac

SEQ ID NO: 212348 - DNA, 574 bp, Homo sapiens
  misc_feature: GYAE6OF01DL22D.21.27.C05.1.454.CMB.1.raw
tcagtcgtcgctcgcacgaccggtgctcgatttagacgcgatcgaagggtttgggggaagaggaagactgacggtcctgccacaggtggtgctgggcacggtgggccctcgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtcgtctcaccatcaccccagacacgtccaagatcaggtcctcctccacctaatgtctgtcactcccgacgacacggcagtttattttgtgcaagaggatcacattcggtgactactccttgactcctgggccagggaaccgtttgtcacccgtctcctcagcctccacccaagggcccattccggtcttcccccgtggccgcccctgcctccaggacgccaccgtccgacgagccacacgccggcccctggggccctcggcccgtggtccgaaacgggaccttaccgttccccggaggtacccgg

SEQ ID NO: 212349 - DNA, 521 bp, Homo sapiens
  misc_feature: GYAE6OF01CQ6LT.21.27.C05.1.454.CMB.1.raw
  modified_base (387)..(387): a, c, t, g, unknown or other
  misc_feature (387)..(387): n is a, c, g, or t
  modified_base (457)..(457): a, c, t, g, unknown or other
  misc_feature (457)..(457): n is a, c, g, or t
  modified_base (480)..(480): a, c, t, g, unknown or other
  misc_feature (480)..(480): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtgacatcgtccggggaaaatgtcgctggcaacaatggttggaattggattaggcagtccccgtcgagaggccttgagtggcttggaagacctattatacgtcccagtggtatgaagactatgcagattctgtgagcggtcgtctcacatcacccngacacgtcaagatcagtctccctccactaatcgtctgtcacctcccgacgacacggctagttttatttgngcaagaggtatcgactattcggngactaccttcttcgacttccgtacgggccgtagggtaaccg

SEQ ID NO: 212350 - DNA, 610 bp, Homo sapiens
  misc_feature: GYAE6OF01EFFAK.21.27.C05.1.454.CMB.1.raw
  modified_base (383)..(383): a, c, t, g, unknown or other
  misc_feature (383)..(383): n is a, c, g, or t
  modified_base (512)..(512): a, c, t, g, unknown or other
  misc_feature (512)..(512): n is a, c, g, or t
tcagtcgtcgctcgcacgaccggtgctcgatttagacgcgatcgaagggtttggggggaagaggaagactgacggtcctgccacaggtggtgctgggcacggtgggccctcgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtcgtctcaccatcaccccagacacgtccaagaatcaggtctccctccacctaatgtctgtcactcccgacgacacggctagtttattttgtgcaagagggatcacattcggtnactacctccttgactccgtggggccagggtaacgtttgtccaccgtctcctcacgccctaccaccgaacgggcccctaagtccggtccctttcccccgtggcccgtcccctgcccgttcccgagggacncccgacccgtccgagacgccaccgacggccgggtcccctgggcccttcggcccgttgggtaccaaacgggtaccttacccgttccccggagtcccggg

SEQ ID NO: 212351 - DNA, 526 bp, Homo sapiens
  misc_feature: GYAE6OF01DQFL9.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (372)..(372): a, c, t, g, unknown or other
  misc_feature (372)..(372): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccaccctgtctgtgtctccgaggggggancgccaccctctcctgcacagccagtcagtctatcgctgactggttagcctggtaccagcaagaaatctggccaggctccaggctcctcatttaccgngccatcccacagggccacgtcggtgtcccaggaccaggttcaggtggcggtggatttgggatagtagttttcnctcaccatcagccgccctacagagtgaagtatgttgctagttttattctgaccagacaattataattacgtggcctgcgtacgtacgttcggacgtaacgggacaaggtaggaaatacgaaacgacgtggcggactagcacatcttgtcttacg

SEQ ID NO: 212352 - DNA, 583 bp, Homo sapiens
  misc_feature: GYAE6OF01C2RO4.21.27.C05.1.454.CMB.1.raw
  modified_base (203)..(203): a, c, t, g, unknown or other
  misc_feature (203)..(203): n is a, c, g, or t
  modified_base (298)..(298): a, c, t, g, unknown or other
  misc_feature (298)..(298): n is a, c, g, or t
  modified_base (377)..(377): a, c, t, g, unknown or other
  misc_feature (377)..(377): n is a, c, g, or t
  modified_base (396)..(396): a, c, t, g, unknown or other
  misc_feature (396)..(396): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaatctggccaggctccaggctcctcatttaccgngcactccaccacgggccacgtggtcgtcccagacctaggttccaggtcggcggtggtagtttgggactagtagttttcnctcacatcacgcgccctanagagtgaagattgtgtctagtttattctgacctagactaattattaattacgtcggtctaggtccgttcggtaaccgtttccgggacccgtaaaccgggtacccgaaagggttacggaaaacgttaccgaaaacggtacgttcggtacggtcctacggaccctaacctagttccttgttccttaccg

SEQ ID NO: 212353 - DNA, 506 bp, Homo sapiens
  misc_feature: GYAE6OF01DJDHZ.21.27.C05.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (384)..(384): a, c, t, g, unknown or other
  misc_feature (384)..(384): n is a, c, g, or t
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
  modified_base (435)..(435): a, c, t, g, unknown or other
  misc_feature (435)..(435): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtgtctccgaggggggancgccaccctntcctgcacagccagtcagtctatcgctgactggttagcctggtaccagcagaaatctggccaggctcccaggctcctcatctatggtgcatccagcagggccacgtggcatcccagacaggttcaggtggctaggtggggtctggggacagtacttcactctcacatcacngactggngctagaatntttgctagtgttattactgtcagctagtatggtanctccacctaccatgtactacgtttggaccgtagggaccaagggtagaaactacgaaacgaactggtgtacg

SEQ ID NO: 212354 - DNA, 594 bp, Homo sapiens
  misc_feature: GYAE6OF01BY1FN.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcagaccctttcactcacctgtgacatcgtaccggggaaaatgtacgctggcaacaatggttggaattggattaggcagtccccgtgagaggccttgagtggcttgggaagacctattatacgtcccagtggtatgaagactatgcagattctgtgaggcggtcgtctacaccactccaccccagaccacgtaccaagaactcacggtccctaccctacccgaacctaatcgtctcgtaccaccgtcccgacgaccgtacggtactacgttttattttacgtgtacgtaaggacgggtactaccgacgtacgttacgggtctacccgttacccttcctttacggacccttaccggtcggggtaccgaggggtttaacccgg

SEQ ID NO: 212355 - DNA, 519 bp, Homo sapiens
  misc_feature: GYAE6OF01AT395.21.27.C05.1.454.CMB.1.raw
  modified_base (202)..(202): a, c, t, g, unknown or other
  misc_feature (202)..(202): n is a, c, g, or t
  modified_base (372)..(372): a, c, t, g, unknown or other
  misc_feature (372)..(372): n is a, c, g, or t
  modified_base (514)..(514): a, c, t, g, unknown or other
  misc_feature (514)..(514): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggcctcctcatttaccgtgcatcccaccagggcccacgtggtgtcccagacaggttcagtggcggtggatttggggactagtagttttcnctcaccatcaccagactggacgccgtagaagtattttgctagtgtattactgtcagcagtatggtagctctacctccatgtactactttggccgtaggggacctaagggtcggaaatacgaaacgactgtcggctgacaccntctcg

SEQ ID NO: 212356 - DNA, 511 bp, Homo sapiens
  misc_feature: GYAE6OF01ADOWP.21.27.C05.1.454.CMB.1.raw
  modified_base (458)..(458): a, c, t, g, unknown or other
  misc_feature (458)..(458): n is a, c, g, or t
  modified_base (479)..(479): a, c, t, g, unknown or other
  misc_feature (479)..(479): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtcgagaggccttggagtggcttggaaggacctatatacgtcccagtggtatgaagactatgcagattctgtgagcgtcgtctcaccatcaccccagacacgtacaagaatcagtctccctccacctaatgtctgtcactcccgacgacacgctagtttatttgngcaagaggatcacattcggtnactacctcttcgactcctggggccagggtacg

SEQ ID NO: 212357 - DNA, 502 bp, Homo sapiens
  misc_feature: GYAE6OF01DMSDH.21.27.C05.1.454.CMB.1.raw
  modified_base (202)..(202): a, c, t, g, unknown or other
  misc_feature (202)..(202): n is a, c, g, or t
  modified_base (370)..(370): a, c, t, g, unknown or other
  misc_feature (370)..(370): n is a, c, g, or t
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
  modified_base (492)..(492): a, c, t, g, unknown or other
  misc_feature (492)..(492): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatcccaccagggccacgtggtcgtcccagacaggttcagtggcggtggatttgggactagtagttttcnctcacatcagccnccctanagagtgaagatgttgctagttttatttctgccagcaattataattctggcctgcgtcgacgttcgccacggacaaggtgaaactcgaaagactgtgctgcacntctgtcttac

SEQ ID NO: 212358 - DNA, 523 bp, Homo sapiens
  misc_feature: GYAE6OF01EDITN.21.27.C05.1.454.CMB.1.raw
  modified_base (358)..(358): a, c, t, g, unknown or other
  misc_feature (358)..(358): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtccggggaaaatgtcgctggcaacaatggttgaattggattaggcagtcccgtcgagaggcctgagtggcttggaggacctattatacgtccagtcggtatgaagactatgcagatntgtgagcggtcgtctcacatcaccccagacacgtcaagaatcagtctccctccacctaatctctgtcactacccacgacacggtctagtttattttgagcaaggtaggatcgtactagttacggtgacctacctccttgaccttccgtcgggccagggttaaccg

SEQ ID NO: 212359 - DNA, 568 bp, Homo sapiens
  misc_feature: GYAE6OF01DSDTZ.21.27.C05.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
  modified_base (387)..(387): a, c, t, g, unknown or other
  misc_feature (387)..(387): n is a, c, g, or t
  modified_base (407)..(407): a, c, t, g, unknown or other
  misc_feature (407)..(407): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctggtaccagcaagaatctggccaggcctcccgaggcctcctctacttttaccgngccactcccaccgagggcccacgtggtcgtcccagacctaggttcaggtggcggtggtagtttgggactagtcgttttcnctcacctatcagccgcctanagagtgaagtatgttgctagttttcttcgtcgcagtactaataagttaattacgtggtcctgcgttaccgtacggttcggacccgtacgggaccgtaaagggtacggtaaacgtaccgaaacgtacgtggtacggactcgtaccacctatctgttcttacc

SEQ ID NO: 212360 - DNA, 512 bp, Homo sapiens
  misc_feature: GYAE6OF01BTHWK.21.27.C05.1.454.CMB.1.raw
  modified_base (203)..(203): a, c, t, g, unknown or other
  misc_feature (203)..(203): n is a, c, g, or t
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgtgcatccaccagggcccacgtggtcgtcccagacaggttcaggtggcggtggagtttgggactaggtagttttctctcaccatcagccgccctanagagtgaagntgttgctagtttattctgccagctaatactaattactggcctgcgtcgacgttcggccgacgggacctaaggtggaaatcaaagactgtggctgacacatctgtcttc

SEQ ID NO: 212361 - DNA, 633 bp, Homo sapiens
  misc_feature: GYAE6OF01BRLJA.21.27.C05.1.454.CMB.1.raw
  modified_base (203)..(203): a, c, t, g, unknown or other
  misc_feature (203)..(203): n is a, c, g, or t
  modified_base (367)..(367): a, c, t, g, unknown or other
  misc_feature (367)..(367): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctgccaggctcccaggctcctcatttaccgtgcatccaccagggccactggtctcccagacaggttcaggtggcggtggatttgggacagtagttttcncctacactatacgacgcccgtacctacgagtacgtaagaagtcgttaggttacgtacgtttagttttactttcgtcgaccgtaacgtaacttaaacttaattaaactttacggtaccgtccgttacggtaccggttaccggttaccggttaccggacccgggtaaccgggtaacggtaagggtaaacggtaaaccgtaaacggtaaaccgtacgttagggtacgtacgtacgtacccgaacttacgttcgttcggttcttaacccg

SEQ ID NO: 212362 - DNA, 586 bp, Homo sapiens
  misc_feature: GYAE6OF01BLQK8.21.27.C05.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (378)..(378): a, c, t, g, unknown or other
  misc_feature (378)..(378): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggcctcccgaggcctcctcatttaccgngcactcccaccagggccacgtggtcgtcccagactaggttcagtgggcggtggagtttgggactagtacgttttcnctcaccatcagccgccctanagagtgaagntgttgactagtttactttctacgccagtactaattattaattactcggtcctggtcgttaccggtaccggttccggaccgtaccggggacctaaaggggtacggtaaaacgtaccgaaaacggaacgttgggtacggtaccgtacggacctacccgtaagttccgttgttccttaccg

SEQ ID NO: 212363 - DNA, 528 bp, Homo sapiens
  misc_feature: GYAE6OF01BKRCD.21.27.C05.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
  modified_base (377)..(377): a, c, t, g, unknown or other
  misc_feature (377)..(377): n is a, c, g, or t
  modified_base (395)..(395): a, c, t, g, unknown or other
  misc_feature (395)..(395): n is a, c, g, or t
  modified_base (406)..(406): a, c, t, g, unknown or other
  misc_feature (406)..(406): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccaggcctcctctatttaccgngcactcccaccgagggccacgtggtctcccagacaggttcaggtgggcggtggatttgggactagtagttttcnctcacatcagcgccctanagagtgaagtntgttgctagtttattctgccagactaatataattactggcctgcgtcgtacgttccggaccgacgggacctaagggtacgaaagtcgaaacgacgtggtcgctcgacactatctgtcttacg

SEQ ID NO: 212364 - DNA, 559 bp, Homo sapiens
  misc_feature: GYAE6OF01CY71L.21.27.C05.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (377)..(377): a, c, t, g, unknown or other
  misc_feature (377)..(377): n is a, c, g, or t
  modified_base (395)..(395): a, c, t, g, unknown or other
  misc_feature (395)..(395): n is a, c, g, or t
  modified_base (410)..(410): a, c, t, g, unknown or other
  misc_feature (410)..(410): n is a, c, g, or t
  modified_base (424)..(424): a, c, t, g, unknown or other
  misc_feature (424)..(424): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcaagaatctggccaggcctcccaggcctcctcatttaccgngcatcccaccgagggccacgtggtctacccagacctaggttcaggtggcggtggagtttgggactagtagttttcnctcacatcagcgccctanagagtgaagatgttnctagttttattcgngccagctaattataacttacgtcggccttgccgtcgtacgttcggacccgtaacgggaccgaaagggtaggaaaacgttccgaaaacggtaacgtggtacggacttacggacctaaccattccgtcgttcttacc

SEQ ID NO: 212365 - DNA, 589 bp, Homo sapiens
  misc_feature: GYAE6OF01CVIC9.21.27.C05.1.454.CMB.1.raw
  modified_base (202)..(202): a, c, t, g, unknown or other
  misc_feature (202)..(202): n is a, c, g, or t
  modified_base (373)..(373): a, c, t, g, unknown or other
  misc_feature (373)..(373): n is a, c, g, or t
  modified_base (392)..(392): a, c, t, g, unknown or other
  misc_feature (392)..(392): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctccccaggctcctcatttaccgtgcatccaccagggcccacgtggtcgtcccagaccaggttcaggtggcggtggagtttgggactagagttttcnctcaccatcagcgccctanagagtagaagtatgttaggttagtttatttctgccagtactaattaataatttactagggtcccttgtcgttccgacggtttccgggccgtaaccggggtacctaaagggtacggaaaagttacccgaaaaccggtaacttagggtacgggaccttaggaccctaacccgacttccgtacgttcccttaccgtaccg

SEQ ID NO: 212366 - DNA, 600 bp, Homo sapiens
  misc_feature: GYAE6OF01EY47N.21.27.C05.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggtagcctggtaccagcagaaatcgtggccaggctcccgaggcctcctctactttaccgngccactcccaccgagggccctacgttgggtcgtccccaggtaccgaggttcagggtcgggcgggttaggtagtttgggaactaggttacgttttcctctcaacctatccgacgccgtaccctacgagtagtagaagtagttgttgcttagtttatttcgtcgacctagtactaattaattaacttacgtcgtccgtagtccgtacgtacggttccggaccgtaccgggaaccgaagggtacgtaaacgtacgaaacgtacgttggtcggctacgaccacctatcttgtcttaccg

SEQ ID NO: 212367 - DNA, 533 bp, Homo sapiens
  misc_feature: GYAE6OF01A2Z86.21.27.C05.1.454.CMB.1.raw
  modified_base (329)..(329): a, c, t, g, unknown or other
  misc_feature (329)..(329): n is a, c, g, or t
  modified_base (462)..(462): a, c, t, g, unknown or other
  misc_feature (462)..(462): n is a, c, g, or t
tcagtcgtcgctcgcacgaccggtgctcgatttagacgcgatcgaagggtttgggggcgagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtgagaggccttgagtggcttggaaggcctattanacgtcccagtggatgaagactatgcagattctgtgagcggtcgtctcacctatccaccccagacacgtaccaagaactcaggtctccctccactatgtctgtcactcccgacgacacggctagtttattttgngtcaagtcgggatcgactattcggtagacctaccttccgttcgacttaccgtcggggccgtagggtaacgg

SEQ ID NO: 212368 - DNA, 582 bp, Homo sapiens
  misc_feature: GYAE6OF01C3A62.21.27.C05.1.454.CMB.1.raw
  modified_base (204)..(204): a, c, t, g, unknown or other
  misc_feature (204)..(204): n is a, c, g, or t
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (306)..(306): a, c, t, g, unknown or other
  misc_feature (306)..(306): n is a, c, g, or t
  modified_base (321)..(321): a, c, t, g, unknown or other
  misc_feature (321)..(321): n is a, c, g, or t
  modified_base (378)..(378): a, c, t, g, unknown or other
  misc_feature (378)..(378): n is a, c, g, or t
  modified_base (401)..(401): a, c, t, g, unknown or other
  misc_feature (401)..(401): n is a, c, g, or t
tcagtcgtcgctcgcacgaccggtgctcgatttagacgcgatcgaagggtttgggggagggaactgctcagttaggacccagacggagccatggaagccccagccgcagcttctcttcctcctgcttctctggctcccagacaccactggagtgattgtgatgacgcagtctccagccacctgtctgtgtctccgaggggggancgccaccctctcctgccacagccagtccagtctatcgctgactggtancctggtaccngcagaaatctggccaggcctcccaggcctcctacactttaccgngacactccacagtcnccactcggtctcccagcaggttcaggtcggcggtggattgggactagttagttttcnctacacctatccagccgacctanagagtgaagattgtgactagttttatctcgacctagtactaattataacgttacgtacgggccttggccgttacggtaccggttccgggacccgtaaaccggggaccgtaagggtacggaaacgttaccgaaaaccggtacgtggtaggacttcggaccctacctacgtccgttggttacc

SEQ ID NO: 212369 - DNA, 537 bp, Homo sapiens
  misc_feature: GYAE6OF01E0ELC.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (368)..(368): a, c, t, g, unknown or other
  misc_feature (368)..(368): n is a, c, g, or t
  modified_base (390)..(390): a, c, t, g, unknown or other
  misc_feature (390)..(390): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatccaccagggccactggtcgtcccagacaggttcagtggcggtggatttgggactagtagttttcncgtcacctatcagccgccctanagagtgaagatgttgactagtttatttctcgccagctaattataacttacgtggtccttgcgttcgtacggttcgggaccgaacggggaccaaagggtacggaaataccgaaaagaactggtacggctcgaccacatcttgtcttac

SEQ ID NO: 212370 - DNA, 499 bp, Homo sapiens
  misc_feature: GYAE6OF01A4TVJ.21.27.C05.1.454.CMB.1.raw
  modified_base (202)..(202): a, c, t, g, unknown or other
  misc_feature (202)..(202): n is a, c, g, or t
  modified_base (367)..(367): a, c, t, g, unknown or other
  misc_feature (367)..(367): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatcccaccagggccactggtgtcccagacaggttcagtggcggtgatttgggactagtagttttcnctcaccatcagcgcctacagagtgaagatgttgctagtttattctgccagctaatataattactggcctgcgtcgacgttcgcgaacggaccaaggtgaaactcgaaacgactgtcgctgcacatctgtctc

SEQ ID NO: 212371 - DNA, 540 bp, Homo sapiens
  misc_feature: GYAE6OF01C9TM3.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaatgtcgctggcaacaatggttggaattggattaggcagtccccgtgagaggccttgagtggcttggaaggacctattatacgtcccagtggtatgaagactatgcagattctgtgagcggtcgtctcaccatccacccagacacgtcaagaatcaggtcctccctaccacctaatcgtctcgtacactccccgacgacacggtctagtttattttgagtcaagagggtatcgactagttcggtcgaccttacctccgttgaccttccgtcggggccgtaggggttaaccg

SEQ ID NO: 212372 - DNA, 535 bp, Homo sapiens
  misc_feature: GYAE6OF01EBZME.21.27.C05.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (377)..(377): a, c, t, g, unknown or other
  misc_feature (377)..(377): n is a, c, g, or t
  modified_base (396)..(396): a, c, t, g, unknown or other
  misc_feature (396)..(396): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctctactttaccgngcatcccaccgagggcccacgtggtctcccagacaggttcaggtggcggtggagtttgggactaggtagttttcnctcacatcagccgccctanagagtagaagattgttgctagttttattctgccagctaatataattactggcctgccgtcgacgttcggaccgacgggaccgaaggtagaaacgtacgaaacgtacgtggtacggctacgaccaactatctgtcttacc

SEQ ID NO: 212373 - DNA, 564 bp, Homo sapiens
  misc_feature: GYAE6OF01DW6ZF.21.27.C05.1.454.CMB.1.raw
  modified_base (203)..(203): a, c, t, g, unknown or other
  misc_feature (203)..(203): n is a, c, g, or t
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
  modified_base (384)..(384): a, c, t, g, unknown or other
  misc_feature (384)..(384): n is a, c, g, or t
  modified_base (398)..(398): a, c, t, g, unknown or other
  misc_feature (398)..(398): n is a, c, g, or t
  modified_base (414)..(414): a, c, t, g, unknown or other
  misc_feature (414)..(414): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccacctctcctgcacagccagtcagtctatcgctgactggttancctggtaccagcagaaatcgtggccaggcctccaggtcctcctctactttaccgngccatcccaccgacgggcctacgtcggtcgtcccagaccgtaggttcaggtggcggtggagtttgggactagtgttttcnctcactatcagccncctacagagtgaagtntgttgcttagtttattcgtgaccagtactaattaattaacttacgtggacctggtccgttacggtacggttaccggacgaaaccggggtacgaaagggtaaggaaaacgtcgaaaagtacgtggtacggctacgctaccatctgtcttac

SEQ ID NO: 212374 - DNA, 571 bp, Homo sapiens
  misc_feature: GYAE6OF01CX5UI.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtgacatctaccggggaaaatgtcgctggcaacaatggttgaattggattaggcagtccccgtgagagccttgagtggcttggagacctattatacgtccagtgtatgaagactatgacagtattcgtgtaggagcggttcgtctacgaccactcaccccgtagaccacgtaccaagtaactcgaacggtcctaccctacccgaactaagtcgtctcgtacctacctacccggacgaacctacggtacttagtttaactttgtacgtctaagacgggtataccgactagttcggtcgtacctaccttcgttacgactccgtcgggtcgtagggttaaccg

SEQ ID NO: 212375 - DNA, 505 bp, Homo sapiens
  misc_feature: GYAE6OF01EE8GY.21.27.C05.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (376)..(376): a, c, t, g, unknown or other
  misc_feature (376)..(376): n is a, c, g, or t
  modified_base (396)..(396): a, c, t, g, unknown or other
  misc_feature (396)..(396): n is a, c, g, or t
  modified_base (406)..(406): a, c, t, g, unknown or other
  misc_feature (406)..(406): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctctatttaccgngcatcccaccagggccacgtggtcgtcccagacaggttcaggtggcggtggagtttgggactaggtacgttttcnctcaccatcagccgccctanagagtgaagntgtgctagtttattctgccagctaatataattactgctgcgtcgacgtcggcacgggacaaggtagaactcgaaagacgtgcgctcgcacatctgtctc

SEQ ID NO: 212376 - DNA, 551 bp, Homo sapiens
  misc_feature: GYAE6OF01DOMVJ.21.27.C05.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
  modified_base (379)..(379): a, c, t, g, unknown or other
  misc_feature (379)..(379): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaatctggccaggctcccaggcctcctcatttaccgngcactccaccagggcccacgtggtcgtcccagactaggttcaggtcgggcggtggtatttggggactaggtagttttcnctcacatcagccgccctagagagtgaagtattgttgactagttttacttcctgcctagtactaattattaattacgtggtcctgcgttcgtacggttccggaccgaccgggacgaagggtagaaacgtacgaaacgacgttggcggtctcgacctactattctgttcgttac

SEQ ID NO: 212377 - DNA, 502 bp, Homo sapiens
  misc_feature: GYAE6OF01EO2A3.21.27.C05.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
  modified_base (368)..(368): a, c, t, g, unknown or other
  misc_feature (368)..(368): n is a, c, g, or t
  modified_base (388)..(388): a, c, t, g, unknown or other
  misc_feature (388)..(388): n is a, c, g, or t
  modified_base (435)..(435): a, c, t, g, unknown or other
  misc_feature (435)..(435): n is a, c, g, or t
  modified_base (486)..(486): a, c, t, g, unknown or other
  misc_feature (486)..(486): n is a, c, g, or t
  modified_base (500)..(500): a, c, t, g, unknown or other
  misc_feature (500)..(500): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgngcatccacagggccactggtcgtcccagacaggttcagtggcggtggatttgggacaggtagttttcnctcaccatcagccgccctanagagtgaagatgttgctagttttattctgccagtcaatataattacnggtcctgcgtcgacgttcggcaacgggaccaaggtgaaatcgaaagactgngctgcacatctgtntc

SEQ ID NO: 212378 - DNA, 610 bp, Homo sapiens
  misc_feature: GYAE6OF01CF0OQ.21.27.C05.1.454.CMB.1.raw
  modified_base (202)..(202): a, c, t, g, unknown or other
  misc_feature (202)..(202): n is a, c, g, or t
  modified_base (306)..(306): a, c, t, g, unknown or other
  misc_feature (306)..(306): n is a, c, g, or t
  modified_base (390)..(390): a, c, t, g, unknown or other
  misc_feature (390)..(390): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggncgccaccctctcctgcacagccagtcagtctatcgctgactggttagcctggtaccagcaagaaatcgtggccaggcctcccgaggcctcctctactttaccgngccactcccaccgacgggccctacgtggtcgtcccagacaggttcaggtcgggcggtggtagtttgggactaggtacgttttcncgtccacctatcacgcccgtaccctacgagtagtagaagtagttggttgtacttagttttactttctacgtacctagactaaattacttaacgtttacgtcggtccttggtaccgttacggtaccggttccggaccgtaaaccgggtaccgtaaagggtaaggtaaacgtaacgtaaacgtaacgttggtacggactcgacacctattctgttcttaccg

SEQ ID NO: 212379 - DNA, 686 bp, Homo sapiens
  misc_feature: GYAE6OF01BR4DR.21.27.C05.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (273)..(273): a, c, t, g, unknown or other
  misc_feature (273)..(273): n is a, c, g, or t
  modified_base (426)..(426): a, c, t, g, unknown or other
  misc_feature (426)..(426): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggnccgccaccctctcctgcacagccagtcagtctatcgntgactggttagcctggtaccagcaagaaatcgnggccaggcctacccgaggtcctccgtactacgtttaccgtcgactactcccaaccgacgggtcccacgttcgggtaccgtacccgaggtaaccgtaggttccgagggtcgggtcgggttagggtacgtttggggaactaggttacgttttccncgttaccaacctatccgacgtcccgtaccctaagacgtaagtagaagtacgttgttagacgtttagttttattcgtcgccgtaagtactaaattaacttaacgttaccgtcggtcctacgggtaccgttacgggtaaccggttaccggaacccggtaaccggggtaaccgtaagggtaaacggaaaccgtaacgaaaacggttaaccgtgggtaaccggtacgtacggtaccctaaccgttattcctcgtttcccttacg

SEQ ID NO: 212380 - DNA, 504 bp, Homo sapiens
  misc_feature: GYAE6OF01BF8I8.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
  modified_base (488)..(488): a, c, t, g, unknown or other
  misc_feature (488)..(488): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatccaccagggccactggtcgtcccagacaggttcaggtggcggtggatttgggactagtagttttcnctcaccatcagcgccctanagagtgaagatgttgctagtttattctgccagtcaatattaattactggcctgcgttcgacgttcggcgacgggaccaagggtgaaatcgaaagactggngctgcacatctgtctc

SEQ ID NO: 212381 - DNA, 524 bp, Homo sapiens
  misc_feature: GYAE6OF01BE2O0.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccaggcaccctgtctttgtctccaggggaaanagccaccctctcctgcagctccagccagaatatccagagctactacatagcctggtaccagcagaagcctggccaggctcccaggttcctcatctatgctcgggtcccacgacgggccacgtcggccactccccaagaccagggttcagtggcaggtgggtctggggacagacttcactctcatcattagcagacgtggacgcctagaagtatttcgactagttgtattactgtcagctagtatggaattcaccttcgtgttccgttcggaccgtaagggacctaaggtaagaagtagaaacgaacgtgacggatgcacgta

SEQ ID NO: 212382 - DNA, 526 bp, Homo sapiens
  misc_feature: GYAE6OF01AHMZT.21.27.C05.1.454.CMB.1.raw
  modified_base (520)..(520): a, c, t, g, unknown or other
  misc_feature (520)..(520): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggacagagccaccctctcctgcggggccagtcaaattgttacccgcgactacttagcctggtaccagcagaacctggccaggctcccagactcctcatccacaatatattctacagggccgcgggcatcccagacaggttcagtggcaggtgggtctgggacagacttcactctcaccatcagcagactgggacgccgtagaagtatttagactaatgttattactgtacagacaatatcgtacctcccgacccccgtatccctaccgttccggaccgaacgggacacgacgtgacagatagaacgacgtgaggtctcgacacntcgtcg

SEQ ID NO: 212383 - DNA, 532 bp, Homo sapiens
  misc_feature: GYAE6OF01EXHD2.21.27.C05.1.454.CMB.1.raw
  modified_base (203)..(203): a, c, t, g, unknown or other
  misc_feature (203)..(203): n is a, c, g, or t
  modified_base (373)..(373): a, c, t, g, unknown or other
  misc_feature (373)..(373): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccagactcctcatccacaatatattctacgagggccgcgggcactcccgagacaggttcaggtggcaggtgggtctgggacagacttcactcncacatcagcagactggacgccgtagaagtatttgactaattgtatttactgtacagtactaatatcgtcctacccacccccgtactacctaccgttccggaccgaacgggaccgaccgtacgtcgacagagacgaaacgaactaggtcggtcgtgaccg

SEQ ID NO: 212384 - DNA, 698 bp, Homo sapiens
  misc_feature: GYAE6OF01ELGMZ.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (305)..(305): a, c, t, g, unknown or other
  misc_feature (305)..(305): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcaagaatcgtggccaggcctcccgaggcctcctctatttaccgngcactcccaccgagggcccacgtcggtcgtccccagacctaggttcaggtcgggcggtggtagtttggggactaggttacgtttttcctccgtactaaccctatccgaacggcccgtacccctaagaggaacggttagaaagtagttcggttacgtacgtttaaggtttttacttttccgtacgtaccctaagtacctaaattaacttaaacgtttaccgtcggtacccgttaggtcccgttaccggtaaccgggtttccgggaaccgtaaacccgggggtaacctaaaggggtaacggtaaaacgttacccgtaaaaacgggtaaccgtttgggtaccgggtacccttacgggtacccctaacccgttaagttccgttagttcccttacccg

SEQ ID NO: 212385 - DNA, 675 bp, Homo sapiens
  misc_feature: GYAE6OF01DDOH4.21.27.C05.1.454.CMB.1.raw
  modified_base (201)..(201): a, c, t, g, unknown or other
  misc_feature (201)..(201): n is a, c, g, or t
  modified_base (303)..(303): a, c, t, g, unknown or other
  misc_feature (303)..(303): n is a, c, g, or t
  modified_base (395)..(395): a, c, t, g, unknown or other
  misc_feature (395)..(395): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggancgccaccctctcctgcacagccagtcagtctatcgctgactggttagcctggtaccagcagaaatctggccaggcctcccaggccttcctctactttaccgngccactccaccgagggcccacgtcggtcgtcccagtaaccgtaggttccaggtgggcgggttggtagttttggggactacggtagtttttcnccgttaccgacctattcgaacgtccgacccgttaacaggagtagaaacgtagttggttcgacttagtttttacttccgtagtacccgtaagaccttaaagttaacttaaacgtttaccgtacggtaccgtaggtacccggttacggtacccggtttacccgggacccgtaaaccggggtaaacccgtaaaggggttacggtaaaaccgttaaccgaaaacggtaacggttcggaccggtacttacggacctaaccctagtttccgtgtttcccttaaccg

SEQ ID NO: 212386 - DNA, 579 bp, Homo sapiens
  misc_feature: GYAE6OF01D1C0Y.21.27.C05.1.454.CMB.1.raw
  modified_base (326)..(326): a, c, t, g, unknown or other
  misc_feature (326)..(326): n is a, c, g, or t
  modified_base (481)..(481): a, c, t, g, unknown or other
  misc_feature (481)..(481): n is a, c, g, or t
tcagtcgtcgctcgcacgaccggtgctcgatttagacgcgatcgaagggtttggggggaagaggaagactgacggtcctgccacaggtggtgctgggcacggtgggccctcgcagaccctttcactcacctgtgacatctccggggaaaatgtcgctggcaacaatggttggaattggattaggcagtcccccgtcgagaggccttgagtggcttggaaggacctattatacgtcccagtggtatgaagactatgcagattctgtgagcggtcgtctcaccatcaccccagacacgtccaagaatcaggtctccctccacctaatntctgtcactcccgacgacacggctagtttattttgtgcaaggagggatacactattcggtgacctacctccttgactccgtcgggccagggtaacgtttgtctacccgtctcctcacgccctccaccacgggcccatccgtccttcccctggccnccctgcctccgacggcgccacccgtccgagacgccacgacgccggcccgtgggcctcgcccgtcgggtacaacggacctaccgttcccgagtacccgg

SEQ ID NO: 212387 - DNA, 608 bp, Homo sapiens
  misc_feature: GYAE6OF01D9K5U.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (377)..(377): a, c, t, g, unknown or other
  misc_feature (377)..(377): n is a, c, g, or t
  modified_base (397)..(397): a, c, t, g, unknown or other
  misc_feature (397)..(397): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaaatctggccaggcctcccgaggctcctctatttaccgtgcatcccaccagggccacgtggtcgtcccagacaggttcaggtggcggtggagtttgggactaggtagttttcnctcactatcagccgccctanagagtagaagtagttgttgcgttagtttactttcgtgacctagtactaattaataacttacgtcggtccctaggtccgttacggtaccggttccgggacccgtaaccggggaaccgtaaaggggtaacggtaaaacgtaaccgtaaaacggtaacgttcggtacgggtacctacgggtacctaacccgtattcccgttggttcccttaccg

SEQ ID NO: 212388 - DNA, 639 bp, Homo sapiens
  misc_feature: GYAE6OF01CBIOR.21.27.C05.1.454.CMB.1.raw
  modified_base (205)..(205): a, c, t, g, unknown or other
  misc_feature (205)..(205): n is a, c, g, or t
  modified_base (393)..(393): a, c, t, g, unknown or other
  misc_feature (393)..(393): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtcgtccgaggggggacncgccaccctctcctgcacagccagtcagtctatcgctgactggttagcctggtaccagcaagaatctggccaggcctcccgaggcctcctctacgtttacccgtgcactcccaccgagggccacgtggtctacccgagacctaggttcaggtgggcggttggtagtttgggactaggtacgtttttcncgtacacctatcgacgccgaccctacgagtacgtagaagtatgttgacttagttttacttctgtcctagtactaaattattaactttacgtcggtaccgttacggtccggttacggtaccgtttaccgggacccgtaaccggggaaccgtaaagggtacggtaaaacgtaccgtaaaaaccgggtaacgttcgggtacgggtaacctacggtaccctaacgtacttccttcggtttcctttacccg

SEQ ID NO: 212389 - DNA, 648 bp, Homo sapiens
  misc_feature: GYAE6OF01AX9KT.21.27.C05.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagacgcgatcgaagggtttgggggcgagagcctgctgacttctggctgaccagggcagtcaccggagctccagacaatgtctgtctccttcctcatcttcctgcccgtgctgggcctccatggggtgtcctgtcacagatcaaactacagcagtctggtccaggactgggtgaggtcctcgcagaccctttnactcacctgtgacatcgtaccggggaaaatgtcgctggcaacaatggttgattggattaggcagtcccccgtgagaggccttggagtggcttaggaaggaccttattagtaccgtcccaggtggtatgaaagactatgcagattctagtgagcggttcgcttacacataccaccccagaccacgtaccaagtaactcgaacggttcctacccgttcccaaccgttaatcggttcttacggtaccaccgtaccccggacgaaccgtacccggcttaacggtttttactttttcggagtaacctaagggacggggttaatccccgtaagttaccggttacggttaccgtaacccttacccttacccggtttaccggtaaccttcccccgggttagggggtccccgaaggggggttttaaaccccg

SEQ ID NO: 212390 - DNA, 659 bp, Homo sapiens
  misc_feature: GYAE6OF01AF1A1.21.27.C05.1.454.CMB.1.raw
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatcgtggccaggcctcccgaggcctcctctactttaccgngccactcccaccgacgggcccacgtcggtcgtcccagacgtaggttcgaggtcgggcggtaggtagtttggggactaggttacgttttctctaccacctataccgacgaccgtaccctaagaggtagtagaagtagttgttcgtactttagttttacttcgtcgtaccgtagtactaaattaattaacgttacgtcggtaccgttcggtccgttaccggttaccggttaccgggacccggtaaccggggtaacccgttaaaggggtaacggtaaaacgtaaccggtaaaacgggtacgttacgggtacggtaccgtacggtaacccaccgttagttccgttccgttcttacccg

SEQ ID NO: 212391 - DNA, 518 bp, Homo sapiens
  misc_feature: GYAE6OF01EFX5L.21.27.C05.1.454.CMB.1.raw
  modified_base (202)..(202): a, c, t, g, unknown or other
  misc_feature (202)..(202): n is a, c, g, or t
  modified_base (370)..(370): a, c, t, g, unknown or other
  misc_feature (370)..(370): n is a, c, g, or t
  modified_base (389)..(389): a, c, t, g, unknown or other
  misc_feature (389)..(389): n is a, c, g, or t
tcagtcgtcgctcgcacgaccggtgctcgatttagacgcgatcgaagggtttgggggaggaactgctcagttaggacccagacggagtcatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatcccaccagggccacgtggtcgtcccagacaggttcaggtggcggtggatttgggacagtagttttcnctcacatcagccgccctanagagtagaagtatgttgactagtttatttctgaccagtactaattataattacgtggtcctgtcgtcgtacgtcggacgaacggacaaggtagaacgtcaaacgactggcgctcgcacatctgtcttac

SEQ ID NO: 212392 - DNA, 543 bp, Homo sapiens
  misc_feature: GYAE6OF01ATFXC.21.27.C05.1.454.CMB.1.raw
  modified_base (300)..(300): a, c, t, g, unknown or other
  misc_feature (300)..(300): n is a, c, g, or t
  modified_base (477)..(477): a, c, t, g, unknown or other
  misc_feature (477)..(477): n is a, c, g, or t
  modified_base (503)..(503): a, c, t, g, unknown or other
  misc_feature (503)..(503): n is a, c, g, or t
  modified_base (527)..(527): a, c, t, g, unknown or other
  misc_feature (527)..(527): n is a, c, g, or t
tcagtcgtcgctcgcacgaccggtgctcgatttagacgcgatcgaagggtttgggggcgagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaaatgtcgctggcaacaatggttgaattggattaggcagtccccgtgagnggccttgagtggcttggaagacctattatacgtcccagtggtatggaagactatgcagattcgtgtgagccggttctctcaccatccaccccagacacgtccaagatcaggtcctccctccactatgtctgtcacctcccgacacgacggtctagttttattttgcgcgtaaacggngggtaactccgactagttccgggtanacctaccctcgttcgacccttcgnggggcctaggggtaac

SEQ ID NO: 212393 - DNA, 525 bp, Homo sapiens
  misc_feature: GYAE6OF01BWQ0E.21.27.C05.1.454.CMB.1.raw
  modified_base (202)..(202): a, c, t, g, unknown or other
  misc_feature (202)..(202): n is a, c, g, or t
  modified_base (298)..(298): a, c, t, g, unknown or other
  misc_feature (298)..(298): n is a, c, g, or t
  modified_base (369)..(369): a, c, t, g, unknown or other
  misc_feature (369)..(369): n is a, c, g, or t
  modified_base (383)..(383): a, c, t, g, unknown or other
  misc_feature (383)..(383): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggtagcctggtaccagcagaaatctggccaggctcccaggctcctcatttaccgngcatcccaccagggccacgtggtcgtcccagacaggttcaggtggcggtgagtttgggacagtagttttcnctcaccatcagccnccctacagagtgaagatgttgctagttttattctgccagactaatataattactggtcctgcgtacgtacgttcggacgaaccggggaccaaagggtagaaactcgaaacgtacgtgtacggctgaccactatctgtcttac

SEQ ID NO: 212394 - DNA, 542 bp, Homo sapiens
  misc_feature: GYAE6OF01EXBM2.21.27.C05.1.454.CMB.1.raw
  modified_base (203)..(203): a, c, t, g, unknown or other
  misc_feature (203)..(203): n is a, c, g, or t
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
  modified_base (409)..(409): a, c, t, g, unknown or other
  misc_feature (409)..(409): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtancctggtaccagcagaaatctggccaggctcccaggcctcctctatttaccgngcatcccaccagggcccacgtggtcgtcccagacaggttcaggtggcggtggatttgggactaggtagttttctctcacccatcagccgaccctacgagagtgaaagnttggttgacttagttttattcgtcgccagtacaattaataattaccgtggtcctggtccgtcgtaccgttccggccgacgggacctaagggtaggaaactcgaaacgactggtaggctagcactatctgtctc

SEQ ID NO: 212395 - DNA, 636 bp, Homo sapiens
  misc_feature: GYAE6OF01CN80D.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggcctcccaggcctcctctactttaccgtgccactccaccgacgggcccacgtcggtcgtccccagacctaggttcgaggtgggcggtggtagtttggggaactaggttacgttttctctcacctagttccacgtccgtaccctaacgacgaacgtagaaagtagttggttagtcttaagtttttatttccgtgtaccctaagtactaaattaattaaacttacgtcggtacctggtaccgttcggtaccggttccgggacccgaaccgggtaccgaaacgggttacggaaactaccgaaaacggtaacgttcggtacggtacctacggtaaccctactagttccgttgttccgtttacccg

SEQ ID NO: 212396 - DNA, 519 bp, Homo sapiens
  misc_feature: GYAE6OF01ELZH0.21.27.C05.1.454.CMB.1.raw
  modified_base (353)..(353): a, c, t, g, unknown or other
  misc_feature (353)..(353): n is a, c, g, or t
  modified_base (468)..(468): a, c, t, g, unknown or other
  misc_feature (468)..(468): n is a, c, g, or t
  modified_base (485)..(485): a, c, t, g, unknown or other
  misc_feature (485)..(485): n is a, c, g, or t
  modified_base (503)..(503): a, c, t, g, unknown or other
  misc_feature (503)..(503): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtcgagaggccttgagtggcttggaagacctattatacgtcccagtggtatgaagactangcagtattctgtgagcggtcgtctcaccatccacccagacacgtcaagatcacgtctccctcactaatcgtctgtcactcccgacgacacggtctagtttatttgtgtacaaggnggatcactagttcggtnacttctccttgactccgngggtccagggtaaccg

SEQ ID NO: 212397 - DNA, 841 bp, Homo sapiens
  misc_feature: GYAE6OF01CTMUW.21.27.C05.1.454.CMB.1.raw
  modified_base (202)..(202): a, c, t, g, unknown or other
  misc_feature (202)..(202): n is a, c, g, or t
  modified_base (421)..(421): a, c, t, g, unknown or other
  misc_feature (421)..(421): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatcgtggccaggcctcccgaggcctcctcactttaccgtgacctactcccgaaccgacgggccctacgtcggtcgtaccccaggacctaggtttccaagggttcgggccggttagggtagttttacgggggaacctagggttacggtttttttccnccgttacctaacccgtaacttcccgtaacccgtaacggtaccggttacggggaacgtacccgttaggtaaacggtttaacgttttttacgggaccgttaagggtttaacggtttaacgttttaaccgttacggttaccgtaacggtaccgttaagggtttaacggtttacggggttaccggtacccgttaccccgttaaccccgttacccgttaacgtttaccggtttaacccgttttaaccgggttttttaccggggaaccccgggttaaaccggggggtaaaccccggtaaaagggggtttaaaccggggtaaaaacgtttaaacccggtaaaaacccgggttaaaccggtttaacgggtaccgggttaaccgttaccggtaccccgtaaacccgttaccgtttccggtttaacccgg

SEQ ID NO: 212398 - DNA, 496 bp, Homo sapiens
  misc_feature: GYAE6OF01D2U7B.21.27.C05.1.454.CMB.1.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
  modified_base (368)..(368): a, c, t, g, unknown or other
  misc_feature (368)..(368): n is a, c, g, or t
  modified_base (387)..(387): a, c, t, g, unknown or other
  misc_feature (387)..(387): n is a, c, g, or t
  modified_base (477)..(477): a, c, t, g, unknown or other
  misc_feature (477)..(477): n is a, c, g, or t
  modified_base (480)..(480): a, c, t, g, unknown or other
  misc_feature (480)..(480): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctnatttaccgngcatccaccagggccactggtgtcccagacaggttcaggtggcggtggatttgggactagtagttttcnctcaccatcagcgccctanagagtgaagatgtgctagtttattctgccagcaatataattactggcctgcgtcgacgttcgcaacgggacaggtgaatcgaaagactgnggntcgcaccatctgtctc

SEQ ID NO: 212399 - DNA, 538 bp, Homo sapiens
  misc_feature: GYAE6OF01A787S.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtcgtctcaccatccaccccagacacgtccaagaatcaggtctccctcccacctaatcgtctcgtcacctcccgacgacctacggctagtttattttgtcgcaagaggatcactattcggtctacctacctccttacgaccttccgtcggggtccgagggttaaccgg

SEQ ID NO: 212400 - DNA, 553 bp, Homo sapiens
  misc_feature: GYAE6OF01D1ZM0.21.27.C05.1.454.CMB.1.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctccccaggctcctcatttaccgngcatcccaccagggccactggtcgtcccagacaggttcaggtggcggtggatttggggactagtagttttctcgtacacctatcacgcgccctacagagtgaagatgttgtctagtttatttctgccagactaattattaattactggtcctgtcgttacgtacggttcggacgaaaccgggaccgtaaagggtaggaaagtaccgaaacggtaacgtggtacggctacgcaacctattccgtgttcttaccg

SEQ ID NO: 212401 - DNA, 552 bp, Homo sapiens
  misc_feature: GYAE6OF01DMSQ7.21.27.C05.1.454.CMB.1.raw
  modified_base (202)..(202): a, c, t, g, unknown or other
  misc_feature (202)..(202): n is a, c, g, or t
  modified_base (303)..(303): a, c, t, g, unknown or other
  misc_feature (303)..(303): n is a, c, g, or t
  modified_base (381)..(381): a, c, t, g, unknown or other
  misc_feature (381)..(381): n is a, c, g, or t
  modified_base (442)..(442): a, c, t, g, unknown or other
  misc_feature (442)..(442): n is a, c, g, or t
  modified_base (541)..(541): a, c, t, g, unknown or other
  misc_feature (541)..(541): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggncgccaccctctcctgcacagccagtcagtctatcgctgactggttagcctggtaccagcaagaaatctggccaggcctccccgaggctcttcatttaccgngccatcccaccgagggcctacgtggtcgtcccagactggttcaggtgggcggtggtagtttgggactaggtgttttcncgtcaccatcagccgccctagagagtagaagtatgttgcttagttttcttcgtgaccgtanactaattaataacttcgtcggtcctggccgttcgtacgtccggaccgaacgggaccaaggtaggaaactacgaaacgtacgtggcggtctacgcaactntctgtcttacg

SEQ ID NO: 212402 - DNA, 672 bp, Homo sapiens
  misc_feature: GYAE6OF01CCO8Z.21.27.C05.1.454.CMB.1.raw
  modified_base (202)..(202): a, c, t, g, unknown or other
  misc_feature (202)..(202): n is a, c, g, or t
  modified_base (302)..(302): a, c, t, g, unknown or other
  misc_feature (302)..(302): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctctcctgcacagccagtcagtctatcgctgactggttagcctggtaccagcagaaatctggccaggcctcccaggcctcctctatttaccgngccactcccaccgagggcccacgttcggtcgtaccccaggaccgtaggttccaaggtcgggcggtggtagtttcggggactaggttacgtttttctccgtcaaccgtattccgacgcccgtaccctaacgaaggtaaggttaggaaagtagtttggtttagtactttaagtttttactttcgtacgtacctaagtacttaaagttaattaacgtttacgtcggtccttagggtaccgttaccggtaccgggttaccggacccggtaaccggggtaaccgtaacggggtaacggtaaacgtaaccgtaaaacggtaacggttcggtacggtaccgtacgtacctaacctagttccgttcgttcccttaccg

SEQ ID NO: 212403 - DNA, 552 bp, Homo sapiens
  misc_feature: GYAE6OF01E0S74.21.27.C05.1.454.CMB.1.raw
  modified_base (467)..(467): a, c, t, g, unknown or other
  misc_feature (467)..(467): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaaatgtcgctggcaacaatggttggaattggattaggcagtccccgtgagaggccttgagtggcttggagactattatacgtccagtggtatgaagactatgcagattctgtgagcggtcgtctcaccactcacccagacacgtaccaagaatcacggtcctccctaccacctaatcgtctgtccactcccgacgaccacggtctagttttatttcgngacgtaaggaggtactacgtactagttcggtctaccgtacccttccgttacgaccttccggtcggggccgtaggggttaacccgg

SEQ ID NO: 212404 - DNA, 715 bp, Homo sapiens
  misc_feature: GYAE6OF01D931H.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttacgcctggtaccagcaagaaatctggccaggcctcccgaggcctcctctactttaccgtgccactcccgaccgacgggcccctacgtcggtcgtccccgaaggaccgtaggttccgagggtcgggacgggtgggtagtttggggaactaggttacgttttctctcaccctatccgacgtccgtacccctaagacggtaaggtagaaacggtagttggttacgtacgtttaagtttttactttaccgttcggtaccctaacggtaacttaaagttaactttaaacgtttaccgttccgggtcccgtttacgggtaccggtttaccgggtaccggtttacccgggaccccgggtaaccggggtaaacccggtaaaggggtaaacgggtaaacgtaccggtaaaacggtacggttagggtaccggtcgtacggacccgtaacctacgttaccgttcgttcccgtttaccg

SEQ ID NO: 212405 - DNA, 649 bp, Homo sapiens
  misc_feature: GYAE6OF01DPFS9.21.27.C05.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagacccctttnactcacctgtgacatcgtaccggggaaaatgtcgctggacaacaagtggttaggaattggattaggcacgtccccgtcgagacggtccttggagtggtcgttggaaaggtaccttaattacgtaccgtcccgagtacggtatagaacggtactagtcgctagtattcgtgtgaggtcggtcgtctcgaccatccaacccagacacgtccaaagtactcgacgtcctccctacctactaatcgtctcgtccaccgtacccgacgacgtacggtacttagttttactttggacgtaccgtaaaggcgggtaactaccgtaacttaccggtttacgggtaccgttaacccgttaacccccgtttccgttaccggttaacccgttcccgggttacggggggtcccgtaaacgggggtttaaaccccgg

SEQ ID NO: 212406 - DNA, 651 bp, Homo sapiens
  misc_feature: GYAE6OF01AS6UM.21.27.C05.1.454.CMB.1.raw
  modified_base (431)..(431): a, c, t, g, unknown or other
  misc_feature (431)..(431): n is a, c, g, or t
tcagtcgtcgctcgcacgaccggtgctcgatttagacgcgatcgaagggtttgggggcagagcctgctgacttctggctgaccagggccagtcaccggagctccagacaatgtctgtctcctcctcatcttcctgcccgtgactgggtcctcccatggggtctcctgtccaccagactcaaactacacgcgagtctggtccacggtactgggtgacggccctcgctacgtacccgtttcactcacctgtgaactactccgtacggggaaaatgtacgctcggacaactagtcggttaggaattggactttaggctagtccccgtagacgacggtccttggaggtcggacttgggaacggacctagttactacggtcccaaggtcggtatggaacgactagtgctagattctagtgacgtcggtcgtctacnccatccacccagactaccgtaccaagtactacgtacgtacccttccctacctaccgtaacttcgttctacgtaccgtaccctacccggacgtaccgtacgggtaccttaggttttaacgttttcgacgtacgaagtacgggtactaccgtacgtagtttccgggactaccctaccgttccgttacgtaccttaccggtcgggcccgttaagggttacccg

SEQ ID NO: 212407 - DNA, 577 bp, Homo sapiens
  misc_feature: GYAE6OF01DBC5A.21.27.C05.1.454.CMB.1.raw
  modified_base (202)..(202): a, c, t, g, unknown or other
  misc_feature (202)..(202): n is a, c, g, or t
  modified_base (303)..(303): a, c, t, g, unknown or other
  misc_feature (303)..(303): n is a, c, g, or t
  modified_base (381)..(381): a, c, t, g, unknown or other
  misc_feature (381)..(381): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctctcctgcacagccagtcagtctatcgctgactggttagcctggtaccagcaagaatctggccaggcctcccaggcctcctctactttaccgngccactcccaccgagggccacgtggtcgtcccagactggttcaggtgggcggtggtagtttgggactagtcgttttcnctcacatcacgcgcctagagagtgaagtattgttgcttagttttacttctacgtcctaagtactaattaattaacttacgtcggtccgttggccgttacggtaccggtttcggacgtaaaccggggtaccgaaagggtaggaaacgtaccgaaacgtacgtaggtacggactacgaccactattcctgttcttacc

SEQ ID NO: 212408 - DNA, 717 bp, Homo sapiens
  misc_feature: GYAE6OF01CE54T.21.27.C05.1.454.CMB.1.raw
  modified_base (202)..(202): a, c, t, g, unknown or other
  misc_feature (202)..(202): n is a, c, g, or t
  modified_base (375)..(375): a, c, t, g, unknown or other
  misc_feature (375)..(375): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggcctcccaggcctcctcactttaccgtgcatccaccagggccactggcgtcccagacaggttcaggtgggcggtgagtttgggactaggtagtttttccncttaccacctattccgacggtcccgtaccccttaacgaaggaggttagaaagtagttaggtttcggtaccttaaggtttttaacttttcgtcggtaccctaaggtaccctaaagtttaattaaacttttaaccgttcgggtacccctttgggtaccggttaccgggttaaccgggtttcccgggacccggtaacccggggggtaaacccgtaaaacgggggttaacggggtaaaaaccgttaacccgtaaaaaccgggttaaacccgtttcggggttaacgggtacctttacgggaaccctaaccccgttaagtttccccgtttggtttaccccgtttaccg

SEQ ID NO: 212409 - DNA, 496 bp, Homo sapiens
  misc_feature: GYAE6OF01BJDFG.21.27.C05.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (371)..(371): a, c, t, g, unknown or other
  misc_feature (371)..(371): n is a, c, g, or t
  modified_base (479)..(479): a, c, t, g, unknown or other
  misc_feature (479)..(479): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctntcctgcacagccagtcagtctatcgctgactggttagcctggtaccagcagaaatctggccaggctcccaggctcctcatttaccgtgcatccaccgagggcccactggtcgtcccagacaggttcagtggcggtggatttgggacaggtagttttcnctcaccatcagccgccctacagagtgaagatgttgctagtttattctgccagtacaattataattactgctgcgtgacgtcgcacggacaggagaactcgaagactgngctgcacatctgtctac

SEQ ID NO: 212410 - DNA, 693 bp, Homo sapiens
  misc_feature: GYAE6OF01ECQG9.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacgagatacaaactacagcagtctggtccaggactggtgacggccctcgcacgtaccctttcactcacctgtgactatcgtaccgggaaatcgtcgctggacaactagtggttaggaagttggtaagttacggcgtacggtccccgtacggaggacggtccgttggtaggtggtcgttagggaacggtaccttaagttactaccgtacccgtaggttcggtaagtagaaagtaactagtcgactaaggtacttcgtggtaggtacggtccggttcgttctaccgacctactacccaaccccgagtaaccgtaccgtaccaaagtaactaccgtacggttccctacccctacctaaccttaacgtcgttacctacgtacctacccgtaccccgaaccgaccgtaccggtactttacggttttactttggtacgtacgaaggtacggtactacgtaccgttagttccggtactaccttacccgttacgttacgtaccgttccgggtcggtaccgtacgggttaacccg

SEQ ID NO: 212411 - DNA, 875 bp, Homo sapiens
  misc_feature: GYAE6OF01DI2QR.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttacgcctggtaccagcaagaaatctggccaggcctcccgaggtcctcctctacttttaccgtgcctactcccaaccgagggccctacgttcggtcgtaccccgaaggtaccgtaacgggtttcgaacgggtttgggggaccggggtttaggggtaacgtttttacggggggaaccttaaggggttttaacggttttttttccctaccgtttaccaaaccccgttaagttcccgaacgggtccccgtacccccgttaaaccgtaaagggtaacgggtttaacggtaaaacgggttaagtttcgggttttacggtaacccgtttaagggtttttttaactttttcccggttacggttaccccgtaaacgggttaacccttaaaaattttaaacgtttaaaacgttttaacccgtttcggggttaccccgtttacgggttacccgggtttacccgggttaacccgggttttcccggggaaccccgggttaaacccgggggtaaacccggtaaacgggggttaaacgggtaaaaaccgtttaacccggaaaaaaccggttaacggttcgggtacgggtacccgttacggtaaccctaaccgttacgtttccgtttacgttccgtttaaccc

SEQ ID NO: 212412 - DNA, 608 bp, Homo sapiens
  misc_feature: GYAE6OF01BIJ63.21.27.C05.1.454.CMB.1.raw
  modified_base (201)..(201): a, c, t, g, unknown or other
  misc_feature (201)..(201): n is a, c, g, or t
  modified_base (303)..(303): a, c, t, g, unknown or other
  misc_feature (303)..(303): n is a, c, g, or t
  modified_base (401)..(401): a, c, t, g, unknown or other
  misc_feature (401)..(401): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggncgccaccctctcctgcacagccagtcagtctatcgctgactggttagcctggtaccagcaagaatctggccaggcctcccaggcctcctctacgtttaccgngcactcccaaccgacgggccctacgttcggtcgtaccccgaggacctagggttcaggtcgggtcggttaggtagtttggggactaggttacgttttcncgtcacctatcacgccgaccctagagtagtagaagtagtgttgcttagttttacttcgtcgacctagtactaaagttacttaatttacgtcggtccttggtccgttacgtaccggttccggacccgaaccggggtacctaaagggtacgaaagtccgtaaaacgacgttggtacggtactacgacctacgattccgtgttccttacg

SEQ ID NO: 212413 - DNA, 558 bp, Homo sapiens
  misc_feature: GYAE6OF01CIH2T.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtcgtctcaccatcacccagacacgtcaagatcagtctccctcacctatgtctgtacacgtcccgacgaccacgctacgttttattttcgtcgtcgtaagacgggaattcgacctagtttaccggtcgtaaccttacccttccgttacgtaaccgttcccggtcggggacccgtaggggttaacccgg

SEQ ID NO: 212414 - DNA, 584 bp, Homo sapiens
  misc_feature: GYAE6OF01CBVLM.21.27.C05.1.454.CMB.1.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
  modified_base (388)..(388): a, c, t, g, unknown or other
  misc_feature (388)..(388): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgcccaccctctcctgcacagccagtcagtctatcgctgactggttacgcctggtaccagcaagaatctggccaggcctcccgaggtcctcctctactttaccgngccactcccaccgacgggcccacgtggtcgtcccagactggttcaggtggcggtggtagtttgggactaggtagttttcnctacactatcacgccgtaccctagagtagtagaagtattgttgcttagttttactttcgtgtcctagtactaaattattaatttacgtcggtccttggccgttcgtacgggttccgaccgtacgggtaaccgtaagggtaggaaacgtacgaaacggtacgtggtacggtactcgactacctatctgttcttaccg

SEQ ID NO: 212415 - DNA, 757 bp, Homo sapiens
  misc_feature: GYAE6OF01D2KHA.21.27.C05.1.454.CMB.1.raw
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctctcctgcacagccagtcagtctatcgctgactggttacgcctggtaccagcaagaatctggccaggcctcccgaggcctcctctactttaccgngccactcccaccgacgggcccacgtcggtcgtcccgagacgtaggttcaggtgggcggtggtagtttcggggactaggttacgttttcctctacgtaacctagtccgaacggtcccgtacccccgttaacgaacggtaacggttaaggtaaacggtacgtttcgggtttacgtaccgtttaaggttttttaactttccggttacggtaccctaaggtaaccttaaaagtttaaacgtttaaacgttttaaccggttcgggtacccgtttcgggtacccggtttaccggttaacccgggtttcccgggaacccggtaaacccggggtaaacccggtaaaggggtaaaccgggtaaaacgttaacccggtaaaaaccgggtaacggttcgggttacggtaccgttacggtaccctaacccgttaacgtttccgttacggtttccgtttaacccg

SEQ ID NO: 212416 - DNA, 541 bp, Homo sapiens
  misc_feature: GYAE6OF01B0KP2.21.27.C05.1.454.CMB.1.raw
  modified_base (300)..(300): a, c, t, g, unknown or other
  misc_feature (300)..(300): n is a, c, g, or t
  modified_base (496)..(496): a, c, t, g, unknown or other
  misc_feature (496)..(496): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtccggggaaaatgtcgctggcaacaatggttggaattggattaggcagtccccgtgagnggccttgagtggcttggaagacctattatacgtcccagtggtatgaagactatgcagattctgtgagcggtcgtctcaccatccacccagacacgtaccaagaatcaggtcctccctccacctatgtctgtcacctcccgacgaccacgtctagtttattttgtagtcgtaagagggtataccgacgtattcggtntactacctccttacgacctccgtcggggtccgtagggttaaccgg

SEQ ID NO: 212417 - DNA, 560 bp, Homo sapiens
  misc_feature: GYAE6OF01CZFLQ.21.27.C05.1.454.CMB.1.raw
  modified_base (360)..(360): a, c, t, g, unknown or other
  misc_feature (360)..(360): n is a, c, g, or t
  modified_base (416)..(416): a, c, t, g, unknown or other
  misc_feature (416)..(416): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggtggaattggattaggcagtccccgtgagaggccttgagtggcttggaagacctattatacgtcccagtggtatgaagactatgcagattcngtgagtcggtctcttcaccatcaccccagacacgtccaagaactcacggtctcccnccacctaatgtctgtcacctcccgacgaccacggtcagtttacttttgcgtacaaggagggtatacgactattcgggttactaccgttacccttacccgtttacggaaccttcccgtacgggggccctagggggttaaacccgg

SEQ ID NO: 212418 - DNA, 682 bp, Homo sapiens
  misc_feature: GYAE6OF01BGSGS.21.27.C05.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
  modified_base (399)..(399): a, c, t, g, unknown or other
  misc_feature (399)..(399): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggancgccaccctctcctgcacagccagtcagtctatcgctgactggttacgcctggtaccagcaagaaatcgtggccaggcctcccgaggcctcctctatttaccgngcctactcccaccgacgggccctacgtggtactcccgagaccgtaggttcgaggtgggcggttggtacgtttgggactaggttacgttttcnctacacctatcgacgtccgtaccctaacgaggtagtacgaagtagttaggttgacgtttagttttactttcgtacgtacctaagtactaaagttaacttaaacgtttacgtcggtaccgttacggtccggttacggtaccgggtttacccggacccggtaaccggggtaaccgtaaaggggttaaccggtaaaacgttaaccggaaaaaccggttaacggttcggggtacggtaaccgttacggaccctaacccgttaattccgtttcgttaccctttaaccg

SEQ ID NO: 212419 - DNA, 606 bp, Homo sapiens
  misc_feature: GYAE6OF01ELDL7.21.27.C05.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
  modified_base (377)..(377): a, c, t, g, unknown or other
  misc_feature (377)..(377): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatcgtggccaggcctcccaggcctcctctattttaccgngcatcccacgagggccacgtggtctcccagacgaggttcagtggcggtggagtttgggactagtagttttcnctcacctatcagccaccctagagtagtagaagattgttcgactagttttactttcgtgcctagtacctaaattactaaatttacgtcggtccgttcggtccgttcggtaacgtttccgggacccgtaaccggggtaacccgtaaagggttaacggaaaacgttccgaaaaacggtaacgttgggtacggtacctacggacctaaccctagttccgttcgttccttaccg

SEQ ID NO: 212420 - DNA, 673 bp, Homo sapiens
  misc_feature: GYAE6OF01C8HG3.21.27.C05.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
  modified_base (382)..(382): a, c, t, g, unknown or other
  misc_feature (382)..(382): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctggtaccagcaagaaatctggccaggcctcccaggcctcctcactttaccgncactccaccgagggccacgtggtcgtcccagacctggttcaggtggcggtggagtttggggactaggtagtttttcncttccgaacctattccgaacgtcccgtacccctaacgaggaacggttagtaaagtaagtttggttacgtaccgtttaaggtttttaacgttttccgtacggtaccctaaggtaaccttaaatttaactttaaacgtttaccgttacgggtacccgttggtccggttaccggtaaccgggtttccgggacccggtaaaccggggtaaccgaaaggggttacggaaaacgttaccgaaaacggtaacgttgggtacggacgttacggaccaacctagttcctgttccttaccg

SEQ ID NO: 212421 - DNA, 546 bp, Homo sapiens
  misc_feature: GYAE6OF01DODD0.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggtgaattggattaggcagtccccgtcgagaggccttgagtggcttggaaggacctattatacgtcccagtggtatgaagactatgcagattctgtgagcggtcgtctcaccatccaccccagacacgtcaagatcagtcctccctccacctaatcgtctgtcacctccgacgacacggcttagttttacttttgtcgtacaaggaggtactcgactagttccggtgtaccttaccctccgttcgtaccttccggtcggggcccgtaggggttaacccg

SEQ ID NO: 212422 - DNA, 623 bp, Homo sapiens
  misc_feature: GYAE6OF01D9C4C.21.27.C05.1.454.CMB.1.raw
  modified_base (203)..(203): a, c, t, g, unknown or other
  misc_feature (203)..(203): n is a, c, g, or t
  modified_base (389)..(389): a, c, t, g, unknown or other
  misc_feature (389)..(389): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccgaggcctcctctactttaccgtgccactcccaccgagggcccacgtgggtcgtcccagactaggttcaggtgggcggtggtagtttggggactaggtacgttttcnctcacctatccacgccgtaccctaacgagtagtagaagtagttgttcgtcttagttttattctgtccagtactaattattaacttacgtcggtacctggtaccgttaccgtaccggttccggaccgtaaccggggaaccgtaaagggttaacggaaaacgtaaccgtaaaaccggtaacgttcgggtacgggactacggtacctaacctagtttccgttcggttccttaacccg

SEQ ID NO: 212423 - DNA, 598 bp, Homo sapiens
  misc_feature: GYAE6OF01E3VDN.21.27.C05.1.454.CMB.1.raw
  modified_base (203)..(203): a, c, t, g, unknown or other
  misc_feature (203)..(203): n is a, c, g, or t
  modified_base (251)..(251): a, c, t, g, unknown or other
  misc_feature (251)..(251): n is a, c, g, or t
  modified_base (303)..(303): a, c, t, g, unknown or other
  misc_feature (303)..(303): n is a, c, g, or t
  modified_base (395)..(395): a, c, t, g, unknown or other
  misc_feature (395)..(395): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttancctggtaccagcagaatctggccaggcctcccaggcctcctctatttaccgngccactcccaaccgagggcccacgttggtcgtaccccaagacctaggttccaggtcgggcggttggtagtttgggactagttacgttttccnctcacctatcgagccgtaccctaagagtagtagaagtagtgttagacgttagttttatttcgtcgacctagactaattaacttaatttacgtcggtcctggtccgttacggtaccggttccggaccgtaccgggacgtaaagggtacgaaactaccgaaacgtacgtggtacggactacggcctaacctattcgtgttcttac

SEQ ID NO: 212424 - DNA, 563 bp, Homo sapiens
  misc_feature: GYAE6OF01C60EU.21.27.C05.1.454.CMB.1.raw
  modified_base (202)..(202): a, c, t, g, unknown or other
  misc_feature (202)..(202): n is a, c, g, or t
  modified_base (301)..(301): a, c, t, g, unknown or other
  misc_feature (301)..(301): n is a, c, g, or t
  modified_base (381)..(381): a, c, t, g, unknown or other
  misc_feature (381)..(381): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggganccgccaccctctcctgcacagccagtcagtctatcgctgactggtagcctggtaccagcagaatctggccaggcctcccaggcctcctcactttaccgngcactccaccgagggcccacgtcggtcgtcccagacctaggttcaggtgggcggtggtagtttgggactagtagttttcnctcaccatcacgccgccctacagagtagaagtagttgttgctagttttacttctgcctaaagctaattattaacttacgtcggtcctggtccgttcgtaccggttccggaccgacgggaccgaagggtaggaaacgtacgaaacggtactggacggtctcgacctacattctcgttcttacc

SEQ ID NO: 212425 - DNA, 742 bp, Homo sapiens
  misc_feature: GYAE6OF01DM50G.21.27.C05.1.454.CMB.1.raw
  modified_base (324)..(324): a, c, t, g, unknown or other
  misc_feature (324)..(324): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacccgccaccctctcctgccacacgccagtcagtctatcgctgacgttggttacgccgtacggtaccagacaagtaaactcgtcggaccacggcctcccgaggtcctcctctacgtttaccgngactactcccaccgacggtccctacgttcggtccgtacccgagaccgtacggttccgagggtcgggtcgggttaggttaacggttttacggggaacgttaggttacgtttttcctccgttacctaaccctagttaccgaaccggtcccgtacccgtaacgacggtaacgtaggtaacgtagttggtttacgtacgtttaggttttactttccgtacgtaccgtaacgtactaaagttaacgttaaacgtttaccggtacggtacccgttcggtaccggttaccggttaccggttaccgggtaaccggtaaacccggggtaaccgtaaagggtaacggtaaacgttaaccggtaaacggtacggttcgggtacggtaccgtacgtacccgtaaccttacgttccgttcgttccttaccg

SEQ ID NO: 212426 - DNA, 598 bp, Homo sapiens
  misc_feature: GYAE6OF01C0SEK.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctgcagtaccctttcactcacctgtgacatcgtaccggggaaaatgtcgctggacaaacaagtggttaggaattggattaggctagtccccgtagagagcctgagtggcttggaacggacctattactacgtccagtggtatagaagtactatgacagtattctgtgaggcggtcgtctcaccactccacccgagacacgtacaagactacgacggtcctccctaccaactaatcgtactcgtaccacctacccgacgaccgacggtacttagttttagtttgagacgaaggacggtataccgtaactagttccggttcgtaacccttacccgttacccgtttacgacccgttcccgggtcgggggtaccgtaaggggtttaacccgg

SEQ ID NO: 212427 - DNA, 695 bp, Homo sapiens
  misc_feature: GYAE6OF01DS9RX.21.27.C05.1.454.CMB.1.raw
  modified_base (305)..(305): a, c, t, g, unknown or other
  misc_feature (305)..(305): n is a, c, g, or t
  modified_base (419)..(419): a, c, t, g, unknown or other
  misc_feature (419)..(419): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggaccgccaccctctcctgcacagccagtcagtctatcgctgactggtagcctggtaccagcagaaactctggccaggcctcccgaggcctcctctacgtttaccgngccactccaaccgagggcccacgttcggtcgtacccgaaggaccgtagggtttccgagggttcgggacgggttgggtaacgttttacggggaaccttaggttacgtttttaccnccttaccaacctaacgttcgaaccggtcccgtaccccgtaacgtaacgggtaaggttacggaaaggtagtttggttacgtcgttaaggtttttattccgtacgacctaagtaactaaattaagttaacgtttaacgtcggtaccttggaccgttacggtacggttccgggaaccggaacccggggtaaccgaaacggggttaacggaaaacgttacgaaaacggtaacgttggtacggacgtcgaaccgtaccctagttacttcggttccttaccg

SEQ ID NO: 212428 - DNA, 543 bp, Homo sapiens
  misc_feature: GYAE6OF01DUSQ8.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggtggaattggattaggcagtccccgtcgagaggccttgagtggcttggaaggactatatacgtccagtggtatgaagactatgcagattctgtgagcgtcgtctcaccatccaccccagacacgtcaagatcaggtctccctacacctaatgtctgtcaactcccgaacgacacggctagtttattttgtcgacaaggacgggatcgaactagtttccgggtgaaccttaccctccgtttagacccttccgtcgggggcctaggggttaaaccgg

SEQ ID NO: 212429 - DNA, 850 bp, Homo sapiens
  misc_feature: GYAE6OF01B73O0.21.27.C05.1.454.CMB.1.raw
  modified_base (204)..(204): a, c, t, g, unknown or other
  misc_feature (204)..(204): n is a, c, g, or t
  modified_base (438)..(438): a, c, t, g, unknown or other
  misc_feature (438)..(438): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgccaccctctcctgcacacgccagtccagtctatcgctgactggttacgcctggtaccagcaagaactcgtggccaggcctcccgaggtcctccctctacttttacccggtgccactacccgaccgaggggccctaacgttcgggtcgtccccaagtaccgtacgggtttcgaaggttcgggtccgggttagggtacgtttttgggggaactaacgggttagttttttcccncgtaccctaaccgtacgtccgtaacgtcccgtaccccttacgaagggtaacgttaggaaaacggtagtttggtttacgtacgtttaaggtttttaacgtttccgtaacggtccctaaggttaaccttaaaagtttaaactttaaacgtttaaccgttccggggttacccgttacgggtaccccggtttacggggttaacccgggtttaccggggaacccgggtaaaaccccggggtaaccggttaaaacgggggtttaaaccgggaaaaacggtttaaccccgggtaaaaaaccggttaaacccggggtttacgggttaaacccggggtaccctttaaccggaaccccggttaaacccgttaaccgttttacccggtttaccggtttaacctttttaccccccccccccggg

SEQ ID NO: 212430 - DNA, 659 bp, Homo sapiens
  misc_feature: GYAE6OF01C9CO4.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgtacccctttcacctcacctgtgacatcgtaccggggaaaatgtcgctggacaacaagttggttaggaattggattaggcgtacgtccccgtgagacggtccttggagtggcgttggaacggtacctagttacgtaccgtcccaggtggtatagaagtactatgacagtacttacgtgtagacggtcggttcgtctacaccactacccaaccccagaaccacgtaccaagaactcgacgttccctccctaccaaccttaatcgtactcgtaccaaccgtcccgaacgaccgtaccggtacttaagtttttacgttttcggacgtaaccgtaagggacgggttactaccgtaacgttacgtttcgggtaccgttaccctttacccgttaccgttacggtacccgttccgggttacggggtacccgttaaggggtttaaacccgg

SEQ ID NO: 212431 - DNA, 708 bp, Homo sapiens
  misc_feature: GYAE6OF01DLG39.21.27.C05.1.454.CMB.1.raw
  modified_base (203)..(203): a, c, t, g, unknown or other
  misc_feature (203)..(203): n is a, c, g, or t
  modified_base (258)..(258): a, c, t, g, unknown or other
  misc_feature (258)..(258): n is a, c, g, or t
  modified_base (320)..(320): a, c, t, g, unknown or other
  misc_feature (320)..(320): n is a, c, g, or t
tcagtcgtcgctcgcacgaccggtgctcgatttagacgcgatcgaagggtttgggggaggaacgtgctcagttaggacccagacggagccatggaagccccagcgcagcttctcttcctcctgcttctctggctcccagacaccactggacgtgattgtgatgacgcagtctccagccacctgtctgtgtctccgaggggggnccgccaccctctccctgcctacacgccagtccagtctatcgctgtactggttacncctaggtaccagcaagaatcgtaggccaggcctcccgaggtcctccgtctacgttttaccgngcacgttcccgaccgtaacgggcctacgtcggtaccgtcccaggtaccgtacggttacacgggtgggtacgggttaggttagttttacgggggaacttacgggttacgttttttccaccgttacaacccgtaagttcccacgggtcccgtaccccttaacgaggtaaacgttggaaacgttagttcgttagtactttaagttttacttcgtacgtactacgtactaaagtttaattaactttccgtggtccgttaggcccggttacggtaaccggttccgggacccggtaacgggtaacccgtaagggttaacgaaaacgttacggaaaacggtacgttcgggtacggaccttacggcccttaacgtactttctcggtttcttacccg

SEQ ID NO: 212432 - DNA, 664 bp, Homo sapiens
  misc_feature: GYAE6OF01B0L1K.21.27.C05.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgcccaccctctcctgcacagccagtcagtctatcgctgactggttagcctggtaccagcagaatctggccaggcctcccgaggcctcctcatttaccgngcatcccaccgagggccacgtggtctcccagacgtaggttcaggtggcggtggtagtttggggactaggtagtttttcctctaccaacctattccgacggtcccgtaccccttaacgaaggtacggttaggaaacgtagtttggtttacgtacgtttaaggttttttaacgttttcccgtaggtacccctaaggtaccctaaaagtttaacttaaacgtttacccgtacgggtcccttagggtccggttaccggtaaccggtttcccgggacccgtaacgggtacccgtaaagggtaggaaaaccgttacgaaaacggtaactgggtacgccgtacgacctaccgattcttgttccttcc

SEQ ID NO: 212433 - DNA, 630 bp, Homo sapiens
  misc_feature: GYAE6OF01EQLLT.21.27.C05.1.454.CMB.1.raw
  modified_base (204)..(204): a, c, t, g, unknown or other
  misc_feature (204)..(204): n is a, c, g, or t
  modified_base (312)..(312): a, c, t, g, unknown or other
  misc_feature (312)..(312): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgcccaccctctcctgcacagccagtcagtctatcgctgactggttacgcctggtaccagacaagaaatctggaccaggcctcccgaggcctcctactactttaccgngaccactcccaccgacgggccctacgtggtccgtcccagaccgtaggttcgaggtggtcggtaggtacgtttgggactagttacgttttcactcacctatccacgtcccgtacctaagagtagtagaagtagttcgttagcgttagtttattcgtcgtacagtactaataattaacttacgttcggtaccgttacgtccggttacgtaccgggttaccggacccggtaaccggggtaaccgtaacgggtaacggtaaacgtacgaaacggtacgttggacggtactacgtacctaacgtacttcgtcgttcctaaccg

SEQ ID NO: 212434 - DNA, 781 bp, Homo sapiens
  misc_feature: GYAE6OF01D11NH.21.27.C05.1.454.CMB.1.raw
  modified_base (203)..(203): a, c, t, g, unknown or other
  misc_feature (203)..(203): n is a, c, g, or t
  modified_base (317)..(317): a, c, t, g, unknown or other
  misc_feature (317)..(317): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggcnccgcccaccctctcctgcacagccagtcagtctatcgctgacttggttacgcctggtaccagacaagtaaactcgtcggccaggcctcccgaggtcctcctctacgtttaccgngcactcccaccgacgggccctacggtggtaccgtacccgaagtaccgtaggttacgacgggttcggggtcgggttagggtacgttttacggggaaccttagggttacgttttttccgtaccgttacctaacccgttacgtaccgtaacggtaccccgtaccccgttaaacggaacggttaagggttaacggtaaaggttaacggttttgggtttacggttaacgtttaacggtttttttaacttttccgtaccggttaccgtaaaggtaacttaaaatttaacgtttaaacgtttaccggtcggttacccgtttacgggtaccggtttaccggtaccgggtttaccgggaaccccggtaaccggggtaaccgtaaacggggttaacggtaaaaccgtaaccggtaaaacggtacgttcgggtaccggtactacgacctaaccgtacttcgttcgttccgttacc

SEQ ID NO: 212435 - DNA, 679 bp, Homo sapiens
  misc_feature: GYAE6OF01A4YM1.21.27.C05.1.454.CMB.1.raw
  modified_base (204)..(204): a, c, t, g, unknown or other
  misc_feature (204)..(204): n is a, c, g, or t
  modified_base (311)..(311): a, c, t, g, unknown or other
  misc_feature (311)..(311): n is a, c, g, or t
  modified_base (400)..(400): a, c, t, g, unknown or other
  misc_feature (400)..(400): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccagtggggganccgcccaccctctcctgccacagccagtcagtctatcgctgactggtagcctggtaccagacagaatcgtggccaggcctcccgaggtcctcctctacgtttaccgngaccactcccaccgacgggccacgtggtcgtacccagacgtaggttcgaggtcgggcggtaggtagtttgggactaggttacgttttcnctacacctatacgacgccgtacctagaggtagtagaagtattagttgtacttagtttactttcgtacgtcctaagtacctaaagttacttaaacgttaccgtcgggtaccttacggtaccggttaccggtacccggttaccgggtaccccggtaaccggggtaaacccgtaaacgggggttaacgtaaaacggttaacccgaaaaccgggttaacgttaccgggtacgggttaccgtacggtaaccccgtaaccgttacgttcccgttcgtttaccccg

SEQ ID NO: 212436 - DNA, 564 bp, Homo sapiens
  misc_feature: GYAE6OF01BN4GT.21.27.C05.1.454.CMB.1.raw
  modified_base (203)..(203): a, c, t, g, unknown or other
  misc_feature (203)..(203): n is a, c, g, or t
  modified_base (543)..(543): a, c, t, g, unknown or other
  misc_feature (543)..(543): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccgaggctcctctactttaccgtgcactcccgaccgacgggccacgtggtcgtcccagactaggttcaggtgggcggtggtagtttcgggactaggtacgttttctctcacctatcacgccgtaccctacgagtaggtagaagtagttggttcgtacttagttttatttctcgcctagtactaatacttaattacgtggtcctgccgttcgtacgtccggaccgtacgggacgtaaggtacggaacgtacgaaacgacgtgnggtctcgacacatctcgtctc

SEQ ID NO: 212437 - DNA, 773 bp, Homo sapiens
  misc_feature: GYAE6OF01AQVXZ.21.27.C05.1.454.CMB.1.raw
  modified_base (168)..(168): a, c, t, g, unknown or other
  misc_feature (168)..(168): n is a, c, g, or t
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
  modified_base (242)..(242): a, c, t, g, unknown or other
  misc_feature (242)..(242): n is a, c, g, or t
tcagtcgtcgctcgcacgaccggtgctcgatttagacgcgatcgaagggtttgggggagggaacgtgctcagttaggacccagacggagccatggaagcccagcgcagcttctcttcctcctgcttctctggcctccagacaccactggacgtgattgtgtatgacgnagtctccagcccaccctgtctgtgtctccgagggggcncgccaccctctcctgcacngccagtcagtctatcgnttcgacttgttagccttaggtaccaggacagaaattccgacgggtaccacgggtcctaccccgaggtccttcctacctacgttttacccggtgccctaatccccaacgacgggtcccacgtcggttctacccgaagtaccgtaacggttcgacggtgggtacggtaggtacgtttggggaacctacgggtacgtttttacctcggtaccctaaccgtacgtacgtacggtacccgtacccgttaacgtaccgggtagttaacggaacgtacggttacgttacgggttacgttacgttttacgtttacgttccgtaccgtacgtacgttaaattaacttaaccgtttaacgttcgggtaaccgttcggtaaccgggttccgttaacgggttcccgggtaccggttaaacccggggacgttaaacccggggtaaagggtaaaccgtttaacccgaaaacggttaaccggttacgggttacgtacggttaccggcccggttaaaccacggtttaccgttacgtcggtttaaccc

SEQ ID NO: 212438 - DNA, 527 bp, Homo sapiens
  misc_feature: GYAE6OF01B16PP.21.27.C05.1.454.CMB.1.raw
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
  modified_base (486)..(486): a, c, t, g, unknown or other
  misc_feature (486)..(486): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcacctcacctgtgacatctccggggaaatgtcgctggcaacaatggttgaattggattaggcagtccccgtgagaggccttgagtggcttggaaggacctattatacgtcccagtggtatgaagactatgcagattctgtgagcggtcgtctcaccatccaccccagaccacgtccaagaatcaggtcctccctccacctaatgtctgtcactcccgacgacacggctagtttattttgngcaagnggatcgactattcggtnacctccttccttgaccttccgtcgggccgtagggttaaccg

SEQ ID NO: 212439 - DNA, 568 bp, Homo sapiens
  misc_feature: GYAE6OF01CDHWW.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (303)..(303): a, c, t, g, unknown or other
  misc_feature (303)..(303): n is a, c, g, or t
  modified_base (381)..(381): a, c, t, g, unknown or other
  misc_feature (381)..(381): n is a, c, g, or t
  modified_base (433)..(433): a, c, t, g, unknown or other
  misc_feature (433)..(433): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaaatctggccaggcctcccaggcctcctcactttaccgngcatccaccagggcccacgtggtctcccagacgaggttcaggtgggcggtggtagtttgggactaggtacgtttttcncttcacctatcacgccgccctagagagtagaagtatgttgctagtttattcngtcctagactaaattataacttacgtcggtcctgtccgttcggtacggttccggaccgaacgggaccgtaaggtacggaaacgtaccgaaacgtaacgttggtacgctacgcctaccgtatccttgttcttaccg

SEQ ID NO: 212440 - DNA, 620 bp, Homo sapiens
  misc_feature: GYAE6OF01BL5NT.21.27.C05.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
  modified_base (395)..(395): a, c, t, g, unknown or other
  misc_feature (395)..(395): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctggtaccagcagaaatctggccaggcctcccgaggcctcctcatttaccgngccactcccaccgagggccctacgtcggtctcccgagaccgtaggttcaggtgggcggtggtagtttacggggactaggttacgtttttcncgttacacctagttccacgccgtacccctaagagtagtagaagtattgttgacttagttttactttcgtgtacctagtactaatattaacgttacgtacggtccttgtccgttgtaccggttcggaccgtacgggtaaccgtaagggtacgaaacgttaccgaaaaccggtacgttcgggtacggtacctacggacctacccgtagttccgttcgttccttaccg

SEQ ID NO: 212441 - DNA, 783 bp, Homo sapiens
  misc_feature: GYAE6OF01ATSYA.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcaagaatcgtggccaggtcctaccccgaggtcccctacctacttaccgttaccgtcgactacctacccgacgggtaccgaccgtacggttcggtaccctaccggaacgtaccggttacggtacgtacggggtcggggttacgggtacgggtttaacgggttacggaacggttacggtttttaccgttttcctaccgttacccgaacttaccgtaccggtaccggtaccccgttaacccgtaaggtaacgggtacgggtaaacggtaagttcggtttacggtttactaacggttttacgtttttacgtttccgtaaccgtaaccgttaacggtaactttaaacgtttaacgttaacgttaccgggttaccggttaccggttaccggtaccgggttaccggttaccgggttacccggaaccgggtaacccggtaacggtaagggtaaccggtaaaccgtaaacggaaacgttacggtcggtacgtcgacgtaccccgtattaccgttcgttccgttcctaaccg

SEQ ID NO: 212442 - DNA, 613 bp, Homo sapiens
  misc_feature: GYAE6OF01B9UUC.21.27.C05.1.454.CMB.1.raw
  modified_base (388)..(388): a, c, t, g, unknown or other
  misc_feature (388)..(388): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcagaccctttcactccacctggtgacatcgtaccggggaaaatgtcgctggacaacaagtggttggaattggattaggcagtccccgtgagagccttgagtgctggaagtactattatacgtccgagtgtatgaagatatgacagtattcgtgtgagtccggtagtctcaaccntaccaaccgaagacacgtaccaagactcacgtctacccctctaccctaatcgtactcgtaccaccgttacccgaccgaccgtaccgtacttagttttacttttgacggtactaaggtacgggtaactcgtaacgttagtttccgggtacgtaaccctttacccgttacccgtttcggtaacccctccgggtttacgggggacccgtaagggggttttaaccccgg

SEQ ID NO: 212443 - DNA, 574 bp, Homo sapiens
  misc_feature: GYAE6OF01BP2M8.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaaatgtcgctggcaacaatggttggaattggattaggcagtccccgtcgagaggccttgagtggcttggaagacctattactacgtcccagtggtatgaagactatgcagattctgtgagcggtcgtctcaccatccaccccagacaccgtccaagaactcgacggtcctcccgtaccacctaatcgtctgtcactcccgacgaccacggtccttagttttacttttgtcgtactaaggtaggactacgtacgtagttccggtcgtaaccttacccttaccgttacgacccgttccgtacggggtacccgtaggggttaacccgg

SEQ ID NO: 212444 - DNA, 594 bp, Homo sapiens
  misc_feature: GYAE6OF01DRSA4.21.27.C05.1.454.CMB.1.raw
  modified_base (160)..(160): a, c, t, g, unknown or other
  misc_feature (160)..(160): n is a, c, g, or t
  modified_base (362)..(362): a, c, t, g, unknown or other
  misc_feature (362)..(362): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtntcctgtcacagatcaaactacagcagtctggtccaggactggtgaggccctcgcacgaccctttcactcacctgtgacatcgtaccggggaaaatgtcgctggacaacaatggttggaattggataggcagtccccgtgagaggccttgagtggcttggaagacctattatacgtcccagtggtatgaagtactatgcagtnttctgtgaggtcggtctctcacgactccaccccagaccacgtaccaaagactcgacggtcctccctacctacctatcgtctcgtccactcccgacgaccgtacggacttacggtttttatttcgagtaccgtaaggtacgggtataccgtaacgtacgtttacggacgttaacccttaccgttaccgttacgtacccttccggtcgggggtaccctaaggggtttaacccgg

SEQ ID NO: 212445 - DNA, 637 bp, Homo sapiens
  misc_feature: GYAE6OF01EEO1X.21.27.C05.1.454.CMB.1.raw
  modified_base (204)..(204): a, c, t, g, unknown or other
  misc_feature (204)..(204): n is a, c, g, or t
  modified_base (313)..(313): a, c, t, g, unknown or other
  misc_feature (313)..(313): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtcctccgaggggggancgccaccctctcctgcacagccagtcagtctatcgctgactggttacgcctggtaccagcaagaatcgtggccaggcctccccgaggtcctccgtactacttttaccgngccactcccgaccgagggcccacgtcggtcgtcccaggtacgtacggttcaggtcgggcggttggtagtttgggactaggttcgttttcctcgtaccacctatccgacgccgtaccctagagtaagtagaagtagttcggttgtacgttagtttttacttcgtcgtacctagtactaattaacttaacgttcgtacggtccgttcggtccggttccgtaaccggttcgggacccgaacgggtaaccgtaaaggggtaacgtaaacgtaaccgaaagtacgtcggtacggactcggaacctacgtattcgttccgttattacccg

SEQ ID NO: 212446 - DNA, 746 bp, Homo sapiens
  misc_feature: GYAE6OF01CUT12.21.27.C05.1.454.CMB.1.raw
  modified_base (208)..(208): a, c, t, g, unknown or other
  misc_feature (208)..(208): n is a, c, g, or t
  modified_base (367)..(367): a, c, t, g, unknown or other
  misc_feature (367)..(367): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccacgtggagtgattgtgatgacgcagtctccagcccaccctgtctgtgtctccggaggggggacnccgcccacccgtctcctgcacgacgccagtcagtctatcgactggtacgtggttacgccgtaggtaccaggacaagaacttcgcggaccgacggcctaccgacggtcccttccgtacttacgtttaccgtcgacctacgtacccacggacgggtacccncggttcggtaccgtacccgaggtaccgtcggtttacgagggggttcggtccgggttagggtacggtttacgggacgttaacgggtttcgttttcccacgttaccaacgtacgtaccgaccggtaccccgtaacccgttaagacggttaacggtacgtaagttacgttggttacgtacgttttaggttttacttcgtaccgtacctaagtaactaaagttaatttaaccgttacgccggttacgtacgggtaccggttaccgtacccgggttaccggaacccggtaacgggtaaccgagggttaaccgaaacgtacggtaaaccggtaacgtcggtaccggtactaccgtaccgtactactttcgtcgttccgttacccg

SEQ ID NO: 212447 - DNA, 625 bp, Homo sapiens
  misc_feature: GYAE6OF01D3NNW.21.27.C05.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
  modified_base (379)..(379): a, c, t, g, unknown or other
  misc_feature (379)..(379): n is a, c, g, or t
  modified_base (400)..(400): a, c, t, g, unknown or other
  misc_feature (400)..(400): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtgtctccgagggggganccgccaccctctcctgcacagccagtcagtctatcgctgactggttagcctggtaccagcagaaatctggccaggctcccgaggcctcctctatttaccgngcactcccaccgagggcccacgtggtcgtcccagacaggttcaggtggcggtggatttgggactagtagttttcnctcaccatcacgccgccctanagtagtagaagtattgttgacttagttttactttcgtacgccctaagtactaaattaattaaacgtttaccgtacgggtcccttgggtacccggttaccggtaccggtttccgggaacccggtaaccggggtaaccgtaaagggttacggaaaacgtaccgtaaaacggtacgttcgggtacgggtactacggacctaacccgtagttccgttgttccttacccg

SEQ ID NO: 212448 - DNA, 769 bp, Homo sapiens
  misc_feature: GYAE6OF01D7ZQX.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggacncgccaccctctcctgcacagccagtcagtctatcgctgactggttacgcctaggtaccagacaagaatcgtcggaccacggcctcccgaggtcctcctactacgttttaccgtgaccacgtcccaccgacggacctacgttcggtaccgtcccgaagtacgtacggtttacgagggtcgggtacgggttaggtaacgttttcggggaacttagggttacgttttttcctacgtaccaacctattcccgacggtcccgtaccccgttaacgaacggtaacggttaggaaacgtaggttcggttacgtacgtttagtttttacgtttccgtacgtacccgtaagtaacgttaaacttaactttaaacgtttaccggttaccggttaccggttacgttacccggttacggtacccgggttaccgggtacccggtaaccggggtaacccggtaaaagggtaaccgggtaaaaaccgttaacccgaaaaacggttaacggttcgggtaccgggttacccttacggtaacccttaacccgttagtttaccgtttcgtttccgtttaaccccg

SEQ ID NO: 212449 - DNA, 681 bp, Homo sapiens
  misc_feature: GYAE6OF01CKH1W.21.27.C05.1.454.CMB.1.raw
  modified_base (211)..(211): a, c, t, g, unknown or other
  misc_feature (211)..(211): n is a, c, g, or t
  modified_base (335)..(335): a, c, t, g, unknown or other
  misc_feature (335)..(335): n is a, c, g, or t
  modified_base (450)..(450): a, c, t, g, unknown or other
  misc_feature (450)..(450): n is a, c, g, or t
  modified_base (669)..(669): a, c, t, g, unknown or other
  misc_feature (669)..(669): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtcctccacgcccacccgtgtctgtgtcgtccggaggggggacnccgcccaccctctcctcgcacgacgccagtcagtctatccgactgtacgtggttacgcctacggtaccagacaagtaaactcgtcggccacggcctcccggagtcctcctactacgtttaccgngacctacgtcccaaccggacggtaccacgttcgggtaccgtacccgagtaccggtcggttacgaggggtcgggtcgggttaggtacgtttacgggacttaaggttacgttttccncttaccactactccgacgtcccgacccgtaacgaaggtacgtagtaagtacgttgttcgtacgttagttttacttacgtcgaacctagaacttaaattaacgtttaacgttacggtcggtaccgttggacccggttacggtaccggtccggaccggaacgggtaacgtaagggtaacgaaacgttacggaaaacgtagttcggagtctagtaccacttntctagttctacc

SEQ ID NO: 212450 - DNA, 581 bp, Homo sapiens
  misc_feature: GYAE6OF01BNFC6.21.27.C05.1.454.CMB.1.raw
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcaagaaatctggccaggcctcccgaggcctcctctactttaccgngcactccaccgagggccacgtggtctcccgagactaggttcaggtgggcggttggtagtttggggactaggttacgttttcctcgtccacctatccgacggccgaccctaagaggtaggtagaagtattggttgacttagttttactttcgtcgtaccagtactaaattaattaacgtttacgtcggccgtggtcgtcgtacggttcggacgaacgggacgaagggtagaaactacgaaacgacgtggtacgcgtcgaccactatcttgtcttacc

SEQ ID NO: 212451 - DNA, 534 bp, Homo sapiens
  misc_feature: GYAE6OF01D4H67.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (372)..(372): a, c, t, g, unknown or other
  misc_feature (372)..(372): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatcccaccagggccactggtcgtcccagacaggttcaggtggcggttggtatttgggactagtagttttcnctcacctatcagccgccctacagagtgaagatgttgctagttttattctgccagactaatattaattactggacctgtcgtcggtacgttcggacgaaccgggaccgaaggtacggaaatacgaaacgaacgtggtaggctacgaccaccatctgtcttacg

SEQ ID NO: 212452 - DNA, 540 bp, Homo sapiens
  misc_feature: GYAE6OF01EWD34.21.27.C05.1.454.CMB.1.raw
  modified_base (473)..(473): a, c, t, g, unknown or other
  misc_feature (473)..(473): n is a, c, g, or t
  modified_base (499)..(499): a, c, t, g, unknown or other
  misc_feature (499)..(499): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgaccgtgctgggcctcccatggggtgtcctgtcacagatcaaactacagcagtctggtccaggactggtgaggccctcgcagaccctttcactcacctgtgacatctaccggggaaaatgtcgctggcaacaatggttggaattggattaggcagtccccgtgagaggccttgagtggcttggaaggtacctattatacgtcccagtggtatgaagactatgcagattctgtgagcggttacgtctcaccactcaccccagacacgtaccaagaactcaggtctccctacctacctaatcgtctcgtcacctcccgacgcacggtctagtttactttgngtacaaggaggatcgactattcggtnaaccttcctcccgttgacttaccgcggggtcagggttaacg

SEQ ID NO: 212453 - DNA, 613 bp, Homo sapiens
  misc_feature: GYAE6OF01DURXM.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagacccttcactcacctgtgacatctaccggggaaaatgtcgctggcaacaatggttgaattggattaggcacgtccccgtgagaggccttgagtggcttgggaagtacctattataccgtcccagtggtatgaagtactatgctagtacttctgtgagtcggtcgtactcaccactccacccctagacctaccgtaccaaagactcgacggtcctacccctcctaacctaatcgtctcgtccacctcccgaacgaccgtacggtcttagttttactttggtagtaccgtaaaggtacggtataccgtaaccgttagtttccggttacgtaacccgttacccgttacccgttacggtaacccgttcccggtacggggtacccgtaaggggtttaacccg

SEQ ID NO: 212454 - DNA, 653 bp, Homo sapiens
  misc_feature: GYAE6OF01CER4W.21.27.C05.1.454.CMB.1.raw
  modified_base (202)..(202): a, c, t, g, unknown or other
  misc_feature (202)..(202): n is a, c, g, or t
  modified_base (321)..(321): a, c, t, g, unknown or other
  misc_feature (321)..(321): n is a, c, g, or t
  modified_base (429)..(429): a, c, t, g, unknown or other
  misc_feature (429)..(429): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgccacagccagtcagtctatcgctgactggttacgcctaggtaccatacaagtaactcgtcggaccaggtccctcccgaggtcctccctactaacgtttacccgngcctactcccgaaccgacgggccctacgtcgggtccgtacccgagtaccgtaggttccgagggttcgggcgggttaggtagtttggggaacttaggttcgtttttccncttaccacctatccgacgtcccgtaccctaacgagtagtagaaagtagttggttacgtactttagttttattccgtacgtaccgtagtactaaagttaacttaacgttacgtcggtccgttaggtccgtacgtaccggttcggacccgtacgggtaacgtaagggtaacgaaacgtacgaaacgtacgtcggtacgcgtcgtacctacgtcttctcgttctacg

SEQ ID NO: 212455 - DNA, 680 bp, Homo sapiens
  misc_feature: GYAE6OF01A0AX5.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatcaaactacagcagtctggtccaggactggtcgaggcccctcgcacgtaccctttcactcacctgtagacagttccgtaccggggaaatcgtcgcgtggacaacgaagttgggttaggaagtttggattaggcctacggtcccccggtggagtacggtccgttggaggtggcgttagggaacggtaccttagttacgtaccgtacccgtaggtacggtagtagaaagtacttagtgactagtattcgtaggtagtacggcggttcgtctaccacctactacccgaacccgagacctaccgtacaagtaactaccgacggttccctaccccgtacctaaccttacgtcgttccttacgtacctacccgtacccgaccgtaaccgtacggttacgttacgtttttacgtttgtacgacgtaaggtacggtacttacgacgttagttcggtactaccttaccgttccgttacgacccgttaccggtcgggtaccgtacggggtttacccg

SEQ ID NO: 212456 - DNA, 617 bp, Homo sapiens
  misc_feature: GYAE6OF01CEWFR.21.27.C05.1.454.CMB.1.raw
  modified_base (304)..(304): a, c, t, g, unknown or other
  misc_feature (304)..(304): n is a, c, g, or t
  modified_base (388)..(388): a, c, t, g, unknown or other
  misc_feature (388)..(388): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggaccgccaccctctcctgcacagccagtcagtctatcgctgactggtagcctggtaccagcagaatcgtggccaggcctcccgaggtcctcctctactttaccgngcatcccacgagggcccacgtggtcgtcccagtacctaggttcaggttcgggcggttggtaagtttgggactaggtagttttcncgtcacctatcgacgtccgtaccctagaggtagtagaagtattgttacgcttagttttacttcgtagtacctaagtactaaattaattaacgtttacgtcggtccttggtaccgttcgtaccggttccggacccgtaccgggtaccgtaaagggtacggtaaactaccgtaaacggtacgttcgggtacggtaccgtcgtacctacctagttccgttcgttccgttacc

SEQ ID NO: 212457 - DNA, 540 bp, Homo sapiens
  misc_feature: GYAE6OF01AMTCP.21.27.C05.1.454.CMB.1.raw
  modified_base (463)..(463): a, c, t, g, unknown or other
  misc_feature (463)..(463): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctcggggaaatgtcgctggcaacaatggttggaattggattaggcagtccccgtgagaggccttgagtggcttggaaggacctatactacgtcccagtcggtatgaagactatgacagattctgtgagcggtcgtctcaccatcaccccagacacgtccaagatcacggtctccctccacctaatcgtctgtcactcccgacgtacacgtctagtttactttgngtacaaggtaggatacgctagttcggtgtaccgttacctccgttgtaccttccgtcggggtccgtagggttaaccgg

SEQ ID NO: 212458 - DNA, 610 bp, Homo sapiens
  misc_feature: GYAE6OF01CO3JZ.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatacaaactacagcagtctggtccaggactggtgacggccctcgcacgtaccctttcactcacctgtcgacactcgtaccgggaaaatgtcgctggcaacaagtggttaggattggattaggctagtccccgtgagaggccttggagtggcttagggaacgtacctattactacgtccctagtggtatgaagtactagtgactagtattcgtggtgaggtcgtcgtctacgaccatccacccagaccacgtacaagactcacgtcctccctaccaacctaagtctccgtacgtaccacccgtacccgaccgaccgtacgtacgttaacgtttttactttggagtacgtaaggtacggactacgtacgtatttaccggtctacccttacccgttcgttacgtaccgtaccggttaccgggccgtaacggggtttacccgg

SEQ ID NO: 212459 - DNA, 565 bp, Homo sapiens
  misc_feature: GYAE6OF01A68CX.21.27.C05.1.454.CMB.1.raw
  modified_base (202)..(202): a, c, t, g, unknown or other
  misc_feature (202)..(202): n is a, c, g, or t
  modified_base (301)..(301): a, c, t, g, unknown or other
  misc_feature (301)..(301): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (441)..(441): a, c, t, g, unknown or other
  misc_feature (441)..(441): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaatctggccaggcctccgaggcctcctctatttaccgngacactcccaccgagggccacgtggtcgtcccgagaccgtaggttcaggtcggcggtggtacgtttgggactaggttacgttttctctcactatcgagccgaccctagagtacgtnaagtntgttgcttagtttacttcntacagactaattataattcgtcgctgcgttcgtaccgtcggaccgacgggaacgtaggtaacgtaaacgtccggaaaacgtacgtaggtcgtactacgacctaacgtatccgttgttccgtacg

SEQ ID NO: 212460 - DNA, 553 bp, Homo sapiens
  misc_feature: GYAE6OF01BEY9D.21.27.C05.1.454.CMB.1.raw
  modified_base (204)..(204): a, c, t, g, unknown or other
  misc_feature (204)..(204): n is a, c, g, or t
  modified_base (270)..(270): a, c, t, g, unknown or other
  misc_feature (270)..(270): n is a, c, g, or t
  modified_base (301)..(301): a, c, t, g, unknown or other
  misc_feature (301)..(301): n is a, c, g, or t
  modified_base (368)..(368): a, c, t, g, unknown or other
  misc_feature (368)..(368): n is a, c, g, or t
  modified_base (435)..(435): a, c, t, g, unknown or other
  misc_feature (435)..(435): n is a, c, g, or t
tcagtcgtcgctcgcacgaccggtgctcgatttagacgcgatcgaagggtttgggggaggaactgctcagttaggacccagacggagccatggaagccccagcgcacgcttctcttcctcctgcttctctggctcccagacaccactggagtgattgtgatgacgcagtctccagccaccctgtctgtgtctccgaggggggancgccaccctctcctgcacagccagtcagtctatcgctgacttggtagcctggtaccagcagaatcnggcaggctcccaggctcctctactttaccgngcactcccaccgagggccacgttggtctcccagaccgtaggttcaggtcggcggtggtagtttgganaggttatttctctcacctatcacgccgacctacagagtgaagtagttgttgcttagtttcttcgtcncgaagactaattattaattacgcggtcctgtccggtcgtaccggtcggacgaaaccgggaccgtaaggtaggaaactacgaaacgtagtgtagctaggtccactattctctcgttacc

SEQ ID NO: 212461 - DNA, 552 bp, Homo sapiens
  misc_feature: GYAE6OF01DKZ5F.21.27.C05.1.454.CMB.1.raw
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
  modified_base (458)..(458): a, c, t, g, unknown or other
  misc_feature (458)..(458): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcagaccctttcactcacctgtgacatcgtaccggggaaaatgtcgctggcaacaatggtgatgatagnagtcccgtgagnggcttgagtggcttggaagactattatacgtcccagtggtatgaagactatgcagattctgtgagtcggtcgtctcaccgatccacccagacacgtaccaagatcagtcctccctccacctatcgtctgtcactacccgacgaccgacgtctagtttattttgngtacaaggagggtatacgtacgtagttacggtcgaaccttacccttccgttacgaccgttacccggtcggggtcccgtaaggggtttaacccgg

SEQ ID NO: 212462 - DNA, 563 bp, Homo sapiens
  misc_feature: GYAE6OF01BA7ZV.21.27.C05.1.454.CMB.1.raw
  modified_base (205)..(205): a, c, t, g, unknown or other
  misc_feature (205)..(205): n is a, c, g, or t
  modified_base (314)..(314): a, c, t, g, unknown or other
  misc_feature (314)..(314): n is a, c, g, or t
  modified_base (544)..(544): a, c, t, g, unknown or other
  misc_feature (544)..(544): n is a, c, g, or t
  modified_base (550)..(550): a, c, t, g, unknown or other
  misc_feature (550)..(550): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggacnccgccaccctctcctgcacagccagtcagtctatcgctgactggttagcctggtaccagcaagaaactcgtcggccaggccctcccgaggcctcctctacttttaccgngtcactcccaccgagggcctacgtcggtccgtacccgaggacgtacggttcgaggtgggcggttggtacgtttgggactaggttacgttttctcgtacacctatcgacgccgtaccctagaggagtagaagtatgttagacttagtttattctcgcctagactaattataactacgtcgtctgcgttcgtacggtcgaccgacggacgtaggagaagtacgaagtcgtgngacgcncactatctgtctc

SEQ ID NO: 212463 - DNA, 653 bp, Homo sapiens
  misc_feature: GYAE6OF01BKE41.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggnccgccaccctctcctgcacagccagtcagtctatcgctgactggttacgcctggtaccagcagaatctggaccaggcctcccgaggtcctcctctacgtttacccgtgctactcccaccgagggcctacgtggtcctccgagacgtaggttcaggtgggcggtaggtagtttacgggactaggtacgttttcactcgtaacctgtaccagtcccgaccctacgacgtagtagaagtagttggttacgtcttaagttttcttccgtcgaccctaagtacctaaagttacgttaactttaccgtcggtacccgttcggtaccgttacccgggttaccggttaccgggaacccggaaccgggttaaccggaagggttaacggaaacgttacccgtaaaacggtacggttcggtacggcttacggaccctaccgtattccgttgttccttacccg

SEQ ID NO: 212464 - DNA, 869 bp, Homo sapiens
  misc_feature: GYAE6OF01CPEES.21.27.C05.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctcttcctcatcttcctgcccgtgctgggcctccatggggtgtcctgtcacagatcaaactcagcagtctggtccaggactggtgacggccctcggcagaccctttnactcacctgtcgacatcgtaccgggaaatgtcgctcggacaacaagttcggttaggaattgggaacgtttacggctacggtcccccggtacggtaacggtacggtacccgtttaggacggttacggggtacctttaggggaaacgggtacccgtttaaagtttaacgtaaccggtttaccccgaggtttaccgggttaatacggaaaggtaccgtaagttcggaactaacggtactttaccgtacggtacggtaacggttaccggttaccggtaccttaccgaacccgttaaccgttacccgtaacccccccgaaggtaacccctaaacccgggtttaacccaaaacgggttaaactttcccggtaaacgggttacccctttaacccccgtaccccgtaaacccgtttaaacgtttccggtaacccgtttaccggttaacccgtaccccgttaacccccgggtaacccggtaacccgtacccgggtaccttttaacggttttttaacgtttttacggaccgtacgtaaacggtacggggtactaaccggtaccgttaggtttaccggtaccgtaaccgttacccgttaccgtttacggtaccccttaccgggttacggggtacccgtaacggggttttaaacccgg

SEQ ID NO: 212465 - DNA, 675 bp, Homo sapiens
  misc_feature: GYAE6OF01AXUXE.21.27.C05.1.454.CMB.1.raw
  modified_base (202)..(202): a, c, t, g, unknown or other
  misc_feature (202)..(202): n is a, c, g, or t
  modified_base (270)..(270): a, c, t, g, unknown or other
  misc_feature (270)..(270): n is a, c, g, or t
  modified_base (307)..(307): a, c, t, g, unknown or other
  misc_feature (307)..(307): n is a, c, g, or t
  modified_base (657)..(657): a, c, t, g, unknown or other
  misc_feature (657)..(657): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgacttggttagcctggtaccagcaggaatcnggccaggctccccgaggcctcctctacgtttacccgngccaactcccaaccgtacgggcccacgttggtcgtccccgaaggtacctaggtttcaggttcgggcgggtggtacgtttgggaactagttacggttttctcgtcaccctattccgagtccgaccctaagacggtaagtggtaaagtagttggttagacgttaacgtttttacgtttccgttcggaccctaagtaccttaaagtttaacttaaccgtttaacgtcgggtacccgttaggtacccggttcgggtaacccggtttccgggaaccccgtaaccggggtaaccgtaaagggttaacggaaaacgtccggaaaacggtacgttggtacggctacggaccctacgtnttccgtgttacccttacg

SEQ ID NO: 212466 - DNA, 531 bp, Homo sapiens
  misc_feature: GYAE6OF01EAXMV.21.27.C05.1.454.CMB.1.raw
  modified_base (203)..(203): a, c, t, g, unknown or other
  misc_feature (203)..(203): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
  modified_base (426)..(426): a, c, t, g, unknown or other
  misc_feature (426)..(426): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtccagtctatcgctgactggtagctgtaccagcagaatctggccaggctcccgaggcctcctcactttaccgtgccatcccaccagggccacgtggtcgtcccagacgaggttcaggtggcggtggagtttgggactagtagttttctctcaccatcacgccgcctanagagtagaagtntgttgctagtttcttcgtncctagctaatatatactgtctgtcgtcgacgttcggcgacggacgaaggtacgaaactaccgaaagtactgacggactcggaccaacgtattcgtgttccttacg

SEQ ID NO: 212467 - DNA, 778 bp, Homo sapiens
  misc_feature: GYAE6OF01A1O2C.21.27.C05.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctntcctgcacagccagtcagtctatcgctgactggtagcctggtaccagcagaatctggcaggcctccaggcctctctattaccgtgcatcccaccagggcctacgtggtcgtacccagacaggttcagggtcgggcggttagggtacgttttggggaacctaggttacgtttttccgtaccttaccgaaaccctaagttaccgacggtacccgtacccccttaacgacggtaagttacggtaaagtacgttagggtttacgacgtttacggtttttaactttccgtacgtaccccgtaagtacctaaaacttttaagttaaacttttaaccggtacgggttaccccgtttaggtacccgggttttacccggggtaaccggttttacccggggaaccccggttaaacccgggggtaaacccggttaaaaacgggggttaaccgggtaaaaaaccgttaacccgggaaaaaaccccggtaaacggttcggggttaaaccgggtaccgtttaccggtaacccgttaaccgtaacccgttttaccgttacggtttacccctttaaccccg

SEQ ID NO: 212468 - DNA, 818 bp, Homo sapiens
  misc_feature: GYAE6OF01A8CZF.21.27.C05.1.454.CMB.1.raw
  modified_base (202)..(202): a, c, t, g, unknown or other
  misc_feature (202)..(202): n is a, c, g, or t
  modified_base (314)..(314): a, c, t, g, unknown or other
  misc_feature (314)..(314): n is a, c, g, or t
tcagtcgtcgctcgcacgaccggtgctcgatttagacgcgatcgaagggtttgggggaggaactgctcagttaggacccagacggagccatggaagccccagcgcagcttctcttctcctgcttctctggctcccagacaccactggagtgattgtgatgacgcagtctccagccaccctgtctgtgtctccgagggggacncgccaccctctcctgcacagccagtcagtctatcgctgactggttagcctggtaccagcaagaaatctggccaggcctccccgaggtccctccgtctaactttttacccggngtaccaacttcccgaaccgaacggggtcccctaacgttcgggtaccgtaccccgaagtaccggtaacggtttccgaaggggttcggggaccgggttagggtacgttttacgggggaaaccttagggggtttacttttttccgtccgttaacccaaacccgtagttcccgaaacggtccccgttacccccgttaaagaggtaaacgttagggaaaacggttgttacgggtttacgtacgtttaacggttttttacgtttccgttaacgcccctaaaggttaaccttaaaagtttaaactttaaacgttttaaccggtcgggtaacccgttacggttcccgggtttaacccggtacccgggttttaccgggaaccccgtaaaccggggtaacccgttaaagggggtaaaccggtaaaacgttaaccgtaaaaccggtaacgttaggggtacggtaccctaccggtaactaccccgttaagttccgtttaacggttcctttaacccg

SEQ ID NO: 212469 - DNA, 542 bp, Homo sapiens
  misc_feature: GYAE6OF01EVNBC.21.27.C05.1.454.CMB.1.raw
  modified_base (412)..(412): a, c, t, g, unknown or other
  misc_feature (412)..(412): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaaatgtcgctggcaacatggttggaattggattaggcagtccccgtcgagaggcctgagtggcttggaagactattatacgtcccagtggtatgaagactatgcagatctgtgagcggtcgtctcacactccacccagaccacgtaccaagatcagtctcccnccactatctctgtacacctccgacgactacggtctacgtttatttacgtgtctaaggtaggactacgtactagttcggtagtaccctaccttccgttcgtactaccgtcggggccgtaggggttaaccgg

SEQ ID NO: 212470 - DNA, 544 bp, Homo sapiens
  misc_feature: GYAE6OF01ERVGI.21.27.C05.1.454.CMB.1.raw
  modified_base (359)..(359): a, c, t, g, unknown or other
  misc_feature (359)..(359): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaaatgtcgctggcaacaatggttggaattggattaggcagtccccgtcgagaggcctgagtggcttggaagacctattatacgtcccagtggtatgaagactatgcagnttctgtgagcggtcgtctcaccatccaccccgagacacgtccaagaactcaggtcctccctaccacctaatgtactgtccacctcccgacgacacggtctagtttattttcgtgtacaaggaggtatcgactagttcggtgtacctacctccttcgacctccggtcgggccgtagggttaaccgg

SEQ ID NO: 212471 - DNA, 793 bp, Homo sapiens
  misc_feature: GYAE6OF01D26SS.21.27.C05.1.454.CMB.1.raw
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtgtcgtccggaggggggcnccgcccacctctccngcacacgccagtccagtcctagtcgcgtgacttggttacgccgtacggtaaccgagacaagtaaactccgtacggcccgtacggcccttaccccgacgggtccctttcctccgttaacgttttaaccccggtggaccctactccccgaaccggaccgggaccctacggttcgggtaccgtcccgaagtaccgtacggtttccgaacgggtgggtcggttagggtaggtttacgggaacgttaggttaccgtttttctacctaccgaacctacgtccgtaaccggcccgtacccaaacggtacggtaaggttaaggtaacgttagttggtttacgtacgtttaaggtttttacgtttcgttaccggtaaccgtaaggttaacttaacgttaagtttaacgtttaccggttccggttaccgttcgggttaccggttaccgggtaccggttacccgggacccggtaaaccgggtaaccggtaaacgggttaaaggtaaaccgttaaaccggaaagtaccgggttagtcccggtacgtaccgtacctaccctaagtttcccgtgttccgttaccccg

SEQ ID NO: 212472 - DNA, 653 bp, Homo sapiens
  misc_feature: GYAE6OF01AMG47.21.27.C05.1.454.CMB.1.raw
  modified_base (202)..(202): a, c, t, g, unknown or other
  misc_feature (202)..(202): n is a, c, g, or t
  modified_base (382)..(382): a, c, t, g, unknown or other
  misc_feature (382)..(382): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtaccagcagaatctggccaggcctcccaggccttcctctactttaccgtgcactcccacgacgggcccacgtggtcgtcccgagacaggttcaggtggcggtggtagtttgggactaggtacgttttcnctacacctatccgacgccgtaccctacgagacgtagaacgtattggttagacgttaagttttactttccgtagaccctaagtacctaaattaacgtttaaacgtttaccgtcgggtacccttcggaccggttaccggttaacccgggttccgggacccggtaaccggggaacccgtaaacggggttaacggaaaaccgtaccggaaaaccggtacgttgggtacccgggtactacggaccctaaccctagtttccctacggttcttacccg

SEQ ID NO: 212473 - DNA, 801 bp, Homo sapiens
  misc_feature: GYAE6OF01BAZV0.21.27.C05.1.454.CMB.1.raw
  modified_base (163)..(163): a, c, t, g, unknown or other
  misc_feature (163)..(163): n is a, c, g, or t
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccatggatgattgtgatgacgnagtctccagccaccctgtctgtgtctccgaggggggacnccgccacctctcctgacacgacgccagtcagtctatcgctagtacgttggttacgtccgtacggtaccgagacgtaagtaaactcgtacggaccgacggtcctacccgacggtcctacctacgttaacgtttaccgtgtacctaccgtacccgaaccggtacgggtacctacggttcggtaccgtacccgaaggtaccgtacggtacgacgggtcggggtacggttacggtaggttacgggaacgttaggtttaccgttttcaccgtaccgtaacgtacgtaccgacgtacccgtacccgtaacggtaacggtaacggttaaacgttaaaacgttcggttacggttaacgtttagttttaacgtttcggtaccgtaaccgtaacgttaacgttaaacgttaaacgttaacgttaccgtaccgggtaccgtacgggttacccggttaccggttaccgggttacccggacccggtaaaccgggtaaccggtaaacgggtaaaccggtaaaaccgtaaccggtaaacggttaacggttacgggtaccggtaccgtaccgaaccgtaaccgttacgttacgttacgttccgttaccgttaccg

SEQ ID NO: 212474 - DNA, 612 bp, Homo sapiens
  misc_feature: GYAE6OF01ANXT9.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgacttggttacgcctggtaccagacagaactcgtggccaggcctccccgaggcctcctctacgtttacccgtgcctactcccaccgtacgggccctacgtcggtcgtcccgaagtacgtaggttcgaggtcgggcggttaggtagtttcgggaactaggttacgtttttctcctactacctataccgtacgccgtaccctaacgacggtagtagaagtagtggttagtacgttagttttacttcgtcgaccgtagtactaattacttaattaccgtggtacctgcgttaccgtacgttacggacgaaccgggtacgaaaggtacgtaaacgtacgaaacgacgtggtacggtcacgacactatccgtgtctac

SEQ ID NO: 212475 - DNA, 549 bp, Homo sapiens
  misc_feature: GYAE6OF01CXY16.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatgggggtgtcctgtcacagatcaaactacagcagtctggtccaggactggtgaggccctcgcagaccctttcactcacctgtgacatctccggggaaatgtcgctggcaacaatggttggaattggattaggcagtccccgtcgagaggccttgagtggcttggaagcctattatacgtcccagtggtatgaagactatgcagattctgtgagcggtcgtctcaccatccaccccagacacgtccaagaactcaggtcctcccctccacctaatcgtctcgtcactccccgacgaccacggctagttttagttttgtagcgtaaggagggtatcgtacgtattacgggtgaccttaccgtcctttgaccttcgtcggggcctagggggttaacccg

SEQ ID NO: 212476 - DNA, 574 bp, Homo sapiens
  misc_feature: GYAE6OF01B1GYF.21.27.C05.1.454.CMB.1.raw
  modified_base (203)..(203): a, c, t, g, unknown or other
  misc_feature (203)..(203): n is a, c, g, or t
  modified_base (386)..(386): a, c, t, g, unknown or other
  misc_feature (386)..(386): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccagggggganccgccaccctctcctgcacagccagtcagtctatcgctgactggttagcctggtaccagcagaatctggccaggcctcccaggcctcctctatttaccgtgcactcccaccgagggcccacgtggtcgtcccagacctaggttcaggtgggcggtggtagtttggggactaggtacgttttcnctccacctagtccacgcccgtaccctaacaggtacgtagaagtattgttgacttagttttacttcgtgcctagactaattattaacttacgtcggtcctggtccgtcgtaccggttccggaccgacgggaccaagggtacgaaactacgaaacgtacgtgtacggctacgccacctatctgtccttac

SEQ ID NO: 212477 - DNA, 724 bp, Homo sapiens
  misc_feature: GYAE6OF01ECEMZ.21.27.C05.1.454.CMB.1.raw
  modified_base (203)..(203): a, c, t, g, unknown or other
  misc_feature (203)..(203): n is a, c, g, or t
  modified_base (311)..(311): a, c, t, g, unknown or other
  misc_feature (311)..(311): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaatcgtggccacggcctcccgaggccttcctactacgttttacccgngcctactcccaccgacgggccctacgtcggtccgtacccagaccgtacggttcaggtcgggcggtgggtagtttcggggaactaggttacgtttttcctacctacctaacccgtacttaccgaaccgtccccgtacccctaacgaacgggaacggttaggaaaggtagtttcgggtttagtaccgtttaaggtttttacttttcgtacgtacccgtaagtaactaaagtttaacgttaaacgtttaccgtcgggtacccttacggtaccggttaccggttaccgggtttaccggggaaccggtaaaccggggtaccgtaaaacggggttaacggtaaaccgtaaccgtaaaacgtacggttcggtacgggaccgttacggtaccctaacctagttaccgttgttcccttaccg

SEQ ID NO: 212478 - DNA, 590 bp, Homo sapiens
  misc_feature: GYAE6OF01B77S3.21.27.C05.1.454.CMB.1.raw
  modified_base (373)..(373): a, c, t, g, unknown or other
  misc_feature (373)..(373): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatgggggtgtcctgtcacagatcaaactacagcagtctggtccaggactggtgacggccctcgcacgtaccctttcacctcacctgtgacactcgtaccggggaaatgtcgctggcaacatggttggaattggattaggcacgtccccgtgagaggtcctgagtggcttaggaggactattatacgtccagtggtagtagaagactatgcagattctgtgngcgtcgtctcacactccaccccagacacgtaccaagaactcgagtccctccctacctacctaatacgtactcgtccacctcccgaccgaccgtacggtcttaagttttacgtttacgtcgtacgtaacggaggtaactaccgacgtacgttcggtacgttacctacccgttccgttacgaccttacccgggtcgggtaccggtacgggtttaaccgg

SEQ ID NO: 212479 - DNA, 783 bp, Homo sapiens
  misc_feature: GYAE6OF01DIZAH.21.27.C05.1.454.CMB.1.raw
  modified_base (204)..(204): a, c, t, g, unknown or other
  misc_feature (204)..(204): n is a, c, g, or t
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (304)..(304): a, c, t, g, unknown or other
  misc_feature (304)..(304): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgctttctctggctcccagacaccactggagtgattgtgatgacgcagtctccagccaccctgtctgtgtctccgagggggacncgccaccctctcctgcacagccagtcagtctancgctgctggttacncctgtaccagcagaatctggcaggcctccgagcctcctactacgttttaccgngacctactcccgaccgtacgggccctacggttcggtcgtaccccgaaggtaaccgtacgggtttaccgaacgggttcggggtacggggtttagggttaacggttttcgggggaaccttaagggtttacgtttttttcctacctttaccacccgtaacttccgaacggtcccgtaacccgtaacgaacggtaacggttaggaaacgttcgttacggtttcgtaacgtttaacgttttttacgtttccgtaccgtaccgtaagtaaccgttaaatttaacgttttaaacgtttaaccgttccggtacccgttacgggtaccggtttacccgggttaacccgggtttccgggaaccccgggttaaccgggtaaaccggtaaacggggttaacggtaaaaccgttaaccggtaaaaccggtacggttcggttacggaccttacggacccttaccgtaacgttcgtttcgttaccgtttacccg

SEQ ID NO: 212480 - DNA, 551 bp, Homo sapiens
  misc_feature: GYAE6OF01ERMPU.21.27.C05.1.454.CMB.1.raw
  modified_base (205)..(205): a, c, t, g, unknown or other
  misc_feature (205)..(205): n is a, c, g, or t
  modified_base (306)..(306): a, c, t, g, unknown or other
  misc_feature (306)..(306): n is a, c, g, or t
  modified_base (415)..(415): a, c, t, g, unknown or other
  misc_feature (415)..(415): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggganccgcccaccctctccctgcacagccagtcagtctatcgctgacttggtagcctggtaccagcagaaatctggccaggctcccaggctcctctatttaccgngcactcccaccagggcccactcggtctacccagactaggttcaggtggcggtgagtttgggactagtagtttctctcaccagtcacgtcgccctagagtacgtgaagtntgttgacttagttttattcgtagccaagtcaattataattcgtggtcctgtcgttcgacggttccggccgaccgggtaccaaggtacgaaactaccgaaagtacgtggtacggctacgaccactatctgtcttacg

SEQ ID NO: 212481 - DNA, 548 bp, Homo sapiens
  misc_feature: GYAE6OF01A3OJR.21.27.C05.1.454.CMB.1.raw
  modified_base (203)..(203): a, c, t, g, unknown or other
  misc_feature (203)..(203): n is a, c, g, or t
  modified_base (270)..(270): a, c, t, g, unknown or other
  misc_feature (270)..(270): n is a, c, g, or t
  modified_base (421)..(421): a, c, t, g, unknown or other
  misc_feature (421)..(421): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatcnggccaggcctcccaggcctcctctacttttaccgtgcactcccaccgagggcccacgtggtcgtcccagacctaggttcaggtgggcggttggagtttgggactaggtacgttttctctcaccatcagccgtccctagagtagtagaagtnttgttgcttagttttattctgaccagtactaattattaattacgtgtcctgcgttcgtacgttccggaccgacgggaccaaggtagaaactacgaaacgacgtggcgcacgccactatcttgtcttc

SEQ ID NO: 212482 - DNA, 750 bp, Homo sapiens
  misc_feature: GYAE6OF01BTVGH.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccagtggggtgtcctgtcacagatacaaactacagcagtctggtccaggactggtgacggccctcgcacgtaccctttcaacctcaccgtgtacgacacgttccgtaaccggggaaaatcggtccggcttacggaccaaacgtaagttgggttaggtaagtttgggaagtttacgggccgtaccggttcccccggtaggacggtacggtccgttaggaggttcggtacgttagggaacggtaccttaagttacgtaccgtaccgtaggttacggtaacgtaggaacgtactagtcgaccgtagtacttcgtggtacgtacggtccggttacgtcctaccaacctacgtacccgaaccccgagtaaccctaccggtaaccaaagtaaccttaccggtaccggttaccctacccctaacctaaccttaacttcggttacctccgtaccctaacccgtacccggaaccgtaccgtaccggttactttaggtttttacgttttacgacggtacgtaaggtacggtactacgtacgttacgttcggtactacccgttaccttaccgttacgtacgttaccggtcgggtaccgtacgggtttaaccg

SEQ ID NO: 212483 - DNA, 648 bp, Homo sapiens
  misc_feature: GYAE6OF01BW5X2.21.27.C05.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaatcgtggccaggcctcccgaggcctcctctattttaccgngccactcccaaccgagggcccaacgttcggtcgtcccgaggaccgtaggttccaagggtcgggtcggttagggtacgttttggggaactaggtacgtttttctccgtacacctataccgacgcccgtaccctacgaggtagtagaagtagttacgttggtacgtttagttttatttccgtcgtacctaagtactaaattacttaaacgttacgtcggtaccgtaggtccggttacggtaccggttaccggacccgaacggggtaccgtaacgggtaacgtaaacgtaccgtaaacgtacgtcggtacgtcgtacgacctaacgtacttcgttcgtctttaccg

SEQ ID NO: 212484 - DNA, 675 bp, Homo sapiens
  misc_feature: GYAE6OF01DOWAT.21.27.C05.1.454.CMB.1.raw
  modified_base (203)..(203): a, c, t, g, unknown or other
  misc_feature (203)..(203): n is a, c, g, or t
  modified_base (402)..(402): a, c, t, g, unknown or other
  misc_feature (402)..(402): n is a, c, g, or t
  modified_base (654)..(654): a, c, t, g, unknown or other
  misc_feature (654)..(654): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctggtaccagacagaatctggccaggcctcccgaggtcctcctactactttaccgtgaccactcccaccgacgggcccacgtcggtaccgtcccagtaccgtaggttcgaggtgggcggttaggtagtttgggactaggtacgttttccncgtaccgacctataccgacgcccgtaccctaagaggtacgtagtaaagtagttggttgtacgtttagttttactttcgtcgtacctaagtaacctaaagtttaacttaacgtttacgtacgggttaccttacggtccggttaccgtaccgggttaccgggacccggtaaccgggtaacccggtaaagggttaacggaaacgttaaaccgaaaacggtaccggttgggtacggtaccgtacgtacccgtaacncgtttacttcgttcgttaccc

SEQ ID NO: 212485 - DNA, 750 bp, Homo sapiens
  misc_feature: GYAE6OF01EUUNJ.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (306)..(306): a, c, t, g, unknown or other
  misc_feature (306)..(306): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggtancctggtaccagcaagaatctggccaggcctcccgaggtcctcctctactttaccgngaccactcccaccgagggccctacgttcggtccgtccccgaaggaccgtagggtttccaagggttcggggtccgggttagggtaacgttttcgggggaactaaggtttacggttttttccctccgtaccgtaaccctagttcccgaacggtccccgtaccccttaacgacggtaaggttaggaaagtagttacgggtttacgtaccgtttaaggttttttaactttccgtacgtacccgtaagtacctaaatttaacttaaactttaacggtcggtcccttagggtccggttaccggtaacccgggttaccgggaccccggtaaaccggggtaacccggtaaaggggtaacggtaaaacgttaaccggtaaaaaccggtacggttacgggtacggtaccgttacggtacctaacccgttagtttccgttcggttacccttaccg

SEQ ID NO: 212486 - DNA, 640 bp, Homo sapiens
  misc_feature: GYAE6OF01CZL5K.21.27.C05.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (303)..(303): a, c, t, g, unknown or other
  misc_feature (303)..(303): n is a, c, g, or t
  modified_base (382)..(382): a, c, t, g, unknown or other
  misc_feature (382)..(382): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctctcctgcacagccagtcagtctatcgntgactggttagcctggtaccagcagaaatctggccaggcctcccgaggcctcctcactttaccgngcctactccaccgagggccacgtggtctcccagactaggttcaggtgggcggtggtagtttgggactaggtagttttcnctacaccatcacgccgtccctaagagtagtagaagtattggttgtacttagttttactttcgtacgacctaagtactaaattaattaactttacgtacggtacctggtccgttaccggtaaccggttccggaacccggtaaccggggtaaccgtaaacggggttacggaaaaccgttaaccggtaaaacggtaacgttacgggtacgggtacgtacgggtacccctaaccgttagttaccgttgtttccctttaaccg

SEQ ID NO: 212487 - DNA, 719 bp, Homo sapiens
  misc_feature: GYAE6OF01BHP63.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctctgcacagccagtcagtctatcgctgactggtagcctggtaccagcagaaatcgtggccaggcctcccgaggcctcctctacgtttaccgtgccactcccacgacgggccacgtggtcgtcccagacgtaggtcgaggtgggcggtggtagtttgggactagtacgttttctcgtacctactactacgacgcccgtaccctacgacggtaggtagaagtagttgtttacggtacgttaaggttttactttaccgtagtcccgtaagtacctaaagtttaacttaaacgtttaccgtcgggtacccgttacgggtcccggttacggttacccgggtttaccgggacccggtaaacccgggggtaacccggtaaacggggttaaaccgggtaaaaacgttaacccggtaaaaccgggttaaacccggttacggggttacgggtaccccgttacgggtaaccccgtaaacccttagttttacccggttacgttttccccgtttaccccg

SEQ ID NO: 212488 - DNA, 784 bp, Homo sapiens
  misc_feature: GYAE6OF01CQPLB.21.27.C05.1.454.CMB.1.raw
  modified_base (204)..(204): a, c, t, g, unknown or other
  misc_feature (204)..(204): n is a, c, g, or t
  modified_base (253)..(253): a, c, t, g, unknown or other
  misc_feature (253)..(253): n is a, c, g, or t
  modified_base (312)..(312): a, c, t, g, unknown or other
  misc_feature (312)..(312): n is a, c, g, or t
  modified_base (500)..(500): a, c, t, g, unknown or other
  misc_feature (500)..(500): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggacnccgccaccctctcctgcacagccagtcagtctatcgctgactggttacncctggtaccagcaagaaatcgtggccaggcctccgacggtcttcctctacttttaccgngacctactcccaaccgagggcccctacgtcggtacgtcccgagaccgtaggttcacgggtgggcgggttaggtagttttacggggaactaggttacgtttttcctacctacgaaccctagttccgaacggtacccgtccccttaaacggagtaaacgggttaggaaacggttagtttacggggtttanaccgtttaaggtttttacgtttttaccgacggttacccctaaaggttacccttaaaagtttaacgtttaaacgtttaaaccccgggttgggtaacccccgttggttacccgggttacccgggttaaaccggggttttcccccgggaacccgggtaaccggggttaaaccccgaaaggggttaaacgaaaacgttaaacccgaaaacccgggttaaacgttgggtaaccgggttacctaccggtacccgtaaccctaagtttccctcggtttcccgtttaacccg

SEQ ID NO: 212489 - DNA, 722 bp, Homo sapiens
  misc_feature: GYAE6OF01DIX8F.21.27.C05.1.454.CMB.1.raw
  modified_base (202)..(202): a, c, t, g, unknown or other
  misc_feature (202)..(202): n is a, c, g, or t
  modified_base (439)..(439): a, c, t, g, unknown or other
  misc_feature (439)..(439): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtcgtccgagggggancgccaccctcgtcctgcacagccagtctagtctatcgctagtacgttggttacgtccgtacggtaaccagtacaagtaaactcgtacggaccgacggcctcccgaggtcctcctactacgtttaccggtgactacctaccgaccgtacgggtcctaacgtcggtaccgtacccaggacgtaggttacagggttcgggtcggttaggtagtttacgggaccttaggttacgttttccnctacctaccgtactcgaccgacccgtacccctaagaggtaacgtacggtaagtacgttcgtttacgtacgtttagtttttactttccgtagacccgttaagtacccttaaatttaacgtaaacgtttccgtacggtcccgtttacggtaccggttaccggtaacgggttccggaaaccggtaaccgggaaccgttaaagggtacggtaaactaacggaaacgttacgtcgggtagttacccgtaagtaccccttaagtaccttacgttccgttcgttaacccg

SEQ ID NO: 212490 - DNA, 561 bp, Homo sapiens
  misc_feature: GYAE6OF01AYH9G.21.27.C05.1.454.CMB.1.raw
  modified_base (476)..(476): a, c, t, g, unknown or other
  misc_feature (476)..(476): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcacgtccccgtgagaggccttgagtggcttggaaggcctattatacgtcccagtggtatgaagactatgcagtattctgtgaggtcgtcgtctcaccatccaccctagaccacgtaccaagaatcacggtcctccctccaacctatcgtctcgtcacctacccgacgacgtacggtcctagtttatttcgngtacgaagtgggacttcgactagttccggtgtaccctaccttaccgttcgtaccttccgtaccgggggtctacgggttaacccgg

SEQ ID NO: 212491 - DNA, 690 bp, Homo sapiens
  misc_feature: GYAE6OF01EMX6T.21.27.C05.1.454.CMB.1.raw
  modified_base (204)..(204): a, c, t, g, unknown or other
  misc_feature (204)..(204): n is a, c, g, or t
  modified_base (252)..(252): a, c, t, g, unknown or other
  misc_feature (252)..(252): n is a, c, g, or t
  modified_base (388)..(388): a, c, t, g, unknown or other
  misc_feature (388)..(388): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgccaccctctcctgcacagccagtcagtctatcgctgactggttancctggtaccagcagaatctggccaggctcccaggcctcctcactttaccgtgcctatcccaccgacggcccacgtggtcgtccccgagacgaggttcaggtcgggcggtggagtttcggggactaggtcgttttcncgtacacctacgttacgacgcccgtacccctaacgtaggtaacggtaggaaagtagttaggtttcgacgtttaacgtttttatttccgtacgtaccgtacgtacgttaaacttaacgttaaactttaccgttacgggtccttcgggtaccgttacccgggtaacgggtttcccgggaaccggtaaccggggaaaccgtaaacggggtaaaccgggtaaaacgtaccggtaaaaaccggtaacggttacgggtacgggtactaccggtaccgaaccgttacttacttccgtgttttaaccccg

SEQ ID NO: 212492 - DNA, 817 bp, Homo sapiens
  misc_feature: GYAE6OF01CQOFG.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatcaaactacagcagtctggtccaggactggtgacggccctcgcacgtaccctttcactcacctgtcgacatcgtaccggggaaatcgtcgcgtggacaaacgagttaggttaggtaagttggacgttaaggccgtaacggtcccccggtacggacgtacggtccgttaggacggttcgggtacgtttacggggaaacggtacccttaagtttaacgtaccggttaccccgtaaggttacgggttaagttacgggaaacgtaaccgttaagtggtacgtaacggtaacgttttcgtaggttacggtacggtccgggtttaccggtccttaccgaaccctaacgtacccctaacccccgaacggtaaccctaacccggtaaccgaaacggtaaacgttaccggtaaccggttacccttaccccgtaaccctaaacccgttaacttccggttacctcgttaccctaacccgttaccccggaaccggtaacccgtacgggttaccgtttaaggttttttaacttttcggtacgtaaccggtaaaggtacgggtaactacgtaacgttacggtttacggtccgtaaccttacccgttaccgttacggacccgttacgggtccggggtaccgttaacggggtttacccgg

SEQ ID NO: 212493 - DNA, 593 bp, Homo sapiens
  misc_feature: GYAE6OF01D4L2X.21.27.C05.1.454.CMB.1.raw
  modified_base (202)..(202): a, c, t, g, unknown or other
  misc_feature (202)..(202): n is a, c, g, or t
  modified_base (389)..(389): a, c, t, g, unknown or other
  misc_feature (389)..(389): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctcagccacctgtctgtgtctccgaggggggacncgccaccctctcctgcacagccagtcagtctatcgctgactggttagcctggtaccagcagaaatctggccaggcctcccgacggcctcctctacttttaccgtgcactcccaccgacgggcccacgtcggtcgtcccgagaccgtaggtcaggtgggcggtggtatttgggactagtacgttttcnctcacctatcacgccgtccctaacgagtagtagaagtattggttagtcgttagttttactttcgtgacctagactaagttaattaacgtttaccgtggtccgtgtccgttcggtaccggttcggacccgtaacgggtaccgaaagggtaggtaaacgtacgaaacgaacggtggtacggctacgacaactatcttcgtcttacc

SEQ ID NO: 212494 - DNA, 772 bp, Homo sapiens
  misc_feature: GYAE6OF01C4NS8.21.27.C05.1.454.CMB.1.raw
  modified_base (201)..(201): a, c, t, g, unknown or other
  misc_feature (201)..(201): n is a, c, g, or t
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
tcagtcgtcgctcgcacgaccggtgctcgatttagacgcgatcgaagggtttgggggaggaactgctcagttaggacccagacggagccatggaagccccagcgcagcttctcttctcctgcttctctggctccagacaccactggagtgattgtgatgacgcagtctccagccaccctgtctgtgtctccgagggggacncgccacctctcctgcacagccagtcagtctatcgctgacgtggtacncctggtaccagcaagaatctggccaggcctccgaggtcctcctctactttaccgngcactcccgacgacgggccctacgtcggtcgtaccccgaagtaccgtacggtttccaagggttcgggaccgggttagggtaacggttttcgggggaacttacgggtttacgttttttcccaccgttaccgtaaacccgtacgttaccggaaccggtcccgttacccccgttaaaggaacgggttaacggtaagggtaaaacgttaacggtttcgggtttaacgtaaccgtttaagggtttttactttccgtacggtacccctaaggttaactaaactttaacgtttaaacgttaccggttacgggtacccttacgggtacccggttaccgggttaaccccggtttacgggaaccccggtaaaccggggtaccgtaaaagggttaaccggaaaacttaccggtaaaacggtacgttcgggtacggtaccgttacgaccctacgtaagttccttacggttcccgttaaccg

SEQ ID NO: 212495 - DNA, 852 bp, Homo sapiens
  misc_feature: GYAE6OF01CIQFC.21.27.C05.1.454.CMB.1.raw
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccactggagtgattgtgatgacgcagtctccagccaccctgtctgtgtctccggagggggganccgccacctctccngcacngccagtcagtctagtcgctgacgtggttacgccgttaggtaccagacgaagtaaactcgtacggaccacggtacctcccggacggtccctttaccgttacttaaccgttttacccggtcgacctaaccgttaccccgaacccggtaccggggtacccctaacggtttcggggtacccgtaccccgaacggtaaccggttacggtttaccgaacggggttcggggtaccggggtttagggttacgggtttttacgggggaaccgttacgggttttaaccgttttttcctaccgttacccgtaaccgtacgttaccgaccggtaccccgtaccgttaacgggaaaggtaggttaacgtaacggttaagtttcgggtttaacgttacgttttaacggtttttacgttttccgtaaccgtaccgtaacgtaacttaaaagttaacgtttaaacgtttccggttaccggtaccgttacgggtccggtttacccggtaccgggtttcccgggaacccgggtaaccgggtaaccggttaaagggtaaccggtaaaacgtaaaccggaaaagttacggttcgggtacggtaccgacggtaacccctaccgttagtttacccgttgttccctttaccg

SEQ ID NO: 212496 - DNA, 525 bp, Homo sapiens
  misc_feature: GYAE6OF01EJ9F1.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaaatgtcgctggcaacaatggttggaattggattaggcagtccccgtcgagaggccttgagtggcttggaaggacctattatacgtcccagtggtatgaagactatgcagattctgtgagcggtcgtctcaccatcaccccagaccacgtccaagatcaggtctccctccacctaatcgtctgtcacctcccgacgaccacggctagtttattttgtcgcacgagggatcgactattcggtgactaccttcctgactcctcggggccagggtaacg

SEQ ID NO: 212497 - DNA, 582 bp, Homo sapiens
  misc_feature: GYAE6OF01DJ2EC.21.27.C05.1.454.CMB.1.raw
  modified_base (305)..(305): a, c, t, g, unknown or other
  misc_feature (305)..(305): n is a, c, g, or t
  modified_base (389)..(389): a, c, t, g, unknown or other
  misc_feature (389)..(389): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggacccgccaccctctcctgcacagccagtcagtctatcgctgactggttagcctggtaccagcaagaatctggccaggcctccgagcctcctctactttaccgngcactcccaccgacgggccacgtcggtcgtacccagacgtaggttcaggtgggcggtaggtagtttgggactagtacgttttcncgtcacagtcagccgaccctaacgagagtagaagtattgttcgtacttagttttcttcgtcgtaccagtactaaattaactaacttacgtcggaccgttgtcggtacgtacggttccgaccgtacgggactaagggtacgaaataccgaaagtacgtgtacggctacgacctaactagttactcgttcttacg

SEQ ID NO: 212498 - DNA, 692 bp, Homo sapiens
  misc_feature: GYAE6OF01AHLYS.21.27.C05.1.454.CMB.1.raw
  modified_base (159)..(159): a, c, t, g, unknown or other
  misc_feature (159)..(159): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctccagtggggtntcctgtcacagactacaaactacagcagtcgtggtaccaggactgggtacgacggccctcgcacgtaccctttcacctccaccttgtacgactacgtaccggtaccggggaaatcgtcgctaggactaactagttgggttagtaagttacggagttacggctaccggtccccggtaggacggtcgtaccgttggaggtcggtacgttacgggaacgtactacgttacgtaccggttaccgaggttcggtaactaggtaaacgtacgtacgtcggacgtagttagttcgtcggtacggtacggtccggttaccgtccgtacctaccgtacctacccgaacccgtacgaccgacccgttaacgaacgtacgtaccgtacgttccctaccctaccgtacttactcgtctaccgtacctccgtacccgacgaccgtacgttacgttacgtttagttcgacgtacgtagtacgtactacgtcgttagttcgtctaccgtcgtcgttccgtacgtaccggtcggtacgtacggttaccg

SEQ ID NO: 212499 - DNA, 708 bp, Homo sapiens
  misc_feature: GYAE6OF01D62Q7.21.27.C05.1.454.CMB.1.raw
  modified_base (366)..(366): a, c, t, g, unknown or other
  misc_feature (366)..(366): n is a, c, g, or t
tcagtcgtcgctcgcacgaccggtgctcgatttagacgcgatcgaagggtttggggggaagaggaagactgacggtcctgccacaggtggtgctgggcacggtgggccctcgcagaccctttcactcacctgtgacatctccggggaaaatgtcgctggcaacaatggttggaattggattaggcagtccccgtcgagaggccttgagtggcttggaaggacctattatacgtccagtggtatgaagactatgcagattctgtgagcggtcgtctcaccatccaccccagacacgtaccaagaactcaggtcctccctccacctaatgtctgtcacctcccgacgacacggctagttttattttgngacaaggaggtactcaactagttcggtacgtaccttaccttccttacgaccttcccggtcggggacccgtacggggtaaccgtttcgtaccctaccgttcctaccgtccaccgtcccctaccaacccgaaccgggtccccaacgtttcccggttccccttccccccggtcgggtcccgtcccccgttggaccccttacccggaacggtccgccctacccgtccgggtaacgaccggtcccaacggtaccggccccgggtacccgtcggggcccttccggcccggttacgggtaccggtaaaccgggtaccctttaccccggttccccgggaggtaccccggg

SEQ ID NO: 212500 - DNA, 696 bp, Homo sapiens
  misc_feature: GYAE6OF01CZS9F.21.27.C05.1.454.CMB.1.raw
  modified_base (201)..(201): a, c, t, g, unknown or other
  misc_feature (201)..(201): n is a, c, g, or t
  modified_base (390)..(390): a, c, t, g, unknown or other
  misc_feature (390)..(390): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccacctgtctgtgtctccgagggggganccgccaccctctcctgccacacgccagtcagtctatcgctgacgtggttacgccgtggtaccagacaagtaaactcgtggccaggcctccccgaggtccttcctactacgttttaccgtcgtaccacttcccaaccggaccggtccacgtcgggtccgacccgaaggacgtaggttcgagggtcggggnggttggtagtttcgggactaggtcttttctctccacctactcgacggcccgtacccgtaaccgtaggaacgtaggaaagttagttggtttcgtacgtttaagtttttctttaccgtacgtacccgtaagtaccttaaatttaacttaactttacggtcgttaccgtcggttccggttaccggtaccggtttaccggaacggtaaaccggggtaaaccgaaagggtaaggaaaacgtaaccgtaaacgtaacggttcggtacggtactacggtaccgtaccgtaacttcgttcgttcgtttaacccg

SEQ ID NO: 212501 - DNA, 783 bp, Homo sapiens
  misc_feature: GYAE6OF01DDM4V.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccacctgtctgtgtcgtccgaggggggacnccgccaccctctcctgccacacgccagtcagtctatcgctgactggttacgcctaggtaccagacaagaaatcgtcggaccaggcctcccgacggtcctcctctacgtttaccgcgccactcccgaccgacggaccctacgtcggtccgtacccaggtacgtacggtttcagggttcggggtcgggttagggtacgttttacggggaacttaacgggtttacgtttttcctaccgttaccctaacctacgttccgaaccggtaccccgtacccccgttaacgaaggttaacggtaaggtaaacgtaagtttcgggttacgttaaccgtttaaggttttttacctttccggtacgtacccgtaagtaacttaaacgtttaatttaaacgtttaccggttaccggttacccgttacgggttccggttaccgggtaccggttttacccggggaaccggtaaaacccggggtaccggtaaaaggggttaaccggtaaaacgttaaccggtaaaaccggttacggttacgggttaccggtacgttcgaccctaaccgttacgttccgtaccgttccgttaacccg

SEQ ID NO: 212502 - DNA, 816 bp, Homo sapiens
  misc_feature: GYAE6OF01AIIQC.21.27.C05.1.454.CMB.1.raw
  modified_base (204)..(204): a, c, t, g, unknown or other
  misc_feature (204)..(204): n is a, c, g, or t
  modified_base (238)..(238): a, c, t, g, unknown or other
  misc_feature (238)..(238): n is a, c, g, or t
  modified_base (335)..(335): a, c, t, g, unknown or other
  misc_feature (335)..(335): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggganccgccaccctctcctgcacagccagtcagtctancgctgacgttggttacgcccgttaggtaacccagaccgaagtaaacttccgtcggaccacggcctccccgagggtccctcctctacgttttacccgngccactcccgaccgacgggccctacgttcggtcgtaccccgaaggtaccgtagggtttcagggttgggcgggttgggtagtttcggggaacttagggtttacgttttttccctaccgttcccaaaccgtacttaccgacggtacccgtacccgtaacgaacggtaacggttaaggtaaacggttacggttacggtttacggtacgttttaacggtttttacgttttccgttacggtaccctaacgtaaccgtaaatttaactttaaacgtttaccggttaccgggttaccgttaccgggttaccgggttacccgggttaacccgggtttaccccgggacccgggtaaaccgggtaacccgggtaaaggggtaaccggtaaaaaccgttaacccggtaaaaccgggttaacggttacgggtaccggtaccggtaccggtaacccgtacccgttacgttaccgtttccgtttccgtttacccg

SEQ ID NO: 212503 - DNA, 573 bp, Homo sapiens
  misc_feature: GYAE6OF01DAE91.21.27.C05.1.454.CMB.1.raw
  modified_base (456)..(456): a, c, t, g, unknown or other
  misc_feature (456)..(456): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatgggggtgtcctgtcacagatcaaactacagcagtctggtccaggactggtgaggccctcgcagacccctttcactcacctgtgacatcgtccggggaaaatgtcgctggcaacaatggttggaattggattaggcagtccccgtcgagaggccttgagtggcttggaaggtacctatatacgtccagtgtatgaagactatgcagattctgtgagcggtcgtctcaccatccacccagaccacgtccaagaactcacggtcctcccctccacctaactgtcctgtcaccgtcccgacgaccncggtctagttttacttttcggtcgtacgaagtagggatccgacgtagtttcggtcgtaccttacccttccgttacgtacccttcccggtacggggtcccgtaaggggtttaacccgg

SEQ ID NO: 212504 - DNA, 663 bp, Homo sapiens
  misc_feature: GYAE6OF01CSL4K.21.27.C05.1.454.CMB.1.raw
  modified_base (203)..(203): a, c, t, g, unknown or other
  misc_feature (203)..(203): n is a, c, g, or t
  modified_base (430)..(430): a, c, t, g, unknown or other
  misc_feature (430)..(430): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtgtcgtccgagggggcnccgccaccctctcctgccacacgccagtcagtctactcgctgtacgttggttacgccgtggtaccagacaagtaaatcgtcggccacggcctaccccgacggtcctccttactacgtttaccgcgcctactacccgaccgacggtccctacgttcggtccgtcccgaagtacgtacggttacgagggtcgggcggttaggtagtttcgggaacttagttcgttttcncctactacctatcgacgcccgtacctacgaggtagtagaagtgttagttcgtacgttagttttacttcgacgtactagtactaaattacttaacgttacgtcggtccgtcggtccgtaccggtaccggttaccggaaccggtaacgggtaaccggtagggtaacgtaaaccgtaacggaaacggttacgtcggtacggtctacgtaccgtacctagttctcgttacttacccg

SEQ ID NO: 212505 - DNA, 696 bp, Homo sapiens
  misc_feature: GYAE6OF01DHIFM.21.27.C05.1.454.CMB.1.raw
  modified_base (202)..(202): a, c, t, g, unknown or other
  misc_feature (202)..(202): n is a, c, g, or t
  modified_base (324)..(324): a, c, t, g, unknown or other
  misc_feature (324)..(324): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagcccaccctgtctgtgtctccgaggggggnccgcccaccctctcctgccacacgccagtcagtctatcgctgtacgttggttacgccttagggtaccaggacaagtaaactcgtggaccgaggcctcccgaggccttcctctactttaccgngaccactacccgaccgacggccctacgtcggtcgtcccagtaccgtaggttcagggtcgggtcggtagggtagtttacggggactagggttacgtttttccaccgttaccaacccgtagttccgaacggtacccgtaccctaacgtaacggtaaggttaggtaacgttagttacggtttacgtacgtttagtttttacttcgtacgaccgtagtaactaacttaattaacgttactcggtcctacggtccggttaccggtaccggttaccggaacggtaaaccgggtaacgtaagggttaacggaaacgttaacgaaacggttacgtacggttacggctcgtaaccctacgtattccgttgttcccgttacc

SEQ ID NO: 212506 - DNA, 788 bp, Homo sapiens
  misc_feature: GYAE6OF01AGWRV.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccaccctgtctgtgtctccgaggggggacncgccaccctctcctgcacagccagtcagtctatcgctgacgttggttagccgtggtaccagcaagaaactcgtggccacggtcctacccgacggtcctcccttactacttttaccggtgcctactccgaaccgacgggccctaccggttcggtaccgtacccgaaggtaccgtaacgggtttcgagggttcgggccgggttagggtaacggtttcggggaacttacggtttacgtttttccgccttactaccgtactaccgacgtcccgtaccccgttaacgaacggtacggtaaggtaaagtacgttacggttacgtacgtttacggtttttaacgtttccgtacggtaccgtaacggtaactaaatttaacgtttaaacgtttaccggttaccgggtacccgttcgggtacccgtttaccgggttaacccgggtttaccggggaaccgggtaaaccgggtacccggttaaagggggttaaacggtaaaacgttaaaccggtaaaaccgggttaacggttcggggttaccggtaccgttacggtaaccctaacccgttacgttcctttcggttccctttacccg

SEQ ID NO: 212507 - DNA, 796 bp, Homo sapiens
  misc_feature: GYAE6OF01BSGRJ.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgaccgtgctgggcctcccagtggggtgtcctgtcacagatcaaactacagcagtctggtccaggactggtgacggccctcgcacgtaccctttcactccaccgtgtacgactacgtccgtaaccggggtaaaattcgtaccggacgttaggacctaaacgtaagttgggttaggtaagtttaggtaagtttacgggcgtaaccggttacccccggtagggtaacggtaccggtccgtttaggacgggttacggtaccgttagggaaaccgggttaccttaacgtttaacgtaaccggttacccgtaggttacggtacgtaggaaacgtacgtaagtcgacgtaagtacgttacgtacggtagacggttccggtacgttactacctaaccgtacttacccgaaccccgtacgaaacctaacccgtaacgaacgtaaacgttcgtaaccggttcccttacccgtaacccgtaacgtacttcgtaccgtacggttaactacccggtacccgaaccgtaaccgtaccggttacctttaggttttacttttacggaccgtaccggtaaaggtaccggtaacttaccgtacgttaggttccggtacgtacccttacccgttaccgttcgtaccgttaccgggtacgggtaccgtaacgggttaacccg

SEQ ID NO: 212508 - DNA, 565 bp, Homo sapiens
  misc_feature: GYAE6OF01BIJMG.21.27.C05.1.454.CMB.1.raw
  modified_base (321)..(321): a, c, t, g, unknown or other
  misc_feature (321)..(321): n is a, c, g, or t
  modified_base (416)..(416): a, c, t, g, unknown or other
  misc_feature (416)..(416): n is a, c, g, or t
  modified_base (463)..(463): a, c, t, g, unknown or other
  misc_feature (463)..(463): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtgacagtctccggggaaaatgtcgctggcaacaatggttgaattggattaggcacgtcccgtcgagaggcctgagtgcttggagctatntacgtcccagtggtatgaagactatgctagattctgtgagtcggtcgtctcgaccacgtcacccctagacgacgtacaagatcgacgtcctcccncaactactcgtactcgtccaccgtccgacgaccgtacgcttagtttntttacgtgtactaacgtagggacttacgacgttagttcggtacgaaccgtaccttcccgttacgaccgttacccggtcggggtccgtaaggggttaacccgg

SEQ ID NO: 212509 - DNA, 544 bp, Homo sapiens
  misc_feature: GYAE6OF01B9MEX.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtgagaggccttgagtggctggaagacctattatacgtccagtggtatgaagactatgcagattctgtgaggcggtcgtctcaccatccacccagacacgtaccaagatccaggtcctccctccaacctaatcgtctcgtcaccgtcccgacgacacgcttagtttatttgacgtacgaaggtaggactctacgtagttacggtcgaccttaccgtccttacgaccttcggtcgggccgtagggttaaccg

SEQ ID NO: 212510 - DNA, 715 bp, Homo sapiens
  misc_feature: GYAE6OF01AV0J3.21.27.C05.1.454.CMB.1.raw
  modified_base (204)..(204): a, c, t, g, unknown or other
  misc_feature (204)..(204): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacncgccaccctctcctgcacagccagtcagtctatcgctgactggtagcctggtaccagcagaactcgtggaccacggcctcccgaggtcctcctactacgtttaccgtcgcactcccaccgacgggccctacgtcggtcgtcccgagacgtacggttcgaggtgggtcggttggtagtttaggggacttaggttacgttttactccgtacaccgtatccgacgcccgtaccctacgagtagtagaagtagttagttacgacttaggttttacttcgtacgaccgtacgtacttaaattacttaaacgttacgtacggtaccgttacgggtccgttaccgggttaccggtttaccgggaacccggtaaaccggggtaacccgttaaagggggttaaaccggtaaaacgttaacccggaaaaccgggtttaaccggttacgggttaaccgggtaccggtttacccgaaccgttaaccccgttacggttcccgtttgtttaccccgtttaacccg

SEQ ID NO: 212511 - DNA, 841 bp, Homo sapiens
  misc_feature: GYAE6OF01C50FQ.21.27.C05.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (242)..(242): a, c, t, g, unknown or other
  misc_feature (242)..(242): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtcgtccgaggggganccgcccaccctctcctgccacacgccagtcagtctancgntgacgttggttacgcctaggtaccagacaagaaactcgtggccaggcctcccgaggtccctacctctactttaccgtcgcctactcccgaaccgacgggtccctacgtcggtaccgtaccccgaagtacgtacggtttacgaacggggttcggggtcgggttaggtacggttttacgggaacgtaacgggtttcgttttttaccgccttaccgaacccgtacgttaccgacggtcccccgtaccccgttaagaacggtaacggttaaggaaaggttcgtttacgggtttacgttacgttttaacgttttttaacgttttccgtacggtaacccgtaaaggtaacccgtttaaatttaaacgttttaaaccggtttaaccgtttaccgggttaacccgtttcgggtaccggttccgggttaaccgggtttaccgggaacccgggtaaaaacccgggggttaaaccgtaaaacgggggttaacgggtaaaaaccggttaaaccgtaaaacccgggttaacggttacgggttaccgggttaccgttaaccggtacccgttaacccttaacggtttcccttaccgggtttaccctttaacccg

SEQ ID NO: 212512 - DNA, 778 bp, Homo sapiens
  misc_feature: GYAE6OF01DGVQG.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggcnccgccaccctctcctgaccacgagccagtcagtctatcgctgacgttgtacgccgtaggtaccagacagtaaactcgtcggaccacggcctacccgacggtccttaccctctaagttttccgagccaactcccgaaccgagggcccctacgttcggtacgaccccaagtaccgtaggtttccgaaggttcggggtacggttagggtaacggtttgggaaccttaggtttacgtttttcccacgtttacccgaccgtagtacccgtaacggtacccgaacccgttaacgacggtaaggtaacgaaagttacgttaggttcgtacgtttagtttttaacttcgtacgtacctaagtaaccttaaagtttaacttaaacgttaccgtacggtaccgttacggtacccggttccggttaaccggtttacccgggaacccgggtaacccggggtaaaccgtaaaacggggttaacgggtaaaaaacccgttaacggtaaaaccggttaacggtacggtttacccgggaaccgttaacggaccctaaacgttacccgtttactttacggttccctttaaccg

SEQ ID NO: 212513 - DNA, 865 bp, Homo sapiens
  misc_feature: GYAE6OF01DBQ8Y.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatcaaactacagctagtctggtccaggactggtcgacggccctcgcacgtaccctttcactccacctgtcgactagtccgtaccggggaaatcggtcgctggacaacaagttggttaggaattggaatttagggctacggtcccccggtacggacggtacgggtccgtttggaaggttcgggtacgtttaggggaaacgggtacccttaagtttaacgttaacccggttacccgtaaggttacggggtaacttagggtaaaacgtaacgttaagttcggacgtaacggtaacttttcggttaggttacggggtaaacgggtcccggggtttaccgggtttacccttacccgtaaacccgtaaccgttacccccaaacccccccggtaagtaaaccccgtaacccggttaacccgaaaacggttaaacgttacccgtaaccggggtttacccttaacccccccgttaccctaaacccgtttaacgttaccggtttaccttcccggttaccctaaccccgttaacccccgggaaccgtaacccggtaccggttaccgtttaaggttttttacgttttacggtacgtaaccgtaagggtacgggtactaccgtaacgttacgtttacggtcgtaacccttaccgttacccgttcggtaaccttcccgggtcggggtccggtagggtttaacccggg

SEQ ID NO: 212514 - DNA, 538 bp, Homo sapiens
  misc_feature: GYAE6OF01DXHXH.21.27.C05.1.454.CMB.1.raw
  modified_base (468)..(468): a, c, t, g, unknown or other
  misc_feature (468)..(468): n is a, c, g, or t
  modified_base (495)..(495): a, c, t, g, unknown or other
  misc_feature (495)..(495): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgtaccctttcactcacctgtgacatcgtaccggggaaaatgtcgctggcaacaatggtggaattggattaggcagtccccgtgagaggccttggagtggcgttggaaggacctattatacgtcccagtggtatgaagactatgcaagatttcgtgtgaggcggtcgtctcaccatccacccagacacgtcaagatcagtctaccctcctactatcgtctgtccactccgactacacggcttagtttatttgngatagacggtatcgtactagttcggtntacctacctcttcgaccttccgcggggtccgagggttaaccgg

SEQ ID NO: 212515 - DNA, 790 bp, Homo sapiens
  misc_feature: GYAE6OF01DFG4L.21.27.C05.1.454.CMB.1.raw
  modified_base (204)..(204): a, c, t, g, unknown or other
  misc_feature (204)..(204): n is a, c, g, or t
  modified_base (258)..(258): a, c, t, g, unknown or other
  misc_feature (258)..(258): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagccacctgtctgtgtccgtcgagggggacnccgcccacctctcctgcacacgccagtccagtctatcgcgtgacgttggttacnccgttggtaccgagcaagaaactcgtacggccgacggccttcccgacggtccctaccgttacctaccgttttaaccggtcgacctacctacccgaccggaccgggtaccctacggttcggtccgtcccgaaggtaccgtacggttcgacggtcggggtacggttagggtacggtttacgggacgtaggtttcgttttccgtacttaccgacctacgttaccgacgtcccgtaccctacgaaggtacggttagaaagtacgtttggttaccgtacgtttagttttactttacgtccgaaccgttagaacttaaagtttaacgtttaactttaaccggtccggttaaccgttccggtaccgggtttaaccggtacccgggtttccgggaaccccgggtaaacggggtaacccgtaaacggggttaaaggtaaaacccgttaaaccggaaaacggttaccggttacgggttacgggtaccgttaacccggtacttaaccccggtagtttaccgtttcgtttaccgtttaaccccg

SEQ ID NO: 212516 - DNA, 627 bp, Homo sapiens
  misc_feature: GYAE6OF01DWMXN.21.27.C05.1.454.CMB.1.raw
  modified_base (201)..(201): a, c, t, g, unknown or other
  misc_feature (201)..(201): n is a, c, g, or t
  modified_base (317)..(317): a, c, t, g, unknown or other
  misc_feature (317)..(317): n is a, c, g, or t
  modified_base (608)..(608): a, c, t, g, unknown or other
  misc_feature (608)..(608): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctcgaggggganccgccaccctctcctgcacagccagtcagtctatcgctgactggttacgccgtaggtaccagcaagaaactcgtcggaccaggccctcccgaggtccttcctactacgtttaccgngacctactcccaccgacgggccacgtcggtacctccgaagacgtaggttcagggtggcgggtggtagtttgggactagtacgtttctctacactatcgacgtccaccctaagagtagtagaagtagttaggttgtacgttagttttcttacgtcgtacctagtactaattaagttaactttacggtcgtccgtaggtccgtcgtacggttccggaccgtaacgggaaccgtaaagggtacgaaacgttaaccgaaacggtacgttcgggtacgccgtacgacctaacgttntaccgttgttcttaacccg

SEQ ID NO: 212517 - DNA, 713 bp, Homo sapiens
  misc_feature: GYAE6OF01B98O7.21.27.C05.1.454.CMB.1.raw
  modified_base (143)..(143): a, c, t, g, unknown or other
  misc_feature (143)..(143): n is a, c, g, or t
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (312)..(312): a, c, t, g, unknown or other
  misc_feature (312)..(312): n is a, c, g, or t
  modified_base (407)..(407): a, c, t, g, unknown or other
  misc_feature (407)..(407): n is a, c, g, or t
tcagtcgtcgctcgcacgaccggtgctcgatttagacgcgatcgaagggtttgggggaggaacgtgctcagttaggacccagacggagccatggaagccccagcgcagcttctccttcctcctgcttctctggctcccagacnccactggagtgattgtgatgacgcagtctccagccaccctgtcctgtntctccgagggggcncgccaccctctcctgcacgagccagtcagtcctatcgctgacgtggttagcctggtaccagcaagtaatcgtggcaggcctcccaggcctcctacgtactttaccgngcactcccacgacgggtcccacgttggtcctacccgagtaaccgtggtttccagggttcgggcggttagtagtttgggactaggttcgttttccncgtccgacagttcgacgtccgaccctaagaggtacgtagaacgtgttcgttacgcttaaggtttttacttcggtacgaccctaaggtaacctaaatttaacttaacttttccggtcggtcccttaggttacccggtttacggttaacccggttcccgggaaccgtaaacccggggtaaaccgtaaaacgggtaaccggttaaaacccgttacccggtaaaaaccggttaaccgggtttcggaccggggtaaccgttacggtaacccggacccttaaaggttccctttacgggttaaccctttcccg

SEQ ID NO: 212518 - DNA, 589 bp, Homo sapiens
  misc_feature: GYAE6OF01CMZ6V.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgaccctttcactcacctgtgacatcgtaccggggaaaatgtcgctggcaacaagtggttaggaattggattaggcacgtccccgtgagagccttgagtggcttggaaggacctatatacgtccagtggtatgaagactatgacagtattctgtgaggcggtcgtctcaccactccacccagacacgtacaagaactcacggtcctcccctacctaccttaatcgtactacgtaccaccttacccggaccgacgtaccggtacttagttttactttggtacgtacgaaggtacggtatccgtactacgttcggtacgtacccttaccttccgttacgtaccttccgggtcgggtaccgtacgggtttaacccgg

SEQ ID NO: 212519 - DNA, 632 bp, Homo sapiens
  misc_feature: GYAE6OF01BP4LM.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggcncgccaccctctcctgcacagccagtcagtctatcgctgactggttacgcctggtaccagacaagaaatcgtggccaggcctcccgaggcctcctctactttaccgtgccactccaccgacggccacgtcggtcgtccagacgtaggttcaggtgggtcggtggtagtttgggaactaggtacgttttctcgtcaccatcgacgccgaccctagagtagtagaagagttgtgtcttagttttattcgtcgtaccagtactaattaagttaacttacgtacggtaccgttaggtccgggttacggtaccgggtttaccggacccggaaccggggtaaccggtaaacggggtaacggtaaaacgtaaccggtaaaaccggtaacgttcgggtacgggtacctcgacccgtaccgtatcgttcgttcttaccg

SEQ ID NO: 212520 - DNA, 869 bp, Homo sapiens
  misc_feature: GYAE6OF01EMO1D.21.27.C05.1.454.CMB.1.raw
  modified_base (202)..(202): a, c, t, g, unknown or other
  misc_feature (202)..(202): n is a, c, g, or t
  modified_base (249)..(249): a, c, t, g, unknown or other
  misc_feature (249)..(249): n is a, c, g, or t
  modified_base (307)..(307): a, c, t, g, unknown or other
  misc_feature (307)..(307): n is a, c, g, or t
tcagtcgtcgctcgcacgaccggtgctcgatttagacgcgatcgaagggtttgggggaggaactgctcagttaggacccagaccggagccatggaagccccagcgcagcttctcttcctcctgcttctctggctcccagacaccactggagtgattgtgatgacgcagtctccagccacctgtctgtgtctccgagggggcncgccaccctctcctgcacagccagtcagtctatcgctgactggttanccgtggtaccagcaagtaatctggccaggcctccgaggtcctcctctacttttaccgngccactcccgaccgagggtcccacgttcggtacgtaccccaaggtaccgtaacggtttcgaagggttcgggacgggttaggttaacggttttacgggggaaccttagggtttaccgttttttaccgtaccgttaccgtaaacccgtacgttacccggtaaccggtccccggttaacccccgttaacggtaacggttaaccgggttaagggtaaaacggttacgttttacgggtttacggttaaccgttttaacggtttttttaacgttttacccgttaccgggtaacccgttaaacgggttaacctttaaaagtttaaacggtttaaaccgtttttaaccggttaccgggttacccggttaccgggtttacccgggttaaccgggttaccccgggtttacccgggaccccgggtaaacccggggtaaacccggttaaacgggggttaaacggtaaaaccgttaacccggtaaaaaccggttaaccggtttcggggtacccgtccgttaaccgggaacccttaacccgttagtttacccggtttcgtttacccgtttaccccg

SEQ ID NO: 212521 - DNA, 680 bp, Homo sapiens
  misc_feature: GYAE6OF01EMLBN.21.27.C05.1.454.CMB.1.raw
  modified_base (202)..(202): a, c, t, g, unknown or other
  misc_feature (202)..(202): n is a, c, g, or t
  modified_base (309)..(309): a, c, t, g, unknown or other
  misc_feature (309)..(309): n is a, c, g, or t
  modified_base (661)..(661): a, c, t, g, unknown or other
  misc_feature (661)..(661): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgcacagccagtcagtctatcgctgactggttacgccgtaggtaccagcaagaatcgcgccaggcctcccgaggcctcctctacgtttaccgngcactcccacgcggcccagtcggtactcccgacgacgtagttcgaggtcgggcggtaggtggtttacgggactaggttcgttttaccgtcgtacacctacgtaccgacgcccgtaccgtaacgtagaaccggtagaagtaacgttggttaccgtacggttttaagtttacgtttccggactacccggtagtaacttaacgttaacttacgtttaaccggtcgttacccgttaggtcccggttaccgttaacccgggttaccggacccggtaaccgggtacccgtaaagggtaacggtaaacgtttcccgaaaacggttcttacgggtagtacccgtacctaccgacgtttanacccgttagtttctaaccg

SEQ ID NO: 212522 - DNA, 821 bp, Homo sapiens
  misc_feature: GYAE6OF01ALFYL.21.27.C05.1.454.CMB.1.raw
  modified_base (132)..(132): a, c, t, g, unknown or other
  misc_feature (132)..(132): n is a, c, g, or t
  modified_base (145)..(145): a, c, t, g, unknown or other
  misc_feature (145)..(145): n is a, c, g, or t
  modified_base (213)..(213): a, c, t, g, unknown or other
  misc_feature (213)..(213): n is a, c, g, or t
  modified_base (577)..(577): a, c, t, g, unknown or other
  misc_feature (577)..(577): n is a, c, g, or t
  modified_base (668)..(668): a, c, t, g, unknown or other
  misc_feature (668)..(668): n is a, c, g, or t
  modified_base (698)..(698): a, c, t, g, unknown or other
  misc_feature (698)..(698): n is a, c, g, or t
  modified_base (745)..(745): a, c, t, g, unknown or other
  misc_feature (745)..(745): n is a, c, g, or t
tcagtcgtcgctcgcacgaccggtgctcgatttagacgcgatcgaagggtttgggggagggtaacgtggctcgagttaggacccgagacggagccatggaagcccagcgcagcttctcttcctcctgcttcnctggctccagacnccactggatgattgtgatgacggcagtctcagccaccctgtccgtgttcgtacctccgaggggggacnccgacccaccccttcgttcccgtgacctaccggaccgaccgtacgggttcctaacggttccttaacgttcccgggaccgttggggaaacccgttttcgggggttttaaccgcccccggtttaacgggggttaaccccaagggaccgtaaaagggttaaaactttccgggaccgggtaccccgaagggtacccttccccggtaaccgggacctttcccgttaccgtaacgtttttccccggaggacctaacttacccgacgacgggacctacgtccgggtatacccgaggaccttaaggggttcaacgggtttcgggcgggttaggttaaacggtttcgggaactacggggtttactttttaccncttaccaccgtaagtcccggacgttcccgacccttaacgaggtaacggtaccgaatacgttcggttactacgtttggttttatttaccggngacctaatactaacgttaataacgtttacnccggtacttggaaaccttcggaacggtttccgaccggtaaccgggancccgggttaaaagtaccgaaacggttaccacggttggaaccgctacggtaccgacacggtttcccttgttctaccg

SEQ ID NO: 212523 - DNA, 721 bp, Homo sapiens
  misc_feature: GYAE6OF01BWIG4.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttctcatcttcctgcccgtgctgggcctcccagtggggtgtcctgtcacagatacaaactacagcagtctggtccaggactgggtgacggccctcgcacgtacctttcactcacctgtgacatcgtacggggaaatcgtcgctggacaacgtaagtgggttaggtaattgggattagggaccgtacggtcccccgtaggacggacggtcccgtttgggaagttcgggaccgtttaggggaaacgggttacccttaagtttaacgtaacccggttacccgaaggttcgggtaagttacggaaagtacgtaagtcggtacaaggttaatttcgtggtaggacggtacgggttctacgttacacccgtacttacccaaccccgaacggtaaccgtaaccgtaccgaaacgtaacgtacgtacgggttccctaccctccgtaaacctattccggtctaccgttccaacccgttcccggaacgtaccgtacggttaacttacgttttaacgttttgacgtccgtaaaggtacggtactaccgtatacggttcggtacgtacctaccgtaccttaggtacctaccggtcgggtccgtggttaaccgg

SEQ ID NO: 212524 - DNA, 694 bp, Homo sapiens
  misc_feature: GYAE6OF01EB51C.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatcgtggccaggcctcccaggcctcctctatttaccgtgccactcccaccacgggcccacgtcggtcgtcccagacctaggttcaggtgggcgggtggtagtttggggactaggtacgttttctcgtccacctatccgacgtcccgtacccctacgaggtaagtaggaagtagttcggttgtaccgttagttttactttcgtacgtcccgtagtactaaattaacttaacgtttaccgtcgggtacccttggtacccggttaccggtacccggtttcccgggaccccggtaaccgggggtaacccgtaaacgggggttaacgggtaaaaccgttaacccggtaaaaaccgggtaaccggtttcgggtacgggtacccgttacgggacccctaaacccgtagtttcccgttacgttcccgtttaacccg

SEQ ID NO: 212525 - DNA, 539 bp, Homo sapiens
  misc_feature: GYAE6OF01EF4T6.21.27.C05.1.454.CMB.1.raw
  modified_base (468)..(468): a, c, t, g, unknown or other
  misc_feature (468)..(468): n is a, c, g, or t
  modified_base (512)..(512): a, c, t, g, unknown or other
  misc_feature (512)..(512): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctgcaacaatggttgaattggattaggcagtccccgtcgagaggccttgagtggcttggaagacctattatacgtcccagtggtatgaaagactatgcagattctgtgagcggtcgtctcaccatccaccccagacacgtaccaagaatcagtcctccctccacctaatgtctgtcactcccgacgaccgacggcctaagttttatttttgngtacaaaggagggatacgactattcggtcaacgtactaccgttnactccgtcgggccgtagggttaaaccg

SEQ ID NO: 212526 - DNA, 689 bp, Homo sapiens
  misc_feature: GYAE6OF01ALRRA.21.27.C05.1.454.CMB.1.raw
  modified_base (202)..(202): a, c, t, g, unknown or other
  misc_feature (202)..(202): n is a, c, g, or t
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (307)..(307): a, c, t, g, unknown or other
  misc_feature (307)..(307): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctancgctgactggtancctgtaccagcagaatcgtcggccgaggcctcccgaggtcctcctactacgtttaccgngctactcccgaccgcgggacccacgttcggtaccgtcccaaggtaccgtacggttcacggttcggggcggttaggtaacgtttggggaacttagggtttacgtttttaccctaccttacctaacccgtagtacccgtacggtaccccgtacccgtaacgaacgggttaggtaacgaaggttacgttcggtttacgtaccgtttagtttttacttccgttacgaccgtaatacgttaaattagttaaccgtttaccgtcggtccttacggtcgtaccggttacggtcccgggaccgtaaccgggacgtaaagggtacgaaacgttaccggaagtaccgttggacggtccgtacgaccgtacctagttccgttcgttccttccg

SEQ ID NO: 212527 - DNA, 751 bp, Homo sapiens
  misc_feature: GYAE6OF01DKVM3.21.27.C05.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggncgccaccctctcngcacagccagtcagtctatcgctagactggttagcctggtaccagcaagtaatcgtggccaggcctccccgagggccttcctctacgtttaccgtgaccacgtccaccgacgggtcccacgttcgggttccgtaccccgaggaccgtacggtttcgaacgggttgggtcgggttaggtacggttttaggggacctaacggttcgtttttcctccgttacctacctaacgtccgaacgtcccgtaccccgttaacgacggtaagtaggtaaggtaacgttagtttcggtacgttagtttttacgtttccgttacgtaccctaagtacgttaaacttaacgtttaaacgtttaccggttacggtacccgttacggtaccggttaccgggttaacccggtttacccgggacccgggttaaacccggggaacccgttaaacggggtacggtaaaaccgttaaccggaaaacgttaacggttacggtacggtacgtaccggtaccctaaccgttacgtttaccgttccggttacctttacccg

SEQ ID NO: 212528 - DNA, 665 bp, Homo sapiens
  misc_feature: GYAE6OF01D21GB.21.27.C05.1.454.CMB.1.raw
  modified_base (205)..(205): a, c, t, g, unknown or other
  misc_feature (205)..(205): n is a, c, g, or t
  modified_base (324)..(324): a, c, t, g, unknown or other
  misc_feature (324)..(324): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggggacnccgcccaccctctcctgcacacgccgagtcagtctatcgcgtgacgtggttacgcctacggtaccagacaagtaactcgtcggaccaggtcctcccgagtcctcctctacgtttaccgngacctactcccgaccggacgggtacctacgttcggtccgtacccgagacgtacggttacgagggttcgggtacggtggttacgttagggactagttacgttttccactacaaccgtactacgacgtcccgtaccctaagaggtagtagtaagtagttgttacgtagttagtttacttccgtacgtaccgtaagtaactaaattaacttaacgtttacggtcggtaccgttaggtccgttaccggttacggtaccggaacggtaaccgggtaacgtaagggtaagtaaacgtaaccgaaacgacgtcggtacgcgtacgacctacgtattacgtcgtcctac

SEQ ID NO: 212529 - DNA, 614 bp, Homo sapiens
  misc_feature: GYAE6OF01DZFLH.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgaccctttcactcacctgtgacatcgtaccggggaaaatgtcgctggcaacaatggttggaattggattaggcagtccccgtgagaggccttgagtggcttggaaggacctatatacgtccagtggtatgaagactatgcagattcgtgtgaggcggtcgtctcaccatccaccccgagaccacgtaccaaagtaactcgacggtcctcccctacctaccttaatcgttctcgtctaccgtacccgacgaccgtacggtcttagttttacttttcgtcgtacgtaaaggtagggtaactccgaacgttagtttaccgggttcgaaaccctttacccgttacccgttacgttaaccccgttccggttacgggggtcccgtaaggggtttaaacccggg

SEQ ID NO: 212530 - DNA, 743 bp, Homo sapiens
  misc_feature: GYAE6OF01A4NAX.21.27.C05.1.454.CMB.1.raw
  modified_base (228)..(228): a, c, t, g, unknown or other
  misc_feature (228)..(228): n is a, c, g, or t
  modified_base (373)..(373): a, c, t, g, unknown or other
  misc_feature (373)..(373): n is a, c, g, or t
  modified_base (730)..(730): a, c, t, g, unknown or other
  misc_feature (730)..(730): n is a, c, g, or t
tcagtcgtcgctcgcacgaccggtgctcgatttagacgcgatcgaagggtttgggggtagggaactgctccagttaggacccgagacggagccatggaagccccagcggcccagccttcgtcttccctccgtgccttctctggcctcccaggaccacccacgtgggacgtgattggtgactgaccgcagtctcccagcccaccctgtcctcgtgtctccgaggggganccgccgacccgtctccctgcaccacgtccagtcgacggtctagtcgcgtagacgttaggttagcccttagggtacccaggaccaaggaaactccgtacggacccgagggcctaccccgacggtacctcccttctacgtttaccgngcacgtcccaccgacgggtcccctacgtttacggtacgtaccccgaaggtaccgtacggttacgtaacgggttcggggtaccgggtaggggtaacggttttacgggggaaccttaacggtttacggttttttcccgaccttaacccgtaaccgttacttacccgaacgtccccggtaacccctacgaacggtacggtaacggtaacgtacgtttcggttacgtacgttacgttttacgttcgtacgtacctacgtacctaattacgttaacgttacgtcgtcgtacgtacgtacgtacgtaccgacgtaccggacgtaaggtaccgaaacgacgtaagcggtgacgacgacgctacncgtctcgtctacg

SEQ ID NO: 212531 - DNA, 789 bp, Homo sapiens
  misc_feature: GYAE6OF01CBLY1.21.27.C05.1.454.CMB.1.raw
  modified_base (200)..(200): a, c, t, g, unknown or other
  misc_feature (200)..(200): n is a, c, g, or t
  modified_base (319)..(319): a, c, t, g, unknown or other
  misc_feature (319)..(319): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccaccctgtctgtgtctcggagggggnccgccaccctctcctgcacacgcagtcagtctatcgctgtacgtggttacgccgtaggtaccagacaagtaatcgtcggaccgacggcctaccgacggtcctcctctaacgtttaccgngacctacgtacccgaaccggacgggtaccctacggttcggtaccgtaccccgaaggtaaccgttacgggtttccgaaggggttcggggtacgggttagggtttaaggtttacggggaacttaacgggtttacgttttttcccgaccttacccgaacctacttaccgtaccggaccccgtaccccgttaaaggaagggtacggttaaaggaaacgttagttagggtttacgtacgtttaacggttttttactttccgtacgtaacccgtaagtaacttaaagttaacgtttaactttaccgggttccggtacccgttacggtaccggttacggttaaccgggttaccggaaaccgggtaaaccgggtaaaccggtaaagggtaaacggaaacgtaaaccggtaaaacggtacggttacgggtacggtaccgtacgtaccctaaccgtactttccgttcgttccttaacccg

SEQ ID NO: 212532 - DNA, 648 bp, Homo sapiens
  misc_feature: GYAE6OF01EDMGO.21.27.C05.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
  modified_base (338)..(338): a, c, t, g, unknown or other
  misc_feature (338)..(338): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgacgtggttagcctggtaccagacagaaatctggccaggcctcccgaggcctcctctacgttttaccgngccactcccaccgaggcctacgtggtcnccagacgtaggtcaggtcggcggtaggtacgttgggactaggttacgttttctctaccacctattccacggcctacccctaagagtacggttagaagtagttcgttagactttagttttatttcgtgacctagtaactaaacttagtaacttacgtcggtaccttagggtccgttaccggtacggttccggaacccggtaacggggtaacccgtaaacggggtaaggtaaaacccgttaccggaaaacggttaccggttacggtacggtaccgtaccgacctaacccgtattcgttcgttccgttacccg

SEQ ID NO: 212533 - DNA, 527 bp, Homo sapiens
  misc_feature: GYAE6OF01EY5W3.21.27.C05.1.454.CMB.1.raw
  modified_base (467)..(467): a, c, t, g, unknown or other
  misc_feature (467)..(467): n is a, c, g, or t
  modified_base (491)..(491): a, c, t, g, unknown or other
  misc_feature (491)..(491): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtcgagaggccttgagtggcttggaagacctattatacgtcccagtggtatgaagactatgcagattctgtgagcggtcgtctcacactccaccccagacacgtaccaagaactcacggtcctccctccacctaatgtctgtcacctcccgacgacgtacgctagtttatttgngcgaagaggatcgactattcggtntactacctcttgactccgtcgggccgtagggttacg

SEQ ID NO: 212534 - DNA, 734 bp, Homo sapiens
  misc_feature: GYAE6OF01DRR35.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagtaccctttcactcacctgtgacatccgtaccggggaaaatcgtcgctggacaacaatggttaggtaattggattaggctacggtccccggtcgaggacggtccgttggaggtcgggtcttagggaaaggtacccttaagtttacgtaccgttcccgaggttcggtatagaaagtactagtgacagtattcgtgtcgaggtcggttcgtctacgtaccctatacccaacccccgaagaaccctaccggtaaccaaacgtacgtaccgtacgtacccgtacccctaccgtaacccttaagtcgtactccgtacctaacccgtacccgtaaccgtaaccgtaccggtacctttaggtttttacgttttcggtaggtaccgtaaagggtaccgggtaactaccggtaaccgttaaggtttacccgggtacgttaacccctttacccgtttacccggtttaccgtacccggtttaccccggggttaccggggtaccccgggttaaacgggggtttaacccggg

SEQ ID NO: 212535 - DNA, 654 bp, Homo sapiens
  misc_feature: GYAE6OF01DHEJB.21.27.C05.1.454.CMB.1.raw
  modified_base (302)..(302): a, c, t, g, unknown or other
  misc_feature (302)..(302): n is a, c, g, or t
  modified_base (420)..(420): a, c, t, g, unknown or other
  misc_feature (420)..(420): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagcccacctgtctgtgtctccgagggggaccgcccaccctctcctgaccacacgccagtcagtctatcgctgacttggtacgccgtaggtaccagcaagtaactcgtggccaggcctccagacctcctacnctaccaactaatatacttcctaagcgggccggcggtaccacgtccagacgtagtacgaggtcgcgtaggtcgggtcgtagggacctacggtaccttacgaccttcctaccaaccgtanaccgtacgtacgaacggacgttaggacgtaccgtaggtaaacttgttttacgaacgttagttacgtttacttacgtgtaacgagtacgtaattcgtacccgtccccgtaaccccgtaacccccgtacgtaccccgttacccggtaccggaacccggaacggtaacccgaccgttagaacggtcgaaagtaacgaaccgtaaaacgacggttaggtccggtacgccgtaaccccg

SEQ ID NO: 212536 - DNA, 873 bp, Homo sapiens
  misc_feature: GYAE6OF01DUHDE.21.27.C05.1.454.CMB.1.raw
  modified_base (229)..(229): a, c, t, g, unknown or other
  misc_feature (229)..(229): n is a, c, g, or t
  modified_base (346)..(346): a, c, t, g, unknown or other
  misc_feature (346)..(346): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacacccacgtggagtgatttgtgatggaccgcagtcctccacgcccaccctgtctgtgtcctccggaggggggcccgcccaccctctccngcacacgccagtcagtctatcgactgtacgttggttacgccgtcggtaaccatacgaagtaaacgtcctacgggcctacggccctacccgacggtcctccgtacttacgtttaccgngtccaaccgttcccgaaccggacggtacccgtaccggttcggttacccgtacccggaagaaccggtacggttagtcggggttacggggtacgggttagggttacggtttacggggaacgttaggtttaccggttttccttaaccgtaccgtaaaccctacgtaccgtaccggtacccgtaccccgttaacggaacgggtaacggttaaacggaaagggtttaaccgttggggtttaacttaaccggtttaagttttttaacccggtttcgttacccggtaaccgtaaacggtttaactaaaacgtttaagtttaaaccgtttaccggtaccgttcccggttacggttacccggtttacccggggttaaccggtaccccgggtaacccggggtaaacccggtaaacgggttaaaccgggtaaacggtttaaaacccgaacgggtaaacccggttaaacggttaacgggttccggaccgttacccggaaccttaccggacttttacccggttagttccccgttaaccgg

SEQ ID NO: 212537 - DNA, 754 bp, Homo sapiens
  misc_feature: GYAE6OF01D5ERR.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcccctccgagtggggtctctgtacacagactacaaactcgagctacgtcgtcggtaccgaaggccgttgggtacgaccggtccctcggactaccgttaccctttacacctcctaccgtgtacgacctacgttccggtaaccgggtaaattcgtccgtcgtacggaactaacgtagttggttaggtaagttaggtacgtaggccgtaccgtccccggtagacggtacgtccgtggtacggtcggtacgtaggaacggtacttagttacgtaccgtccgtaggtacggtagtacgtaacgtacgtagtgacgtaagttacttgtacggtagtacggtccgttcgtaccttaccgaccctaacttacccccgaaccgtacgtaacccgtaaccgtaacggtaaactacgtccgtacgttcccctacccctaaccgtacgtaagttccgtacttcgtaccctacccgtaccgaccgtacgtaccggttactttagtttacgttcgacgacggtaagtacggttacacgttacgttacggttcgtacccgttaaccgttcccgtaccgttacggtacccggttcggtaccgggtacggtaacgggtttacccg

SEQ ID NO: 212538 - DNA, 563 bp, Homo sapiens
  misc_feature: GYAE6OF01CJS6O.21.27.C05.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
  modified_base (342)..(342): a, c, t, g, unknown or other
  misc_feature (342)..(342): n is a, c, g, or t
  modified_base (419)..(419): a, c, t, g, unknown or other
  misc_feature (419)..(419): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgcccaccctctcctgcacagccagtcagtctatcgctgactggttagcctggtaccagcagaaatctggccaggcctccgaggcctcctcactttaccgncactccaccgacgggccacgtggtcgtcccagaaccgnggttcaggtgggcggtggtagtttgggactagtagttttcctctcaccatcagccgaccctacgacgtagtgaagtntgtgctagtttacttctcgcctagactaatataattacgtcggtcctcgtcgtacgtaccgttcggaccgtaccgggacgaaaggtacggtaaacgtacgaaacgtaacgtggtacggtcgtcgacctactatcttgtcttacc

SEQ ID NO: 212539 - DNA, 751 bp, Homo sapiens
  misc_feature: GYAE6OF01DQ9D0.21.27.C05.1.454.CMB.1.raw
  modified_base (200)..(200): a, c, t, g, unknown or other
  misc_feature (200)..(200): n is a, c, g, or t
  modified_base (309)..(309): a, c, t, g, unknown or other
  misc_feature (309)..(309): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctcagccaccctgtctgtgtctccgaggggganccgccaccctctcctgcacagccagtcagtctatcgctgactggttacgcctggtaccagacaagaaactctggccaggcctccgaggtcctcctctacgttttaccgngtccactcccaccgacgggccacggttcggtcgtcccgagacctaggttcgaggttgggcgggtggtagtttaggggactaggtttacgttttccaccttcgaacctattaccgaacgtacccgtacccctaacgacggtaagttacggaaagttagttggtttacgtacgtttaacggtttttaatttccgtacggtaaccccgtaagtaacccttaaagtttaaacgtttaaaccgttttacggtccgggttacccgttacggttaccgggtttacccggttaaccggggtttcccgggaaccccggtaacccgggggtaaaccgaaaaggggttaacggtaaaaacgtaacccggtaaaacggttaaccggttacgggttacccggtacgttacggtaacccgttaacccttagttccgtttccgttaccgtttacccg

SEQ ID NO: 212540 - DNA, 546 bp, Homo sapiens
  misc_feature: GYAE6OF01A60MO.21.27.C05.1.454.CMB.1.raw
  modified_base (203)..(203): a, c, t, g, unknown or other
  misc_feature (203)..(203): n is a, c, g, or t
  modified_base (264)..(264): a, c, t, g, unknown or other
  misc_feature (264)..(264): n is a, c, g, or t
  modified_base (383)..(383): a, c, t, g, unknown or other
  misc_feature (383)..(383): n is a, c, g, or t
  modified_base (413)..(413): a, c, t, g, unknown or other
  misc_feature (413)..(413): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgcccaccctctccctgccacagccagtcagtcctatcgctgactggttagcctggtaccngcagaatctggccaggcctcccagggcctcctctactttaccgtgcacgtcccaccgagggcccacgtggtcgtcccagacaggttcaggtgggcggtggattgggataggtattttcnctcacatcagccgcctagagagtagaagtntgttgctagtttattctgaccagactaattataattacgtgacctgaccgtcgtaccgttcggaccgacgggtaccaaggtacggaaactcgaaacgacgttggtacggtctagaccactatctgttccttac

SEQ ID NO: 212541 - DNA, 718 bp, Homo sapiens
  misc_feature: GYAE6OF01A719U.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgaccctttcactcacctgtgacatcgtaccggggaaaatgtcgctggacaactaagtggttaggaagttaggattagggctacggtccccgtcggagacggtcctttggagtgggtcgttagggaaacggtaccttaagttaacgtaccggttacccgaggttaggttaattaggaaagtacgttaagttaggacgtaaggtaatttcgttagggtacggacggtcgggttacccgtaccgttaccaacccgtaacttacccgaaccccccaaggtaaccctaaccggtaacccaaagtaacgtaccgaacgggttccctaccccgtacccaaccttaacgttcgttacgtacgtacctacccgtacccgtaaccgaccgtacggtactttaagttttacttttgacgtacgtaaggtacggtactaccgtacgtagttacggtctaccttacccgttaccttacgtaccgtaccggtacggggtccgtaacgggttaccgg

SEQ ID NO: 212542 - DNA, 899 bp, Homo sapiens
  misc_feature: GYAE6OF01DMCYL.21.27.C05.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccacgccaccctgtctgtcgtcgtccggagggggnccgcccaccctctcctgccacacgccagtcagtctagtcgctgaccttggttacgccgtaggtaccagacaagtaaactcgtacggccacggcctaccccgaggtcccttccctacgtacgttttaccggcgacctactcccgaaccggacgggtaccctacggtcggtaccgtacccaagaccgtaggttacgagggttcgggacgggttaggttacggttttacgggaacgtttaagggtttacgttttttccctaccgttacctaacccgtacgttaccgaaccgggtacccccgtacccccgttaaacggaacgggtaacgggttaaagggtaaacggttaacggttttagggtttaccggtttaaccgttttaaacgggttttttttaccgttttacccggtaccggttaacccgtaaaggtttaaacccgtttaaaagttttaaacttttaaaacggttttacccggtacccggggtttcccgtttaccggggtacccgggtttacccgggtttaacccgggtttccccggggaaaccccgggtaaacccgggggtaaacccgggttaaacggggttaaaccgggaaaaccttaaaccgggaaaacccgggttaacggttacgggtaccggtacgttaaccgtacccgtaacccgttactttaccgttccggtttaccgttaaccccg

SEQ ID NO: 212543 - DNA, 743 bp, Homo sapiens
  misc_feature: GYAE6OF01CI98L.21.27.C05.1.454.CMB.1.raw
  modified_base (262)..(262): a, c, t, g, unknown or other
  misc_feature (262)..(262): n is a, c, g, or t
  modified_base (366)..(366): a, c, t, g, unknown or other
  misc_feature (366)..(366): n is a, c, g, or t
tcagtcgtcgctcgcacgaccggtgctcgatttagacgcgatcgaagggtttgggggggaagaggaagactgacggtcctgccacaggtggtgctgggcacggtgggccctcgcagaccctttcactcacctgtgacatctccggggaaaatgtcgctggcaacaatggttggaattggattaggcagtccccgtgagaggccttgagtggcttggaaggacctattatacgtcccagtggtatgaagactatgcagattcngtgagcggtcgtctcaccatccaaccccagacacgtccaagaactcaggtcctccctccacctaatgtctgtcactcccgacgacacggctagttttattttgngacaaggaggatcactattcggtatactacctcttgacctccgtggggcctagggtaacgtttgacctaccgttcctacctcgacgtccctaccgaaccgtaacgggcccctaaggttcccgggttacccctttccccccggtacgggccccgttacccccgttcggtaccccgttcccggaacggggtacccgtaccccgtaaccccgttaccccgggaaggtaacccggtacccgaaacccggtaccggggacccccggggtcccccgttacgggggggtcccctccgggttacccccggttacgggggtaaccccgtaaaacggggttaccccctttaaccccgtttccccccggttccggttttaacccccgg

SEQ ID NO: 212544 - DNA, 672 bp, Homo sapiens
  misc_feature: GYAE6OF01A5FET.21.27.C05.1.454.CMB.1.raw
  modified_base (206)..(206): a, c, t, g, unknown or other
  misc_feature (206)..(206): n is a, c, g, or t
  modified_base (316)..(316): a, c, t, g, unknown or other
  misc_feature (316)..(316): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtcgtctccgaggggggacnccgcccaccctctcctgcacagccagtcagtctatcgctgacgtggttacgcctggtaccagcaagtaaatctggccaggcctacccaggcctccgtctacgtttaccgncactcccaccgaggtcccacgtcggtccgtacccagacgtacggttcaggtgggtcggtggtagtttgggactagttacgttttctctaccacctacgtccgacgtcccgtacccgtacgaggtacgtagaagtagttggtacgctttagttttacttccgtagtacccgtaagtactaaagtttaacttaacgtttacgtcgggttaccgttcggttacccggttaccggtaccggttacccgggacccggtaaacccggggtaccgtaaagggtaaccggtaaaaccgtaaccgtaaaccggtacggtcggtacggccgttaccgactaccctagttccttgttccgttacccg

SEQ ID NO: 212545 - DNA, 558 bp, Homo sapiens
  misc_feature: GYAE6OF01AI7RF.21.27.C05.1.454.CMB.1.raw
  modified_base (481)..(481): a, c, t, g, unknown or other
  misc_feature (481)..(481): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcgacctgtgacatctccggggaaaatgtcgctggcaacaatggttggaattggattaggcagtccccgtcgagaggccttgagtggccttggaaggacctattatacgtcccagtggtatgaagactatgcagattcgtgtgagtcggtcgtctcaccatccaccccagaccacgtaccaagaactcgaggtcctccctccacctaatcgtctcgtcaccgtcccgtacgactacggctaggttttacttttgngtccaaggtacggatacgactagttacggtctaccttaccctccgttcgacctcccgtggggtcctagggttaaccg

SEQ ID NO: 212546 - DNA, 619 bp, Homo sapiens
  misc_feature: GYAE6OF01EHFKU.21.27.C05.1.454.CMB.1.raw
  modified_base (202)..(202): a, c, t, g, unknown or other
  misc_feature (202)..(202): n is a, c, g, or t
  modified_base (311)..(311): a, c, t, g, unknown or other
  misc_feature (311)..(311): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggncgccaccctctcctgcacagccagtcagtctatcgctgactggttagcctggtaccagcaagtaaatcgtggccaggcctccccgaggcctcctctacgttttacccgngaccactcccgaccgacgggcctacgtcggtcgtacccagacgtaggttcgaggtggcggtgtagtttgggactaggtacgtttctctcacctatcgacgccgaccctagagtagtagaagtgttgtcgtacttagttttacttcgtcgtacctagtactaaattaactaactttacgtcggtccttacggtaccggttaccgtaccgggttccggaccggaaccgggtaaccgtaaagggtaacggtaaacgtaaccgaaacggtacgtggtacggtctacgacctactattcgttcgttccttacc

SEQ ID NO: 212547 - DNA, 762 bp, Homo sapiens
  misc_feature: GYAE6OF01CWE2V.21.27.C05.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagaccaccacgtggagtgattgtgatgacgcagtcctaccacgccctacccgtgtcttcgtgtaccgtcccgggaggggggaccncccgtccctcccgtcctccgtcgaccacgaccgtaccgtacgtacgtagttcctacgtccgtacgtacggttacgttcggttaccgccgtcgtaacgagtaacaagtacgtcggtccggaccgacggtccctaccgtcgtcccttaccgtaccgttaccgttaccgcgtacctaccgacccggaccggaccgggtaccctacggttccggtacccgtaaccgaggtaaccggttggttacggtcgggttcggggtaggtttaggtacggtttaacggacgtttggttttccttcacccgtacgaacctcgtaccgaccgtacccgaccgttaagacggtaagtacgtacgttagtacggttacgttacgtttacgtttaccttcgtacgtacctaagtaacttaattacgttacgtcgttccggtcgtacggtacgtaccggtacgtaccggaccggtaacggacgtaaggtaacgtaaacgtaacggtaacggtacggtcggtacgccgtacgtacctagttaccgttcgtccgttccgtc

SEQ ID NO: 212548 - DNA, 758 bp, Homo sapiens
  misc_feature: GYAE6OF01B5VZ6.21.27.C05.1.454.CMB.1.raw
  modified_base (165)..(165): a, c, t, g, unknown or other
  misc_feature (165)..(165): n is a, c, g, or t
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (229)..(229): a, c, t, g, unknown or other
  misc_feature (229)..(229): n is a, c, g, or t
tcagtcgtcgctcgcacgaccggtgctcgatttagacgcgatcgaaggggtttgggggaggaactgctcagttaggacccagacggagccatggaagcccagcgcagcttctcttcctcctgcttctctggcctccagacaccactggagtgattgtgatgacgnagtctccagccacctgtctgtcgtcnccggaggggggacnccgcctaccctctcctcgcacacnccgagtcagtctatcgctagtacgttggttacgccgtacggtaccagacaaggaacttcggacggaccacggtcctcccgacggtccttaccttacttaccgtttaccgcgacctaaccgtcccgaaccgtacgggaccctacggtcgggtacctacccgtagaccgttacggttacgagggttcggggacgggttagggtaggttacggggaacttacggtttacgtttttccacccgtacctaaccgacgttccgaaccgcccgttaacccaggtaagggttacgtaaggtaacgttaggttacgtttacgtacgttttaatttttacgttacccgtagacccgtaagtaacttaaagtttactaacgtttaccgcggttacccgttcggttaccggtaccggttaccgggttcccggaaccggttaaccggggaaaccgtaacgggttaaacgaaaccgtaaccgtaacgtacggtcgggtaccgtacgtcccggaccttaccgtattccgtttgttcccttacgg

SEQ ID NO: 212549 - DNA, 613 bp, Homo sapiens
  misc_feature: GYAE6OF01DSOT0.21.27.C05.1.454.CMB.1.raw
  modified_base (203)..(203): a, c, t, g, unknown or other
  misc_feature (203)..(203): n is a, c, g, or t
  modified_base (339)..(339): a, c, t, g, unknown or other
  misc_feature (339)..(339): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccgaggcctcctctactttaccgtgcactccaccagggccacgtggtcgtcccagacnggttcaggtggcggtggtagtttacgggactaggtcgttttcacgtcacatcgacgcccgtaccctaacgagtacggtagaagtattgtgtaccttaggttttattcgtggtcccagacctaaattaataactttacgtgtccgttcgacggttcgtaacggttccggacccgaaccgggaccgtaaggggtaccgaaaagtacccgtaaaacggtacgttcgggtacggtcgtaacggtccctaaaccctagttaccgttgtaccgttacccg

SEQ ID NO: 212550 - DNA, 773 bp, Homo sapiens
  misc_feature: GYAE6OF01EJU6L.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctcccagtggggtgtcctgtcacagatacaaactacagcagtctggtccaggactgggtgacggcccctcgactacgtacccctttcaacctcacctgtcgacagtaccgtaccgggaaatcgtcgcgtggacaacgtaagttggttaggaagttggtagttacggcgtaccggttccccggtacggacggtacggtccgtttggacggtggtacggttagggaacggtaaccgttaagtttaacgtaccggtacccgtaaggttaggttaacgtaggtaaacgtaacgttagtacgtacgtaagtacgtttacgttaggtacggtacggtccggttccgttccgtaccgtaaccctacgtaccccgaaccccgtacggtaaacccgtacccgttaaaccgaacgtaacgttaccgtaccggttcccttaccccgtaccctaaccgttaacgttcgttactccgtacctacccgtacccgaccggaccgtacgtacttttaggttttacgtttcgtacgtacgtaagggtaccgtaactacgtaacgttacgttacggtaccgttaccttacccgtttaccgttacgtaccgttaccggtaccggggtaccgtaccggggtttaccg

SEQ ID NO: 212551 - DNA, 828 bp, Homo sapiens
  misc_feature: GYAE6OF01BL16G.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggatgattgtgatgacgcagtcctcagcccaccctgtctgtgtcctccgagggggnccgcctacctctcctgacacacgccagtctacgtctatcgctgtacttggttacgccgtaggtaccagacaaggtaaactccgtacggaccgtaggtacctaccccgacggtacccttcccgttacgttaaaccgttttacccggtcgacccgttaccgtaccccggtaacccggtacgggtacccttaacgggttcggttaaccgttacccccgaaagttaccggttaacggtttcggaacgggttgggggtacggtttaacgggttacggtttacggggaacgttaaccggggtttacctttttacccggttacccttacccggtaaacgttacggttaccccgtaacggtacccggtttcccctaaaagggttcgtaaacgggtagtaaaacggttacggtttcggttacgttacgttttaacgtttttacgttgtaacccggtctaacggtaacttaagtttaacgtaaacggtttcctacgggttccgttcccggttaacggttaccgtaccggtacccggtaaccggaaacgggtacgtaaacgggtaataaaccggtacccgtaaaaggtcgaacggtttcaacgttacgacctaccgttagtcttcgttaacttcccg

SEQ ID NO: 212552 - DNA, 648 bp, Homo sapiens
  misc_feature: GYAE6OF01DUEOI.21.27.C05.1.454.CMB.1.raw
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacccgccacctctcctgcacagccagtcagtctatcgctagacttggttacgccgtacggtaccagacaagaactcgtcggccacggcctacccgacggtcctcctcgtactttaccgcgactactcccaccgacggccctacgtcggtcgtacccgaagtaccgtaggttacgaggtcgggtcggtaggtacgtttacgggaactaggttacgttttctcctacctactacgtaccgacgtcccgtaccctaacgaggtagtagaagtagttgttgtacgtttagttttacttctcgacctaagactaattaacttaacgttacgtcggtccgttggtccgttacggtacggttaccggacccgtaacgggtaaccgtaaaggtaacgtaaacgtaccgaaacgtacgtcggtacgcgtacgacctaacgtattcgtcgttctacg

SEQ ID NO: 212553 - DNA, 658 bp, Homo sapiens
  misc_feature: GYAE6OF01E1GUF.21.27.C05.1.454.CMB.1.raw
  modified_base (291)..(291): a, c, t, g, unknown or other
  misc_feature (291)..(291): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacccgccaccctctcctagccacagtccagtcagtctatcgctgacgttggttacgcctacgtaccatacagaactctcggcgacggccnccgtaccacggtctaccttcattaccgcgccacgtccgtaccaggtccgtactcggtacgtacccgtaggtaccagggttcgaggttggtacggttacgggactttaggggtacttacgtacgttttccaccgttactacccgtacgtacccgtacgtaccgaccgtaacgacgtagtagtacgtatttacgtgtacttacgctttaagtcctaagtctaagtactagtactaggtaccttcggaccttcggaccgttacgggaccgttaacgggtaccgaaaacgggtaccgtaaacggttacggtaacgttacggaaacgtaccggtcgttacggtacttacgacgtaccttagtaccgtttccg

SEQ ID NO: 212554 - DNA, 818 bp, Homo sapiens
  misc_feature: GYAE6OF01CZK7N.21.27.C05.1.454.CMB.1.raw
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
  modified_base (248)..(248): a, c, t, g, unknown or other
  misc_feature (248)..(248): n is a, c, g, or t
  modified_base (307)..(307): a, c, t, g, unknown or other
  misc_feature (307)..(307): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccatggagtgattgtgatgacgcagtctccagcccacctgtctgtcgtccgtcggaggggggacnccgcccaccctctccngaccacacgccagtcagtctatccgntagtacgttggtacgccgtagaccgagacaagtaactcgtcggaccacggtctccccgngtcctcctactacgtttacgcgacctacgtcccgaaccgtacggtccctacgtcgggtacgacccgtaggaaccgttacggtttacgacggggttcgggtcgggttaggttaagggtttacgggaaccgtttagggtttacgtttttcccgaaccgttaccgtaacccgtaacgttccgaacccggtacccggtaacccgttaagaacggtaacggtaaggtaacggttagttacggttacgttacgtttacgtttttacgttccgtaccggtaacgtaaacgtaactttaaattaacgttttaacgttaaccgggttccggttaccgggttaccggtacccggttaaccggttacccgggttacccgggaacccgggtaaacccggggaaaccggttaaacgggttaaacgtaaaaccgtaaaccggaaacccggttaacggttcgggtaccttaacggaccggttaaccctaaccggttaaccgtttccttccgttaccgttaaccccg

SEQ ID NO: 212555 - DNA, 643 bp, Homo sapiens
  misc_feature: GYAE6OF01DWSSO.21.27.C05.1.454.CMB.1.raw
  modified_base (161)..(161): a, c, t, g, unknown or other
  misc_feature (161)..(161): n is a, c, g, or t
  modified_base (229)..(229): a, c, t, g, unknown or other
  misc_feature (229)..(229): n is a, c, g, or t
  modified_base (368)..(368): a, c, t, g, unknown or other
  misc_feature (368)..(368): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatgggggtntcctgtcacagatcaaactcagcagtctggtccaggactgggtgacggccctcgcacgtacccctttnactccacctgtgactatcgtaccggggaaaatgtcgctggcaacaagtggttagtaagttggattaggctacgtccccgtgagaggcctgagtggcttggaagtactatactacgtcctagtggtatgaagtactatgntagtattctgtgagtcggttcgtcgtcacactaccaccccgataacgactacgaaagtactccgacgtcctaccctaccaaccttaagtcgtactcgtacctacctacccggacgaaccgtaccggtacttaacgttttacgttttcgtacggtaccgtaaaggacgggtactacctaacgttaacggttccggtaacgtaccctttacccgttacctttacggtaaacccgtttccccggtaacggggtcccggtaaggggttttaaacccggg

SEQ ID NO: 212556 - DNA, 626 bp, Homo sapiens
  misc_feature: GYAE6OF01ESRSF.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactccacctgtgacagtcgtaccggggaaaatgtcgctggacaacaagtgtaggaattggattaggctacgtccccgtggagacggtccgttgagtggcgttaggaaggtacctattactacgtcccgtagtgtatagaagactagtgactagtattcgtgtcgaggtcggttcgtcgtacacctactccaccccagaaccacgtaccaagactcgacgtcctaccctacctactaatcgttactcgtccacccgtaccgacggtacctacggtacttacgttttatttacggcgtacgaaaggtaccggtaataccgtacgttaagtttccgggtacttaacccgttaccttccgttacgtacccgtcccggtacggggtaccgtacgggttaacccg

SEQ ID NO: 212557 - DNA, 843 bp, Homo sapiens
  misc_feature: GYAE6OF01C7F66.21.27.C05.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtcgtcgtccgagggggacnccgcccaccctctcctgcacacgccagtcagtctagtcgctgactggttacgccgtggtaccagacaagtaaactcgtcggaccgaggcctcccgacggtccttcctactacgtttaccgcgactacctacccgaccgacggtccctacggtcggtaccgtacccgaggtaccgtacggtttccgagggttcggggtcgggttagggttaacggttttacggggaacgttaaggttacgttttttccgaccgttaacccgtaacccgtacgttacccgaaccggtaccccggtaaccccgttaacggtaacgggtacggttaacggtaaacggttacgtttacggtttaacgttacgtttaacggttttttaacgtttcccgttacgaccccgttaagtaaccgttaaacgttttaacgtttaaaccgtttaccggttaccgggttaccgttaccgggttacccggtttaaccgggtaccgggtttacccgggaaccgggtaaacccggggtaaaccggtaaaaccggggtaaacgtaaaaccgttaaaccggtaaaaccggtaaccggttacgggtaccggtaccgttacgtacccgtaacccgttacgtttcccgttaccgttaccgtttaacccg

SEQ ID NO: 212558 - DNA, 703 bp, Homo sapiens
  misc_feature: GYAE6OF01DURB7.21.27.C05.1.454.CMB.1.raw
  modified_base (161)..(161): a, c, t, g, unknown or other
  misc_feature (161)..(161): n is a, c, g, or t
  modified_base (311)..(311): a, c, t, g, unknown or other
  misc_feature (311)..(311): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttctcatcttcctgcccgtgctcgggcctccgagtggggtntcctgtcacagatacaaactcagcagtcgtggtccagggtactgggtcgacggcccctgctacgtaccctttcacctcacctgtcgacagtcggtaaccgggaaatgtcgcgtgacaactagtggttggaattggataggcacgtcccgngagcggtccttggaggtggtcgtagggaagtaccttagttactaccggtaccgtaggtcggtagtagaaacgtacgtagtgacgtagtactttgtgtaggacggtcggttccgtacgttacacccgtacttacccgaacccccgtaagaccgtaccctaacgaacgtaaccgtaccgttaccggtcccttaccctacccgttaaccgttaactcggttaccttccgtaaccctacccgtacccggaacgtaccgtacggttacttttacgttttagtttagaccgtaagtacgggtaggtactacgaacttaaggttaccgtcgttaacccgttacccttccggttacgtacccgttacgggtccggggtaccgttaagggggtttaacccg

SEQ ID NO: 212559 - DNA, 685 bp, Homo sapiens
  misc_feature: GYAE6OF01DHVR8.21.27.C05.1.454.CMB.1.raw
  modified_base (204)..(204): a, c, t, g, unknown or other
  misc_feature (204)..(204): n is a, c, g, or t
  modified_base (667)..(667): a, c, t, g, unknown or other
  misc_feature (667)..(667): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtcctccggagggggnccgcccaccctctcctgccacacgccagtcagtctatcgctgacttggtagcctggtaccagacaagtaatcgtcggccgaggcctcccgaggtcctcctctactttaccgtgacctactccaccgacgggacccacgtcggtacctacccgagtaccgtaggtttacgagggttcgggcgggttaggtagttttcggggacttaggttacgttttttcctaccttacaacccgtactacgaccgtcccgtaccctaacgaggtaacggttagaacgtagttcggttagacgtttagttttactttcgcgtaccgtaagtactaaatttaacttaacgttacgttcggtaccgttcggtaccggttcggtaccggttccgggtaccggaaccgggtaacggtaagggtaacgaaacgtaaccgaaaacggtcggttacggtcggtaccgtcgacctaaccgtnttccgttcgttcttaccg

SEQ ID NO: 212560 - DNA, 885 bp, Homo sapiens
  misc_feature: GYAE6OF01AIAJN.21.27.C05.1.454.CMB.1.raw
tcagtcgtcgctcgcacgaccggtgctcgatttagacgcgatcgaagggtttgggggcgagagcctgctgacttctggctgaccagggcagtcaccggagctccagacaatgtctgtctccttcctcatcttcctgaccgtgctcgggcctcccagtggggtcgtcctgtcacagatacaaactacagcagtctacggcaggactggtgacggccctcgcacgtaccctttcacctcgaccttcgtgactaacgtccgtaaccggggaaaattcggtccgcgtcggactaacgagttggttaggtaagttaggtacggttacggacgtacccggtaccccggtacggaacggaccggtaccggtttggaacgggttcgggtacggtttaaggggtaaaaccgggttaaccccttaagtttaaacccggtaccgttaaccccggtagggttacggttaaacgttaaacggaaacggttaaacccttagtaggtaccgtaagttaacgttcgtttaggtacggacggttcccggtcgttaccctaccgtaacccttacaaccccgtacccctacggtaaaccccgtaacccggttacgaaaacgttaacgtaccgaccgggttacccctttaccccgaaccctaacccgttatttacccggttacgttaccgtacccgtccccgaacccgggttaccggaactaccgggttacccgttttaaacgtttttcgttttagggtacccaaaagggtttaccgggaaacgggtaaccctacgttcgttaaccgggtttaggtaacccccgtaacctttacccgttttccccgtaagttaccccccggtaggggttaacccgggtaccccggggtaggttttaaaccccggg

SEQ ID NO: 212561 - DNA, 599 bp, Homo sapiens
  misc_feature: GYAE6OF01D5KVP.21.27.C05.1.454.CMB.1.raw
  modified_base (160)..(160): a, c, t, g, unknown or other
  misc_feature (160)..(160): n is a, c, g, or t
  modified_base (502)..(502): a, c, t, g, unknown or other
  misc_feature (502)..(502): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgaccgtgctgggcctcccatggggtntcctgtcacagatcaaactacagcagtctggtccaggactggtgaggccctgcacgtaccctttcactcacctgtcgacactcctaccggggaaaatcggtcgctcggcaacaagtggttagaattggattaggcacgtccccgtgacgtacggccttggagtcggtcttggaagaccttattactaccgtccaggtcgtatgaacgtactatgcagtcttctggtgacgtcggtctctcactactacccaccagaccacgtaccaagatccacgtcctcccgtccaccgtatctctaccgtcaccgtcccgacgaccgtacggtcttaggttttatttggngtaccgtaaggacggtacttcgtaacgttacgttacggtctaccgttacccttaccgttccggtacttccgggtacgggtccgtaacgggttaaccg

SEQ ID NO: 212562 - DNA, 618 bp, Homo sapiens
  misc_feature: GYAE6OF01CDXIM.21.27.C05.1.454.CMB.1.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
  modified_base (611)..(611): a, c, t, g, unknown or other
  misc_feature (611)..(611): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttacgcctggtaccagcagaaatctggccaggcctcccgaggtcctcctctactttaccgngccactcccgaaccgacgggcccacgtcgggtcgtacccgagaacgtggttacagggttcggccgtagggtgggtcgtaggggacaggtaccttcactctaccaccatcagacacgacgtggacgtccgtaggaacgttagttttgaactaagttagttaacgtttacgtcgttacaacgtactaacttactgtaccctacccgtacccccgtactaccctacccgttaccggaccgaaacggtaccacgtaccgtacgacggaagtacgtaacgaaaccgtacgtagtacgggtctaccgtntaacccg

SEQ ID NO: 212563 - DNA, 842 bp, Homo sapiens
  misc_feature: GYAE6OF01E5BGW.21.27.C05.1.454.CMB.1.raw
  modified_base (210)..(210): a, c, t, g, unknown or other
  misc_feature (210)..(210): n is a, c, g, or t
  modified_base (344)..(344): a, c, t, g, unknown or other
  misc_feature (344)..(344): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtcctccagcccaccctgtctgtcgtccgtccggaggggggacnccgcccacccctctccgtgccacgacgccagtcagtcctagtcgctcgtacgttggttacgccgtaggacctagacaagtaactcgtcggccgacggtcctcccgacggtcctccgttactacgttttaccggngacctaccgtaccccgaaccggtaccgggtacccctacggttcggtaccgtacccgaaggtaccggttacggttcggtaggggtcggggtacgggttagggtttacggtttacggggaaccttaggttttacccgtttttccgacccttaccgacccgtatacccggtaccggcccgtaaccccgtaaggaacggtagttaggtaacgttaggttcggtttacgtacgttttaagttttaccgttaccgtacggaaccgtaacgtaactaaacgtttaactttaacggttacccggtaccggttccggttaccgggttacccggtaccgggttacccgggttacccgggaacccgggtaaaccgggtaaccggttaaacgggtaaaccggtaaaaccgtaaacccggtaaaacgggttacggttacgggtccgggtaccgtaacccgtaccctaaccgttaaccggtttccgtttaacccgttcccgtttaaaccccg

SEQ ID NO: 212564 - DNA, 805 bp, Homo sapiens
  misc_feature: GYAE6OF01EV7OA.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctctcctgcacagccagtcagtctatcgctgacttggttacgcctggtacccagcaaggtaaactcgtcggccgacggtcctaccccgacggtcctaccctggtacccttaggttcccgatcccaccctacggggtcccaccgggttcggtacggttccccgaggtacccaggggtttccaaggttgggacgggttggggacgtttttgggggaacctttagggaacgttttttaccgtacctttaccaccccgtaacgttacccaaggtcctacccccggttaaaccgaaccgggttaacgggttagggaaaacggttaacgtttacgggttttacggttaccgttaacggtttttaactttttacccgtttaacggtaccctaaggtaccctaaaagtttacttaaacgttttaaccgttaacgggtacccgttagggtacccggttaccggtaaccgggtttaccgggtacccggtaaccggggtaacccgtaaacggggttacggtaaaacgtccgaaaacggttaaccgttacggttcggtaccgttacggacctaccgtacttacccgttcgtttccttacccgttaccg

SEQ ID NO: 212565 - DNA, 595 bp, Homo sapiens
  misc_feature: GYAE6OF01D8QOK.21.27.C05.1.454.CMB.1.raw
  modified_base (359)..(359): a, c, t, g, unknown or other
  misc_feature (359)..(359): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgaccctttcactcacctgtgacatcgtaccggggaaatgtcgctggcaacatggttggaattgagttaggctagtccccgtgagaggtccttgagtggcttggagtactattatacgtcccagtgtatgaagactatgcagtntctgtgagcggtcgtctcacctatccaaccctagaccacgtccaagaactcacggtcctcccgtaccaacctaatcgtctcgtaccacccgtacccgaccgaccgtaccggtcgttacgttttacttttgtcgtactaaggaggtactccgtaacgttacgttcggtcgtaacccgtacccttaccgttaccgtaccgttcccggtaccggggtccgtaacggggtttaacccggg

SEQ ID NO: 212566 - DNA, 929 bp, Homo sapiens
  misc_feature: GYAE6OF01CR1A5.21.27.C05.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgctttctctggcctcccagacaccactggagtgattgtgatgacgctagtctccagccacctgtctgtcgtcgtccggagggggacnccgacccacccttctccgtagccaacgacgaccgagttacgacgttacctacgtccgcgttagtaccgttaggttacgtcccgttacggtaccgagtacgaacggtaaacgtccgtacggaccgtacggtcccgtaccgacggtccctaccttacgttaccgttttaccggacgtaccctaaccgttcccgaacccggacgggtacccttaacggttccgggtaccgtaaccccggtaagggttaaccccgttaacgggttccgtaacgggggttcggggttacggggttaacgggtttaacggtttaacgggacggttaacggttttacgttttccctaccgttaccgaacccgtacttaccgggaacccgtacccggtacccgttaaggtacgggtaacggttacggtaaacggttcgtttacgggttacgttaaccgttttagggtttttaccttacggaccgttaacccgttaagtaaacctttaaagtttaacgtttaaaccgttcggttacccgggtacgtttaccggggaacccggttttaaccgggttaaaccggggtttaacccggaaaaccgggttaaaccgggttaaacggttaaaaccgtaacggttaaaaccgttaaccggaaacggtttacgggtacggtacccgttaccggtaccgttaaacccgttaggttccctttaaccggttcctttaacccgttcccccgg

SEQ ID NO: 212567 - DNA, 697 bp, Homo sapiens
  misc_feature: GYAE6OF01AQ63S.21.27.C05.1.454.CMB.1.raw
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (314)..(314): a, c, t, g, unknown or other
  misc_feature (314)..(314): n is a, c, g, or t
  modified_base (475)..(475): a, c, t, g, unknown or other
  misc_feature (475)..(475): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacncgccaccctctccngcacacgccagtcagtctatcgctgactggttacgccgtggtaccagcaagaaactcgtcggccaggcctcccgaggtcctcctctactttaccgngtccactcccgaccgacgggccctaccgttcgggtcgtaccccaggtaccgtaggttcgaagggttgggccggttggtagtttacggggactaggttacgtttttccgctaccgtacctacgtacgacgacccgtaccctaacgtacggtagtagtaagtnttacggttactacgtttagttttacgttacgtacgtaccgtaacgtacgtaaatttacttaacttaccggtcggtacccttacggtccggttaccggtaccggttccgggtaacccggaccggggtaaccgtaaacgggttaacgaaacgtaacccggtaaacgtaaccgttgggtacgtaccgtacgtacctaccgtagttcccttggttcccttaacccg

SEQ ID NO: 212568 - DNA, 851 bp, Homo sapiens
  misc_feature: GYAE6OF01DE0O1.21.27.C05.1.454.CMB.1.raw
tcagtcgtcgctcgcacgaccggtgctcgatttagacgcgatcgaagggtttggggcagagcctgctgacttctggctgaccagggcagtcaccggagctccagacaatgtctgtctcctctcatcttcctgcccgtgctcggcctccgagtggggtcgtcctgtacacagactacaaactacagctagtcgtggtccaggtacgtggtagacggccctcgactacgtaccctttcaccgtctacctggtcacctacgttacgtaaccgggtaaatcggtcgacgtaggaacctaacgtagttggtaggtagttaggacgttacggacgtaccgtcccggtagacggtacgtccgtagtacggtggtacgttacgggaaacgtacgttaacgttacgtaccggtacccgtaaggtacggttaatacggtaaacgtagttacgtacggtaccgtaagttaacgtttcgtacggttacgggtacggttccggttaccgttcccgttaaccaacccgtaccgttaccccgaaaccccgtaacgaaccgttaaccccgtaaacccgtaaacggtaaccgttaacggtaccccggttaacccttaccccgtaaccccgtaaactttaccggttacccgtttacgtacccgttaacccaaccccgttaaccccggaacgaacccggttaaccgttacgttttaacgttttttaccggtttaggaaccggtaacggtaaaccgggtacggttaaccgttacgtaccgtttaacggtaccgtaccgttaacccgttacccgttaccgttacgaacccggtttcgggaaccgggtacccgggttaagggtttaaccccgg

SEQ ID NO: 212569 - DNA, 651 bp, Homo sapiens
  misc_feature: GYAE6OF01EXLI9.21.27.C05.1.454.CMB.1.raw
  modified_base (203)..(203): a, c, t, g, unknown or other
  misc_feature (203)..(203): n is a, c, g, or t
  modified_base (312)..(312): a, c, t, g, unknown or other
  misc_feature (312)..(312): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctggtaccagcagaaatctggccagggcctccccgaggcctccgtctacttttacccggngtaccatcccaaccgacgggccctacgttcggtcgtcccaaggacgtaggttccaggtggcggtggtagtttggggactagttagttttccactccaactattccgacgccgtcccctaagaggaagttagaaagtattagttagactttagtttatttcgtacgacctaagtactaaattaattaaagtttaccgtggtacccttggtaccggttacgtaccggtttacgggacccgtaacggggtaacctaaacggggtaaggtaaaacgtaccgaaaacggtacttgggttaccggacttacgaaccgtaccctatttccgttcgttcttaacccg

SEQ ID NO: 212570 - DNA, 747 bp, Homo sapiens
  misc_feature: GYAE6OF01AZGFY.21.27.C05.1.454.CMB.1.raw
  modified_base (204)..(204): a, c, t, g, unknown or other
  misc_feature (204)..(204): n is a, c, g, or t
  modified_base (343)..(343): a, c, t, g, unknown or other
  misc_feature (343)..(343): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagccaccctgtctgtgtctccgagggggganccgccaccctctcctgcacacgccagtcacgtctactcgctgacgttggttacgccgttggtaacccagacaagtaaactcgtcgggaccacggtccctaccccgacggtcccttcccttactaacgtttttacccggngacctaaccgtccccgaacccgacggggaccctacggttcgggtccgtaccccgaggtaccgtacggttcgagggttcgggcgggttaggtaggtttacggggaacttacgggtttaccgtttttcctaccgtaccaacccgtacgtaccgaccggtccccgtaccccgtaacgaagggtaacgtaggaagtgtttggttacgtacgtttaagttttacttcgtacgacctagtaactaattaacttaacgtttacgtcggtccgttcggtaccgttaccgggtaccggttaccggaaccgggtaaaccgggaaccggtaaagggtaacggtaaaacgttaccgaaaacggtaacgttcggacggtctaccggtaacctacgttacgttcttcgttccttaccg

SEQ ID NO: 212571 - DNA, 1090 bp, Homo sapiens
  misc_feature: GYAE6OF01ARN35.21.27.C05.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagacgcgatcgaagggtttgggggagggaactgctcagttaggacccagacggagccatggaagccccagcgcagcttctcttcctcctgcttctctggctcccagacaccactggagtgattgtgatgacgcagtctccagccaccctgtctgtcgtcctccggaggggggacnccgccaccctctcctgccacacgtccagtcagtcctatccgctgacgttggttacgcctcggtaccagacgaagtaaactcgtcggaccacgggtcctacccggacggtccttccctaccgtacgttttacccggtcgcctaaccgtccccgtaaccggaacggggtcccctaacggtttccggtaccgtaccccgaacgggtaaccgttaacggggtttcaacggggttcggggtaccggggtttacgggtaacggttttacgggggaaaccgttaacggggtttaccggttttttttccccgtacccgttaaccccgtaaaacccggtacgtttaccccggaaccgggttacccccggtaaccccccgtttaacgggtaaaccgggttaaggggtttaaaccggtaaaagggttaccggtttttaccggggtttaacggtttaaccccggttttttaaagggtttttttccccgtttttaacccggttaacccgggtaacccgttaaacggggttaaaacctttaaaccgttttaaacggttttaaaaccggttttaaccccgggttttaccggggttacccccgggttaccggggtttaaccccggggttttaccccgggttaaacccccggggttttacccgggggtaaaaccccccgggggttaaaacccggggtaaacccggggggtttaaaacccgggggtttaaaacggttaaaaaacccgggttaaaccccgggtttaaaaaccccggggtaaacccgggttttaccggggtaccgggggttttaaaccccgtaccccgggttaacccggttaacccccggttttaaccggtttacccgggttttaccccgggttttaccctttaaccccggg

SEQ ID NO: 212572 - DNA, 650 bp, Homo sapiens
  misc_feature: GYAE6OF01BOWD1.21.27.C05.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggganccgccaccctctcctgcacagccagtcagtctatcgctgacgttggtacgcctggtaccagacgaagaactcgtcggaccaggcctcccgaggtcctcctctacgtttccgcgctactcccgaaccgcgggccctacgttcggtccgtacccaggaccgtacggttcagggttcgggcggtagggtaacgtttcgggaactacggtttacgttttccaccttccaactacgtccgacggtcccgtacccgtaacgaggtacggtagtaagtagttgttacgtacgtttagttttacttcgtacgtaccaagtactaattaagttaacttcgtacggtccttggtccgttaccggtccggtaccggccggtaacggacccgtaagggtaacgaacgtaaccgaaacgtacggtcgtacggctacgaccctactacttcgtcgtcttaccg

SEQ ID NO: 212573 - DNA, 787 bp, Homo sapiens
  misc_feature: GYAE6OF01DLAZA.21.27.C05.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatacaaactacagcagtctggtccaggactggtgaggccctcgcagtacccttnactcacctgtgacactcgtaccgggaaaatgtacgctggacaacgaacttggttaggtaagttggtaattaggccgtaggttcccccggtacggaaggtaggacccgtttggtaaggttgggtacgttgggtaaacggtaaccgttaaatttacgtaaccgttaccccgtaggttcgggttaactacggaaaggtaacttaagtacggtactaaggtaattccgtggttacggacggtcgggttaccgttacctcccgtaacctacgttcccaaccccccgtaagaacccgtaccggtaaccgtaaaaggtaaacctacgaacgggttacccttaccccctaacccgtaaccctttaacgttcgttccgttacgttaccgtaaccccgttccccgtaaaccggacccgtaccgggtaccttaaggtttttaactttttggtacggtaccgtaaaggtacgggtacttaccgtaacgtagttttccgggtacgtacccgttacccgttcccgtttacgtaacccgttcccggtacggggtcccgtaacggggtttaaacccgg

SEQ ID NO: 212574 - DNA, 878 bp, Homo sapiens
  misc_feature: GYAE6OF01EEVIW.21.27.C05.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (307)..(307): a, c, t, g, unknown or other
  misc_feature (307)..(307): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctntcctgcacagccagtcagtctatcgctgactggttagcctggtaccagcaagaatctggccaggcctcccgaggcctcctctacttttacccggngcctactcccgaaccgacggggccctacgttcgggtaccgtccccgaaggtaccgtaacgggtttccaaggggttcggggtcgggttagggtacgtttttcgggggaacctaggggtttaacgttttttccctaccgttaccgtaaacccgtagttacccgacggtaccccgtacccccgttaacgaacgggtaacggttaggaaaacggttacgtttgggtttacggtacgttttaacgggttttttaacttttcccgttacggtaccccgttaaggttaacccttaaaagtttaaacgtttaaaacgttttaaccggtaccggggttacccgtttacgggttacccgggtttaacccgggttaacccggggttttacccggggaaccccggttaaaccgggggtaaaccccgttaaaacggggggttaaccgggttaaaaaacccggttaacccgggtaaaaaacccgggttaaccggtttaccggggttaccggggtacccgtttaaccgggtaaccccgttaacccgttaaccgtttacccggtttcggtttaccccgtttaacccg

SEQ ID NO: 212575 - DNA, 829 bp, Homo sapiens
  misc_feature: GYAE6OF01A2FXV.21.27.C05.1.454.CMB.1.raw
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagccacctgtctgtgtctccgaggggggcccgccaccctctcctagcacngtccagtcagtctancgctgacttggttacnccgttacggtaccagaccaagtaaacttccgtacggaccaacggtcctccccgagggtccctcccttacttaacttttaccggtcgtctaccttcccgaaccggacgggtaccctaacggttcgggtaccgtacccaacggtaccgttaacgggttacacgggttcggggtccgggttagggtaagttttacgggggaacctagggtttaccggttttttcctacctaccctaacccgtagttacccgacggtaccccgtacccccgttaaagaacgggtaaccggttaggaaaaggttcggtttacgggtttagtacccgttttaaggttttttacctttcgtacccgtaaccgtaacgttaactaaacttttaaactttaacgtttaaccgttacggtacccttaggttacccggttaccgtaccggtttacccgggaacggtaaacccggggtaaccgttaaaacggggttaaggtaaaaccgttaaacccggtaaaacggttaaccgggttggttacgggtacctaacggtacccgttaaccgtacgtttaccgttcggttcccttaaccg

SEQ ID NO: 212576 - DNA, 635 bp, Homo sapiens
  misc_feature: GYAE6OF01CGVAE.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtgacatcgtaccggggaaaatgtcgctggcaacgaatggtaggaattggattaggctacgtcccgtacgagacggccttgaggtggtacgttaggaacggtaccttattacgtaccgtcctaggtggtaacgtagaacgactatgactagtattcgtgtagacggtcggtcgtactaccgaccacttccaaccccgagaccctacgtaaccaagaactcgtacgtccctaccctacctaacctatcgttcctacgtccgtaaccctacccggacgtaccgtacggtacttacgttttagttcgtacgacgtaaggacggtataccgacgtacgttacggtctacccgttaccgttaccgttacgacccgttccggtacggggtccgtaaggttacccgg

SEQ ID NO: 212577 - DNA, 894 bp, Homo sapiens
  misc_feature: GYAE6OF01ENM2D.21.27.C05.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccacgtggatgattgtgatgacgcagtctccacgccaccctgtctgtgtcgtccggagggggcnccgcccaccctctcctgccaacacgccagtcacgtctactcgtctcgacgttggttacgccgttcggtaaccaggacaaagtaactcggtggtacgtacggcctaccccgaggtccctccttacttaccgtttaccgcgacctacctaccccgaacggaccggtcctacggttccggtccgtacccgaggtaaccgtcgggttacgtacggggtcggggtcggttaggggttacgtttaggggacttaacgggtttaccgttttccacctaccgaactacgttccgaaccggtacccgtaccctaaggacggtaaggttaaggtaaacgttagtttacgggttagttaccggtttttaaggttttaaccctttcgtaccggttaaccgtaacggtttaaccttaaaacgttttaacgttaaaccggttttaccgggtaccggttacccgggttaccgggtttaacccgggttacccggggttacccgggtaccccgggggtaaacccgggtaaacccgggggtaaaacccggggttaaaaggggtttaaacccgggtaaaaaccgtttaaacccgggggtaaaaacccggtttacggggttacccgggttacgggtaccccgaaacccggggttacccttaaacccttcggggttttaacccctttccggttaacccgttttaaccccg

SEQ ID NO: 212578 - DNA, 747 bp, Homo sapiens
  misc_feature: GYAE6OF01C0NA6.21.27.C05.1.454.CMB.1.raw
  modified_base (162)..(162): a, c, t, g, unknown or other
  misc_feature (162)..(162): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccgagtggggtntcctgtcacagatacaaactacagcagtctggtaccaggactggtgacgccctcgcacgtaccctttcactcacctgtgacacgtcgtaccggggaaatcgtcgctggacaacaagtggttagagttggattaggcgtacgtccccgtgacggacggtccttggacggtggtcgttagggaaacggtaccttagttacgtaccggtccccgtaggttacggttagtaggtaaacgtaacgtaagtcggacgtaacggtaactttccgttaggtaggtacggtcggttaccgtcctaccgaaccgtacctaccccgaaccccgtacgaacccgtaacccgttaccgaacgtaacgtcccggtaaccgttcccgttaccccctacctaacccgttaacgttcgttcgtaccgtcctaacccgtacccggaccgtaaccgtaccggtacgtttaagtttttacggtttcgtacgtaacgtaacgggtagggtactaccgtaacgttacgttaccgggttacgtacccgttaacccttccggttacgtacccgttcgggtaccggggtccgttaacggggtttaacccg

SEQ ID NO: 212579 - DNA, 686 bp, Homo sapiens
  misc_feature: GYAE6OF01C1FVG.21.27.C05.1.454.CMB.1.raw
  modified_base (209)..(209): a, c, t, g, unknown or other
  misc_feature (209)..(209): n is a, c, g, or t
  modified_base (251)..(251): a, c, t, g, unknown or other
  misc_feature (251)..(251): n is a, c, g, or t
  modified_base (338)..(338): a, c, t, g, unknown or other
  misc_feature (338)..(338): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccacgcccacctgtctgtcgtccgtccggaggggggacnccgcccaccctctcctgaccacacgaccagtcagtctatcgntcgtacgttggtacgtccgtagtaccatacaagtaactcgtcggccaggtccctaccgacggtccttccttacgtaccgtttaccgntaccactcccgacgacgggccctacgtcggtaccacccgagaccgtaggttcgaggtcgggcggttaggtacggtttcggaacgttagtttacgttttccaccgtaccaacctagtccgaaccgtcccacccgtaagaaggtagtaagtaagtagttgtacgttactttaagttttacttcgacgtaccgtaagtactaaagtttaacgttacgttacgtcggtccgttcggtaccgttacggtacccggttaccggaacccgtaaccgggtaacggaagggtaacgtaaacgtaacgaacgttaggtacggcgtactacgtaaccgtacttcgtcttgttccgttac

SEQ ID NO: 212580 - DNA, 732 bp, Homo sapiens
  misc_feature: GYAE6OF01CA9UQ.21.27.C05.1.454.CMB.1.raw
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
  modified_base (271)..(271): a, c, t, g, unknown or other
  misc_feature (271)..(271): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgtacagtctcagccacctgtctgtgtcgtcgagggggacncgccaccctctctgcacncgcagtcagtctatcgctgactggtacgccgtgaccagacaagtaatcgngccacggcctcccgaggtcctaccgtacgtacgtttaccgcgctaacctccgaaccgacggtcctaacgttcggtacgtcccaaggtaccgtacggttcaagggtcgggtacggtaggtaacggtttacgggtaacgtaagttcggttttttacaccgttaaccgtacctaacgtccgaaccgtacccgtacccgtacgtaacggtaacggtaacgaaacggtaacgttacgttacgggtactttaggttttaaccgtttcgtacgtaccgtaacgtaacctaaattaaccgttaacgtttaaccgtcggtaccgttcggtaccggttaccggttaaccggttccggaaccggtaaccgggtaaccggaaacggttagtaaaacgtaaccggtaaaaccgttaacggttacggtaggtaaccgttacgacctaacgacgtttaccggtcttccgttacccg

SEQ ID NO: 212581 - DNA, 826 bp, Homo sapiens
  misc_feature: GYAE6OF01AZHL1.21.27.C05.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctcagccaccctgtctgtcgtcgtaccgagggggggtaccnccgtaccctacccttcgtccgtacggacctaacgaccgtcccgtaggttaccacggttaccgttacgtccgacgttacggtacgtttcggttaccgtccggttacggtaaccgtacggtactaacggtaaactcggtaccggaccgacggtccgtacccgacggtccttccgttaccgttaccgtttaccgtcgtacctaccgtacccgaccggtacggtacccgtaccgttacggtaccggtaccgtaacgtaccggttaacggttcgtaacgggtcgggtacgggttacgggttacgttacgggtacgtacggtttacgtttcgttacgtaccgtaaccgtacgttaccgaccgtacccgtacccgtaacgtacggtaacgttacgtaacgtagttacggttacgttacgtttacgttttacgttaccgtagtaccgtaacgttagtaaacttaacgtttaacgtacgtacggttaccgttacggtaccgttacggttaccggtacggtacccggtaaccggtaacggtaaacgggtaacggtaaccgtaacgtaaccggttaagtcgggtacgtaccgtacggtacctaacgtacgttaccgtagttccgttacg

SEQ ID NO: 212582 - DNA, 686 bp, Homo sapiens
  misc_feature: GYAE6OF01CYBXU.21.27.C05.1.454.CMB.1.raw
  modified_base (191)..(191): a, c, t, g, unknown or other
  misc_feature (191)..(191): n is a, c, g, or t
  modified_base (204)..(204): a, c, t, g, unknown or other
  misc_feature (204)..(204): n is a, c, g, or t
  modified_base (254)..(254): a, c, t, g, unknown or other
  misc_feature (254)..(254): n is a, c, g, or t
  modified_base (311)..(311): a, c, t, g, unknown or other
  misc_feature (311)..(311): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgctagtctccagccaccctgtctgtgtcnccggaggggggancgcccaccctctcctgcacagccagtcagtctatcgactgacttggtacnccttaggaccagacaagtaatcgtggccaggcctaccgacgctcctctatttaccgngtccatacccaacgacggaccacgttggacctcccgaagtaccgaggtttcgacgggtcgggcgggttaggtacgtttaggggactaggtttagttttccgacttccgaacctagttccgacggtcccacccgtaagacgtagtaggtaaagagtttcggtagttacgttaaggttttttacttcggttacgacccgtaaagtactaaaattaacgtttaaacgtaccgttcggtaccgtcgttaccgtacggttaaccggtaccgggtaacggaacccgggtaacggtaaagggaaagttaaaaccgtaacggtaaaccggtagtcgggttacgacgtaccgacctaaccgtacgttccgttgtaccgttaccg

SEQ ID NO: 212583 - DNA, 547 bp, Homo sapiens
  misc_feature: GYAE6OF01A3ERO.21.27.C05.1.454.CMB.1.raw
  modified_base (202)..(202): a, c, t, g, unknown or other
  misc_feature (202)..(202): n is a, c, g, or t
  modified_base (413)..(413): a, c, t, g, unknown or other
  misc_feature (413)..(413): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgtttgcctggtaaccaacaaaaacctggccaggcctcccagtctcctcatctatggggcatcctacaggatgaccggcactcccagacaggttcagtgccaggtcgggtctgggacagacttcactctcaccatacaacacacgtcggcgcctgaagtatttgctagtntattactgtacagtattgtatggtagtctaccgtactacgttgggaccgaggggaccaagggtggaagagtacgaggaaccgtacgtggtgggctggccacctactcgtcgttaccttcagttcccttaccccg

SEQ ID NO: 212584 - DNA, 645 bp, Homo sapiens
  misc_feature: GYAE6OF01DO87T.21.27.C05.1.454.CMB.1.raw
  modified_base (228)..(228): a, c, t, g, unknown or other
  misc_feature (228)..(228): n is a, c, g, or t
  modified_base (408)..(408): a, c, t, g, unknown or other
  misc_feature (408)..(408): n is a, c, g, or t
  modified_base (516)..(516): a, c, t, g, unknown or other
  misc_feature (516)..(516): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactcagcagtctggtccaggactggtgacggcccctcgcacgtacccctttnacctcgacctgtgacatacgtcgggaaaatgtcgctggacaacgtaagtggttaggtaagttggagttacggcacggtccccgtaggagacggtccgttgagttggtcgtttagggaaacgggtaccttaagttactaccgtccctaggtaggtatagaagtactagtgactagtattcngtgaggtcgtcgtctcacctactaccacccagacctacgtaccaagtaactcgtacggtcctccctacctaccttaatctacgtacgtccaaccgtccgaaccgaccnccggttacttagtttttaacgtttgtcgtaaccgtaaggtacggtactaccgtacgtaccgtttggtacctaaccttacccgtacccgttcgaccgttccggtacgggtaccgttacgggttaaaccgg

SEQ ID NO: 212585 - DNA, 731 bp, Homo sapiens
  misc_feature: GYAE6OF01C52BD.21.27.C05.1.454.CMB.1.raw
  modified_base (213)..(213): a, c, t, g, unknown or other
  misc_feature (213)..(213): n is a, c, g, or t
  modified_base (233)..(233): a, c, t, g, unknown or other
  misc_feature (233)..(233): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccactggagtgattgtgatgacgcagtctaccacgccctacccgtgtctggtcgtcgtccggaggggggacnccgcccacctctcctgcacncgccagtcagtctagtcgctagtacgttggttacgccgtgggtaccagacaaggtaaatcgacggccacggcctccgacggtcctaccttactacgttaccgtcgactactacccaccggtacgggtaccctacgtcggtccgtacccgaaggtacgtacggtttaccgagggtcggggtacggttagggtagtttacggggacttaggtttactttccgtactaccgaactacgtacgtaccgaccgtaccgtaacgtaggtacgtaggtaagtacgttacggttacgttacgtttaacgttttacttccgtacgtaccgtaacgtactaaacgtttaacgttaaacgtttaccgcggtacgttcggtacccggtcggttaacccgggttacggaacccggtaaccggggtaacccggtaaagggttaacggaaacgtaaccgtaaacggacggtacggtccgtacgacgtcctacgtactacgttacgtcttaccg

SEQ ID NO: 212586 - DNA, 621 bp, Homo sapiens
  misc_feature: GYAE6OF01AOJZY.21.27.C05.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
  modified_base (395)..(395): a, c, t, g, unknown or other
  misc_feature (395)..(395): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacncgccaccctctcctgcacagccagtcagtctatcgctgacttggttagcctggtaccagcagaatctggccaggctcccaggcctcctctactttaccgngccactcccgaccgtagggccctacgtggtctacccagtacgtaggttcgaggtggcggtaggtacgtttgggacttaggttacgttttcncgtacctacctagtaccacgtccgacccttaagaggtagtagaagtagttcgttagacttagttttacttcgtgacctagtactaaattacttaagtttaccgtggtacccgttcggtaccggttacggttaccggttccggaacccgaacggggtaaccgtaaaggtacggaaactacggaaacgtacgtggtacgtctacgacctactattctcgttcttaccg

SEQ ID NO: 212587 - DNA, 691 bp, Homo sapiens
  misc_feature: GYAE6OF01DJX88.21.27.C05.1.454.CMB.1.raw
  modified_base (204)..(204): a, c, t, g, unknown or other
  misc_feature (204)..(204): n is a, c, g, or t
  modified_base (279)..(279): a, c, t, g, unknown or other
  misc_feature (279)..(279): n is a, c, g, or t
  modified_base (319)..(319): a, c, t, g, unknown or other
  misc_feature (319)..(319): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgcccaccctctcctgcacacgccagtcagtctatcgctgacttggtacgccgtggtaccagacagtaactcgnggaccacggcctacccgaggtcctcctactactttaccgngccactacccgaccgacgggccctacgttcggtccgtacccgagtaccgtggttacgaggtcgggtcgggtaggttagttcgggactaggtttacgttttcctacgtcctactactcgacgtcccgtacctacgaggtacgtagaagtgttgttacgactttagttttacttccgtacgacctaacgtaacttaacttaacgtttaacgttaccggttacggtacccgttacgggtaccgttaccgggtaacccggtttcccgggaacccggtacgggtaaacccgttaaagggtaaaccgtaaaccgttaaccggaaacgtacggtcgggtacggaccgtacgtacctacgtactcgttacgttccgtacc

SEQ ID NO: 212588 - DNA, 621 bp, Homo sapiens
  misc_feature: GYAE6OF01A90HA.21.27.C05.1.454.CMB.1.raw
  modified_base (338)..(338): a, c, t, g, unknown or other
  misc_feature (338)..(338): n is a, c, g, or t
tcagtcgtcgctcgcacgaccggtgctcgatttagacgcgatcgaagggtttgggggcagagcctgctgacttctggctggaccagggcagtcaccggagctccagacaatgtctgtctccttcctcatcttcctgcccgtgctgggcctcccatggggtgtcctgtcacagatcaaactacagcagtctggtccaggactggtgacggcccctacggcacgacccctttcactccacctgtgacatcgtaccggggaaaatgtacgctggacaacaatggttggaattggattaggcagtccccggtcgagaggtcctgagtgcttggaagctattntacgtcccagtggtatagaagactagtgcagtattcgtgtgacgtccggtcggtcctctaccgatacccaccccacgacaccgtaccaagaactcgacggtcctcccaccacctaactcgtctagtccaccgttacccgaccgacgaccggtacttaggtttttaattttgtacgtaccaaggtacgggtactaccgtactacgtttccgggtacttacccttaacccgttcccgttaggtaccccttcgggttccggggtacccggtaggggtttaacccgg

SEQ ID NO: 212589 - DNA, 638 bp, Homo sapiens
  misc_feature: GYAE6OF01CZ8ZK.21.27.C05.1.454.CMB.1.raw
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatgggggtgtcctgtcacagatcaaactacagcagtctggtccaggactgggtgaggccctcgcacgtaccctttcactcacctgtgacatcgtaccggggaaatgtcgctggacaacaatggtaggaattggattaggcacgtccccgtgagngcctgngtggcttggaagtactatatacgtccagtgtatagaagtactaagtgactagtatttcgtggtaggacggtaccgggttcgtctccaacctacgtcccaaccccgagacccgaccgtaccaaacgtaactccgtacgggtccctacccgtacccaccttaagtcgtcttcgtcctaaccgtcccgaacgtaccgtacggtcttagttttacgttttgacgacgtaaggacgggtactcgtaacgtacggtttacggtccgttaaccttacccttccgttacggtacccgttcccgggtacggggtccgtaacggggtttaacccgg

SEQ ID NO: 212590 - DNA, 822 bp, Homo sapiens
  misc_feature: GYAE6OF01CM2RV.21.27.C05.1.454.CMB.1.raw
tcagtcgtcgctcgcacgaccggtgctcgatttagacgcgatcgaagggtttgggggggaagaggaagactgacggtcctgccacaggtggtgctgggcacggtgggccctcgcagaccctttcactcacctgtgacatctccggggaaaatgtcgctggcaacaatggttggaattggattaggcagtcccgtgagaggccttgagtggcttggaaggacctattatacgtccagtggtatgaagactatgcagattctgtgagcggtcgtctcaccatccaccccagaccacgtaccaagaactcgaggtcctccctccaacctaatcgtctgtccacctcccgacacgacggacttagtttatttgcgactaaggacggtatacaacgtagtttcggtacgtaaccttaccctccgtttacgaccgtttccgggtacgggggtaccctaacgggggttaaccgttttcgtacccgtttaaccccggttttcctaccgtaaccggtccccttaaccccgaacccggtaaaccggggtacccctaccggtttaccccggttccccgtttaccccccggtccgggtaccccgtccccgttaccggcccgttaaccccggtagggtacccgtaccccgtaacccggttacccggacggtaacccggaccctaaacccggaccgggtcccccgggttccccggttaacggggtcccgttcccgggtacccgggtttacccggggtaaccccgtaaaaccggggttaacccccgttaacccccgggtttaccccggtaaacggggtcccccgggtaaaacccggg

SEQ ID NO: 212591 - DNA, 834 bp, Homo sapiens
  misc_feature: GYAE6OF01E0MOV.21.27.C05.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgctagtctaccacgcccacctgtctgtcgtcgccggagggggacnccgccctaccctctccgtcgaccaccacgccagttccagttcctatccgtcgttacgtacgttacggttacgccgttacgtaaccgagactaaagtaaccttcgtacggaccacggtccctaccggacggtccttaccgtcgttacgtttaccggctacctacgtcccgaaccggtcgtacctacggtcgttaccgaccgaacggtacgtaggttacgagggttcggggtacgttagggttagttacgggagttacggttttaccgtttccgtacgtacctaaccgtacgttaccgacggacccctaaccgtacgtaagggtacggttagaaacgttgttcggttacgtaactttttacggttttacttcgaacgtaccgttaaagttaaccttaatttaaacggttcgtttaacccgggtcggtttaacccgggtccgggttaaccggttcccggggtttaacccgtacccgggggaaacccgtaaacccggggttaaaccgggttaaaggggttaaacccgttaaaaaccgggtacccgtttaaaaccggggctttacggggttacccgaacgttacccggtaacctaacgtttcgttcccgttagttccctttaaaccccgg

SEQ ID NO: 212592 - DNA, 605 bp, Homo sapiens
  misc_feature: GYAE6OF01A13E5.21.27.C05.1.454.CMB.1.raw
  modified_base (203)..(203): a, c, t, g, unknown or other
  misc_feature (203)..(203): n is a, c, g, or t
  modified_base (314)..(314): a, c, t, g, unknown or other
  misc_feature (314)..(314): n is a, c, g, or t
  modified_base (327)..(327): a, c, t, g, unknown or other
  misc_feature (327)..(327): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggatgattgtgatgacgcagtctccagccaccctgtctgtgtctccgaggggggtancgcctaccctctcctgcacagccagtcagtctatcgctagtactggttacgcgtggtaccagcagaaatcgtcggccaggcctcccgaggtcctcctctacgtttaccgtnccactccacccgnggtaccacgtcggtcgtacccgagtacgtacggttcgaggttgggacggtggtacgtttgggaacttagtagttttctctcgtacctatccagtcccgaccctacgagtagtagtaacgtagtgttcgtacgttaggtttacttctcgacctagtactaattataacgttacgtcgtaccgttcggtaccgttccggtacggtcccgaccgtaccgggacgtaaggtacggtaaactcgaacgacgtgtacggctacgcctacgtatctgtcttaccg

SEQ ID NO: 212593 - DNA, 686 bp, Homo sapiens
  misc_feature: GYAE6OF01BNXRK.21.27.C05.1.454.CMB.1.raw
  modified_base (210)..(210): a, c, t, g, unknown or other
  misc_feature (210)..(210): n is a, c, g, or t
  modified_base (264)..(264): a, c, t, g, unknown or other
  misc_feature (264)..(264): n is a, c, g, or t
  modified_base (332)..(332): a, c, t, g, unknown or other
  misc_feature (332)..(332): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtcctccagcccaccctgtctgtgtccgtccggaggggggacnccgcccaccctctccgtgccacacgccagtcagtctatcgctgacgttggtacnccgtgtaccagacgaagtaatcgtacggccacggcctccgacggtcctacccttactacgtttaccgngacctactcccgaacgacgggtcctaggttcggtcacccgagtaccgtggttaccagggtcgggtcggtaggtgtttacgggacttaggttacgttttccactaccaactacgtccgacgtaccctacccgtaagaggtaagtagaagtacggttgttacgtacgtttagttttacggttctcgtaccgtacgttaactaaagtttactttaaagttccggtacgtaccgttcggtccggttacgtaccggttaccggaccggtaaccgggaacgtaagtaaccgggtaaactaccggtaaacgtacggtcgtacggtcgtacgtaccgtactacgttcgttacgttctaaccg

SEQ ID NO: 212594 - DNA, 648 bp, Homo sapiens
  misc_feature: GYAE6OF01B0LMW.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttctcatcttcctgcccgtgctgggcctccagtggggtgtcctgtcacagatcaaactacagcagtctggtccaggactggtgaggccctcgcacgtaccctttcacctcacctgtcgactagtcgtaccggggaaaatcgtcgcgtaggacaacaagttggtaggaattgggattacggacgacggttccccggtacggacggacggtccgttggaggtggcgttaggaacgtactagttactacgtcctagtcggtatacgagtactatgtacagtacttcgtggtgacggtcggtcgtactacaccgtactcccgtaacccgacgtaccgtaccgtaaccaagtaactcccgtagtcccctaccctactacctaacttcgtctcgtctaccgtacccgacgacgtacgtctttaagtttactttcgacgtacgagtacggtactacgtacttaggttaccggtactaccttacccgttcgttacgacccgttaccgggacgggtccggtaacggggtttacccgg

SEQ ID NO: 212595 - DNA, 835 bp, Homo sapiens
  misc_feature: GYAE6OF01A2J7K.21.27.C05.1.454.CMB.1.raw
  modified_base (127)..(127): a, c, t, g, unknown or other
  misc_feature (127)..(127): n is a, c, g, or t
  modified_base (221)..(221): a, c, t, g, unknown or other
  misc_feature (221)..(221): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttcnctggcctccagacaccactggagtgagttgtagatgacgctagtcctaccacgaccctaccttgtcttggtcgtccgtaccgggagggggaccncccgaccctacccgttcttccgtcgaccgaacgacgaccgtacgttacgtacgttcttacgttccgtacgttacggtacgtttacgggttaccgtaccggtttacggtaacccgaggttacgaaacggttaaacgttccgtaccggtaccgaccggttcccgtacccggaccgggtcctttaccgttaccgttaacgttttaccgacgtactacccgtaccgaaccgggttacggcccgtaacggttcggtacctaccgtacgtacgtacggttcgaagggtttcgggaacgtggtacgtacgggtatacgttacgttttccacgtacacgtacgtacgaaccgtccgttaacctacggtaacggtaagtaggtacttaggttaccgtagttaccgtttagtttacgttaccgtacgtacctaaggtacttaaaccgtttaacgttaagttccgttaggtcccgttaccgtacgggttaccgggttaccggtaccggttaacccgggtaaccggtaacggttaaaccggtaacgtaacccggtaaccgtaacggtcgttaccggacgttacccgaacgttaccgtacttacgttcgttagttacccgttaccgg

SEQ ID NO: 212596 - DNA, 688 bp, Homo sapiens
  misc_feature: GYAE6OF01BS3G4.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctccgagtgggtcgtcctgtcacagatacaaactacagctagtctcggtccaggtactggtcgacggccctgcctacgtaccctttcactcacctgcgactagtcgtaaccgggaaatcgtcgcgtaggacaacgtagttggtaggtaagttggattacggcgtaccgtacccgaggaggtacggtccgttaggaggtcggacgttacggaacgtaccttaagttacgtacgtccgtaggttaggtatagtaaagtactagtcgacgtagtacgttcgtaggtacgacggtcggtcgtactacacctactacccgaacccgagaacctaaccgtaacaacgtaactcgtacgtcctacccgtactaactagtcgtactacgtacctaccgtacccgacgtaaccgtacgttcgtttaacgtttacgttacgtacgtaacgtaacgggacgttactacgtaaccgttaggttaccggtacgtaacccttaccgttacgttaccgaccggttaccggtacgggtaccgtaacgggtttaacccg

SEQ ID NO: 212597 - DNA, 742 bp, Homo sapiens
  misc_feature: GYAE6OF01CMYW9.21.27.C05.1.454.CMB.1.raw
  modified_base (202)..(202): a, c, t, g, unknown or other
  misc_feature (202)..(202): n is a, c, g, or t
  modified_base (317)..(317): a, c, t, g, unknown or other
  misc_feature (317)..(317): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgccacagccagtcagtctatcgctgtacgtggttacgcctaggtaccagacaagaaatcgtggccacggcctcccgaggtcctcctactactttaccggngaccactcccaccgacgggccctacgtcggtccgtacccgaagtaccgtacggttacgagggtcgggacgggttagggtagttttacggggacttaggttacgtttttcctccgtaccaaccgtataccgacggtaccccgtacccgttaacgaacggtaaggtacggtaaagtagtttaggtttacgtacgtttaagtttttactttccgtacgtaccctaaggtaccttaaagttaatttaaacgtttacggtcggtacccgttcgggtaccggttaccgggtaccggtttaccgggaaccggtaaaccggggtaaaccggtaaagggtaacgggtaaaacgtaaccggtaaaacggttaacggttcgggtacggtacctaccggtacctaacccgtagtttaccgttcggttacctttaccg

SEQ ID NO: 212598 - DNA, 643 bp, Homo sapiens
  misc_feature: GYAE6OF01CQDXB.21.27.C05.1.454.CMB.1.raw
  modified_base (163)..(163): a, c, t, g, unknown or other
  misc_feature (163)..(163): n is a, c, g, or t
  modified_base (382)..(382): a, c, t, g, unknown or other
  misc_feature (382)..(382): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatccttcctgcccgtgctgggccctcccagtggggtntcctgtcacagatcaaactcagcagtctggtccaggactggtcgacggcccctcgccacgtacccctttcactccaccttgtagactagtcgtaccggggaaatgtcgcgtggcaactagtggttgtaagtggagttaggcacgtccccgtagagtcgcgttgagtggtcgtaggaagtacctattactaccgtccagtaggtatagaagtactagtancgtagtagttacgtgttagcggtcgttccgtctaccgaacctacgtacccgacccgaacgaaccgtacgtaccaaacgtaacgtaccgtacggtcccctaccctacccacttatcgttacctacgtacgacctacccgacgtaaccgaccgtacttaagttttgttcgtacgtacgtacggaacggtctacgtacgttagttacggtctaacccttacgttccttacgaccgttccgacggggtcgtacggggttaacccg

SEQ ID NO: 212599 - DNA, 645 bp, Homo sapiens
  misc_feature: GYAE6OF01D1AA3.21.27.C05.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctntctgcacagccagtcagtctatcgctgactggttacgcctaggtaccagcaacgaaatcgtcgccaggctccccaggctcctctagtttaccgcgacactccacgtacggcctacgtggtacgtcccagaaacggtggttacgaggttcgggcggttggtacttttaggggacctaggttacgttttcctacctactaaccctaagttccgaacggtaccggaccccttaaacgaacgggtaactaagggtaagtaagttcggtttacgtacgttagttttactttcgacgtacccgtagtaacctaattaagttaaacgtttagtcgtaccgtgtcgttacgtacgttccggtacgaccggtaccgaaggtacgtaacgtaaacgaacgtactcggtacgacgtagtccaaactcgttctcggtcttaccg

SEQ ID NO: 212600 - DNA, 751 bp, Homo sapiens
  misc_feature: GYAE6OF01CW638.21.27.C05.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccacctgtctgtgtctccgagggggacncgccaccctctcctgcacacgccagtcagtctagtcgctgtacgttggttacgccgttaggtaccagacaagtaaacttccgtggccacgggcctccccgaagggtcccttcctacgtactttttaccggcgccacgttcccaacccggacgggtcccctacgttcgggtacgtccccgaaggtaccgtaggttaccgaggttcggggtcgggttaggtaagtttcggggaacttagggttaacgttttttccgacgtaccctaacctacgttaccgaacggccccgtacccgttaacgaaggtaggtacggtaaagttacgttcggtttagactttaaggttttaacttcgtcgacctaagtactaaagtttattaacgtttacgtcggtaccgttggaccggttacgttaccgggttccggtaacccggtaacggggtaacccgtaaaggggttaacggtaaaacccgttaacgaaaaaccgggtacgttacgggtacgggtaccttaacggtccctaaccgtactttaccgttcgtccctttaaccg

SEQ ID NO: 212601 - DNA, 774 bp, Homo sapiens
  misc_feature: GYAE6OF01BII93.21.27.C05.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagccgtggtaccagcaagaatcgtggccaggcctcccaggcctcctctactttaccgngaccatcccacgtagggcccacgtggtactcccaaggtaccaaggtttcaggtcgggcggttaggtacgtttaggggactaggttactttttccgacttaccgaacctaagttccgacggtacccgaccccgttaacgaacggtaacgttaggtaaaaggtacgtttacggttttacggaaccgtttaaggttttttaacgttttcccgtacgggtaccccgtaaacggtaaccttaaaagtttaaacgtttaaaaccgtttaaccggtttccgggaccccgtttcggtaacccgggtttacccggttacccgggtttacccgggaaccccggtaaccggggtaacccggtaaaaggggttaacggtaaaaaccgttaccgtaaaacccggtaacgtttcgggtaaccgggtacttaccggtaacccgtaacccgtaagtttccgtttacggttcccttttaacccg

SEQ ID NO: 212602 - DNA, 790 bp, Homo sapiens
  misc_feature: GYAE6OF01EAAHK.21.27.C05.1.454.CMB.1.raw
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagaccaccactggagtgtagttgtgatcgacgctacgtctccagccctacctgtctgtcgtctcggagggggcccgcccgaccctcgtccgtgccaacgacgcctagtcacgttctagtccgctagtacgttggttacgccgtacggtaccagacaagtaacttcgtacggaccgacggcccctccgtacggtccctcctacgttacgttttaccgcgacctacgtcccgaccgcggtccctagtccggtacctccgaaggtaccgtacgtcgagggtcgggtcggtaggttacggttacgggtaccgtagtttaccgtttttccacttaccgtaccgtacgtaccgtaccgaccccgtaacccgtaaggtaacggtacgttaagtaacgttacggttggttaccgttaacggttttacttttacgttccgtacgtaccgtaagttaactaaagtttacgttaagtttcccgggtacgttaccggttacggtttacccgggttaccggtttaaccggtacccgggtaaacggggtaaccggtaaaccggttaacgggtaaaacgtaacccggtaaaaccgtaacggttacggttggtacccgtacccgtacggtaaccctacggttaccttttcccgttcgtttaccccgtac

SEQ ID NO: 212603 - DNA, 902 bp, Homo sapiens
  misc_feature: GYAE6OF01EG1OJ.21.27.C05.1.454.CMB.1.raw
  modified_base (166)..(166): a, c, t, g, unknown or other
  misc_feature (166)..(166): n is a, c, g, or t
  modified_base (210)..(210): a, c, t, g, unknown or other
  misc_feature (210)..(210): n is a, c, g, or t
  modified_base (719)..(719): a, c, t, g, unknown or other
  misc_feature (719)..(719): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccacgtggagtgattgtgatggacncgagtctccagccctaccctgtctgtcgtcgtccggagggggcnccgcctaccctctcctcgaccacgacgcctagtctaacgtctacgtcgcgtagacgttggttacgtccgtaggtacccagacctaaggtaaactcgtacggaccgtacggtcccgtacccggacggttccctttacccgttaccgttaaaccgttttccccggagtacccgtaaccgttaccccgaaaccgggtaccgggtaccccgttaaccggttccgggtacccgttaaccccggtaaggtaaccccggtttaagggttaccgggtaaacggggttcgggggttaccgggttacggggtttaacgggttacgggtaacccgttaagggttttaccgtttccctaaccgttaccgaacccggttatacccgggaccgtacccggttaacccctaagggaacgttaacggggtaacggtaacgtttaaacgggttcgtttaccgggttttacgttttaaagtttttacccgtttacggtaccccggttaaacgtaaaccgggtttaanaaaaccgtttttaacgttaaccgtttaaccggttcccgggtaccgttaccgggtaccggtttaacccggggtaaccgttcccgggggaaacccggtaacgggtaaacccggttaaggtaacgtaaaccgtaacggtaaacgttcgggtacgtcgacgtctaacgaccttatcgtctcttaccg

SEQ ID NO: 212604 - DNA, 675 bp, Homo sapiens
  misc_feature: GYAE6OF01BOUFT.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatacaaactacagcagtctggtccaggactggtgacggccctcgcacgtacccttcactcacctgtgacatcgtacgggaaatgtcgctggacaacaagtggttagattggagttaggcacgtcccgtggagacggtcctggagtggcgttaggaacggtacctattactaccgtccgtagtggtaatgaagtactagtacgactagtacttacgtagtcgacggtcggtcgttactaccaccctactaccaaccccgtagaacctaccgtaccaacgtaactccgtacggtaccctccctacctaacgtaactcgtctccgtactacccgtacccgaaccgtaccgtacggtacttacgttttacgtttcgtacggtacgtaacggtacggtaactaccgtaacgttacggttaccggtaaccggtaccctttaacccgttccggtttaccggtacccgttacccggggtccggggtaaccggttacggggtttaaacccggg

SEQ ID NO: 212605 - DNA, 795 bp, Homo sapiens
  misc_feature: GYAE6OF01BWYR6.21.27.C05.1.454.CMB.1.raw
  modified_base (204)..(204): a, c, t, g, unknown or other
  misc_feature (204)..(204): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgcccaccctctcctgccacacgccagtctagtctatcgctgacgttggttacgccgttggtaaccgagaccgaagtaaactccgtacggcccgaaggcccctacccggacggtccttcctcctaacgttttcccggtcgcctaacctcccgaacccggtagggccctaacggttcggtaccgtacccgaggtacctaggttccgtagggtggggtacgggtagggtttacggtttacggggaaccttagggtttaccgtttttcgaccttaccaaccgtacgtaccgtacccggtaccgtaccccgtaacgtacggtaaggttaaccgggtaaattacggttaggttacggttaccgtttaacggttttttactttcggaaccgttccggtaaataacgttaaagtttaaacttaaccgtttacggtcgggtcctacggttcccggttaacggtaccggttaccgggtaacccgaaacggggtaacggtaaacgggttaacgtaaaaccgttaacgggtaaaacccgacggtttcggtacgggttacgaccgaacccgtataccctttacggttccgttacttaccccg

SEQ ID NO: 212606 - DNA, 838 bp, Homo sapiens
  misc_feature: GYAE6OF01C7R9K.21.27.C05.1.454.CMB.1.raw
  modified_base (211)..(211): a, c, t, g, unknown or other
  misc_feature (211)..(211): n is a, c, g, or t
  modified_base (819)..(819): a, c, t, g, unknown or other
  misc_feature (819)..(819): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagaccaccacgtggagtgattgtgatgacgcagtctccacgcccaccctgtctgttcgtccgtccggaggggggnccgcccaccctctccgtgccacacgccagttcagtctagtcgcttgacgtggttacgccgttaggtaaccagtacaaagtaaactccgtacggacccgacggtcccctaccccgacggtccccttacccttacgttacttttaccggcgtaccctaccttacccgaacccggacgggtcccctaacgggttcggttacccggtacccgtaacggtacgttaacgggtttccggaaggggtttccggggtacggggtttaggggttaaggtttttacggggaacgttaacggtttaccggtttttttccaccgttacccgtaaccctagttaccccgaaccgggtccccgttaccccgtaaacgtacggtacggttaaaggttaacgtaaggtttcggttacggttacctttaacggtttttacgttttaccgacgtaccgtaaacgttacgttaaaatttacttaacgtttaccgtacggtaccgttccggtccggtaacgggttacccgggttacggcccggtaaaccggggtaaccgtaagggtaacggtaaaacgttaccggaaaccggttaacgtcgggtagtaccctaggtaccctaacgttntccgttcgtttactacccg

SEQ ID NO: 212607 - DNA, 880 bp, Homo sapiens
  misc_feature: GYAE6OF01A5XUI.21.27.C05.1.454.CMB.1.raw
  modified_base (222)..(222): a, c, t, g, unknown or other
  misc_feature (222)..(222): n is a, c, g, or t
tcagtcgtcgctcgcacgaccggtgctcgattttagacgcgatcgaagggtttgggggtagggaacgtgctcagttaggacccagacggagccatggaagccccaagcgcgacggccttctcttcctcctggcttcctctggctcccagacaccacgtggagtgattgtgatagaccgcagtctccgagcctaccctgtctgtcgttcgtccgagggggacncgccctacccgtcgtccgtagaccaacgacgaccgtagttctacggttcctaagtaccggtctacggaacttggtttaacgtacccgtttaggttaaccgagtacgaaggtaaactacgtacggaccggacggtaccctacccgacggtcctccgtactacgtttaccgtcgtcctacgtcccgaaccgaacgggaccttaacggttagggttaccgttaccccggagtaaccgtacgggtttcgtaacgggttcggggtacgggttagggttaacggtttcggggtaacgtagggtttaacgggtttttaccttaaccgtttacgacccttaacgtaccgaaccgtccgtacccttacgacggtacggttacgtaacgtacgttaacggttacgtacgttttagttttaacgttccgttacgttaccgttaagttaacctaaacgtttaaacgttaaacgtttaacgtacccggtaccgtttaccggttaccgtttacccgggttacgggtttacccggtaaccggtaaacccgggtaaacggtaaacggggtttaacggtaaacccgttaacgttaaaacccggaaacggttcggtacggtaccgtaaccgtccgttaaacccgttaccgtttacttccggtttaactttaccccg

SEQ ID NO: 212608 - DNA, 817 bp, Homo sapiens
  misc_feature: GYAE6OF01DJZPP.21.27.C05.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagacgcgatcgaagggtttggggggaggaactgctcagttaggacccagacggagccatggaagccccagcgcagcttctcttcctcctgcttctctggctcccagacaccactggagtgattgtgatgacgcagtctccagccacctgtctgtgtctccgaggggcncgccaccctctcctgcacacgccagtcagtctatcgctgacgttggttacgccgtggtacccagacctaagtaaaactccgtacggacccgacggtcccttcccccgaaggtcccttaccctacttacgtttttacccggcgacctacctccccgaaccggaacgggcccctaacgttcgggtaccgtaccccgaagtaaccgtcggtttacagggttcggggacgggttagggtacgtttttacggggaacttaacggttcggttttttcccaccgttactaacccgtacgttactaccggtacccgtacccctaaagtagggtaacgttaagaacggttagttacggttagtacctttaagtttttactttccgacgtacccgtataaccgttaaatttaacgtttaaacgtttacggtaccggtaccttacgggtaccggttacccggttaacggggtttacccgggaccggttaaacccgggggtaaccggttaaaacgggttaacgggtaaaacctaaacccgggttaaaccggtaaacggtttcgggtaccgggtattacccggaccttaaccggttaatttccccggttcggtttaccctttaacccgg

SEQ ID NO: 212609 - DNA, 867 bp, Homo sapiens
  misc_feature: GYAE6OF01C2CWW.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatctcctgcccgtgctcgggcctccagtcggggtctcctgtcacagactacaaactacacgctagtccgtcggtaccagggtacgtgggtacgccgggtcccctcggaccgtaccgttacccctttcacctccaccttggtacgaaccgtacgtaccggtaaccgggggtaaaatccggtccggcgtacgggaactaacgtaaggttgggttaagtaagttgggtagttacggcctaccggttccccggtcggaacggcggttaccgttaggacggttcgggttacggtagggtaacgtaccgttaacgtttaacgtaccggtaccgtaagggttacggtagtaacgggtaaagttaaccgagttacggaacgttaacgtacggttttaccggttaggttacggtacgggtccgggtttacctccggttaaccaacccgtaccttacccccgaaccccgtaacgaccgtaacccggttaacgaacgtaacgttaccggtacccggttccccttaaccctaccccttaaccgttacgtttaccgtacccgtttacgtaaccccgtcccgtacccgggtaaccgtaccgtaccgttaacgttttaacgtttttacgttaccggtaacggaacgttaacgggaggttacctaccgtaacgttccggttacgtttaccggtaccctttaccgttacgttaccggtacccgttccgggtaacgggtaccggtaacgggtttacccg

SEQ ID NO: 212610 - DNA, 832 bp, Homo sapiens
  misc_feature: GYAE6OF01BFV1Q.21.27.C05.1.454.CMB.1.raw
  modified_base (171)..(171): a, c, t, g, unknown or other
  misc_feature (171)..(171): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtacanagatacgaaactacagcagtctcggtaccaggtactgggtagacggcccttcgcctacgtacccctttcaccgtacaccctggtacgaacgtacgttaccggtaaccggggaaaatcggtacgtaccgacggaacctaacgtaacgttagggttaggtaaagtttagggtaacgttacgggacctaccgggtacccccgtacgggtaacggtaccgggttcccgtttagggtacggttacggtaccggttagggtaaaccggtacccttaaggttacggtacgttccggtaacccgtaggttacgttaagtacgtaaatccgtatcgtacaacggttaactttcggtaggtacggtcggtacggttaccgtaccttaaccgccgtaacgttaccccgtaaacccgtacggtaaccccgtaaccgttaaccggaaacgtaaactccggtaaccggttacccttaccccccgtaactaacccgttacttaccggtcgttaccggtaacccgtacccgtaacccggaaccgtaaccgttaaccggtaccgttttaagttttacgtttacgacggtaaccgtagggtacggttacctaacgtcgttaagtccggttacctaacgttcccgttacgtcgtacctccggtacgggacttaaccgggg

SEQ ID NO: 212611 - DNA, 871 bp, Homo sapiens
  misc_feature: GYAE6OF01AB10J.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctccatggggtgtcctgtcacagatcaaactacagcagtctggtccaggactggtgacggccctcggctacgtaccctttcacttcacctgtcgacatccgtaccggggtaaaattcggtacgcgttaggacctaaacgtaagttcggggttaggtaaacgtttgggtaactttaagggccgtaaccggttccccccggttaggaaacgggtcgggtacccgtttaggtaacgggtcggtccggtttagggaaacgggtaccctttaagtttaacgtacccggtacccgtagggttcgggttaaatcggggtaaaactacgttacgtacggtaaccctaaagggttctttaccggtaacggttcgggtaaacggttcccgggttaccggtttccctaaccctaacccgtacgtacccccgtaacccgtaacggtaaacccgtacccgtaaccgtaaacgtaccgttaaccgtaaccgggttccctttaccccgaaccccgttaactaacgttccggtacctttcgtaaccccgccgttaaccccggctaaacccggtacccgggttatttacgtttttaacggttcgtaggtacctaaagggtccgggtaactccgtttaaccggtacgttttaccggtaacccgttacccttaaccgtttaccggttaccgtaaccccgttacggggttaccccgggtccgggttaaaccggtttaacccgggg

SEQ ID NO: 212612 - DNA, 1174 bp, Homo sapiens
  misc_feature: GYAE6OF01E3F1B.21.27.C05.1.454.CMB.1.raw
  modified_base (161)..(161): a, c, t, g, unknown or other
  misc_feature (161)..(161): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgaccgtgctgggcctcccagtggggtntcctgtcacagatacaaactacagcagtctggtccaggactgggtcgaggtccctcgacctacgtacccttttcacctccaccgttgtacgactacgtaccggtaaccgggggtaaaattggtaccgcgttcggacctaaaacgtaaaggttgggtttagggaagtttagggtaacgtttaacgggccttaccgggtcccccggtacgggtaacggtacgggtacccgtttaggacgggtttacgggtaccgtttaacggggtaaaccgggtaaccctttaaaggttttaaccgttaaccggttacccccggaaggggtttacggggtttaaacgttacgggtaaaaccgggttaacctttaacggttacggtaacccggttaaagggttaacgttttaccggttagggttacggggtaaacgggttccccggggttttaaccgttaacccgttaacccgtttaacccccggaaacttacccccccgtaaaaccccccgggtaacgggtaaccccgttaaacccccgggttaaaaccccgtaaaagggttaaacccgtttaccccgggttaaacccggggtttacccccttaaccccccccgtttaaaccccgtaaacccccgttttaaacggtttccgggtttttaacccctacccggggtttaacccgttaacccccgggttaaacccccccggggttaaacccggtaaacccccgggttaacccggggttttaaacccttttttaaacccgggtttttttttttaaacggtttttttacccgggggaaaccgggtttaaacccgggtaaaaccggggttaaaaccggggttaaacccgtttacccggttaaaccggtttaacgggttttaaccccccgggtttaacgggtttaaaacccccgttaacccgtttttacccccgggttttaaccggggtaacccccggttttaccccgggggtaaccgggggtttaaaccccgggtaaacccggggggtttttaaaacccgg

SEQ ID NO: 212613 - DNA, 630 bp, Homo sapiens
  misc_feature: GYAE6OF01EHFJ1.21.27.C05.1.454.CMB.1.raw
  modified_base (205)..(205): a, c, t, g, unknown or other
  misc_feature (205)..(205): n is a, c, g, or t
  modified_base (324)..(324): a, c, t, g, unknown or other
  misc_feature (324)..(324): n is a, c, g, or t
  modified_base (451)..(451): a, c, t, g, unknown or other
  misc_feature (451)..(451): n is a, c, g, or t
  modified_base (560)..(560): a, c, t, g, unknown or other
  misc_feature (560)..(560): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtcgtcgtccgagggggacnccgccaccctctcctgaccacagcctagtcagtctagtcgtctgactggttacgcctggtaccaggacaaagtaacgtcgtaggaccgaggtcctccgagtcctcctcgtagtttccgngcactccgacgacggcctagtcggtacaccgagaccgtggtcaggtgggacggtgtcggttacgggactaggtttacgtttctacctactactacgtcgacgccctacctacgagtacgtagaagtntcggtatacgttattttatcgtacgacctagtactaataacgttaactacgtcgtaccttgaaccgttcggaacgtaccggaccgttaacgggaacctaaagggttaanaaaccgttacgaaaccgtagggttcgacgtaaccttcggtaacccaacttgtacgtttccgcccgtttac

SEQ ID NO: 212614 - DNA, 963 bp, Homo sapiens
  misc_feature: GYAE6OF01BPXXS.21.27.C05.1.454.CMB.1.raw
  modified_base (161)..(161): a, c, t, g, unknown or other
  misc_feature (161)..(161): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtntcctgtcacagatacaaactacagctagtctggtccaggactgggtcgacggccctgcacgtaccctttcactctaccgtgtcgacacgttaccggtaaccggggaaaatcggtacgcgtacgggaccaaacgtaagttgggttaggtaagtttaggtacgttacggaccgtaccgttccccggtacggtaacggtaacggtccgttagggtacggttcgggtaccggttaagggtaacggttaaccgtttaacgtttaacggtaacccgttaccccggttaaggttacggggttaacgtacggtaaaacgtaacgttaagtcggtaacgtaaggttacttttaccggttagggttacggtacgggttacccgggtttaccgttaccgttacccgtaaacccgtaacccgtacccccgtaacccccggaacgttaacccgtaaacccggttaaccgaaaacgttaaccggttacccggtaacccgggtttacccccttaaccccgttaaccccgttaaacctttaaccgggtttcgtttacccggttaaccgttaccccgtaaccccgggttaacccccggtaaaccggtaaccggtaccggtttaacgtttttaacggttttttacggttttaacggtaacgtaaccggtaaagggttaaccgggtaacctttaaccggttaaccgttacggtttaccggtaacccgttaaccctttacccggttaccgtttaacccgggtaccccgtttacccgggggttaccggggttaacccggggttaaacgggttttaaccccggg

SEQ ID NO: 212615 - DNA, 672 bp, Homo sapiens
  misc_feature: GYAE6OF01BJRU9.21.27.C05.1.454.CMB.1.raw
  modified_base (161)..(161): a, c, t, g, unknown or other
  misc_feature (161)..(161): n is a, c, g, or t
  modified_base (609)..(609): a, c, t, g, unknown or other
  misc_feature (609)..(609): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctcgggcctccagtggggtntcctgtcacagatacaaactacagcagtctggtccaggactggtcgacggtccctgaccacgtaccctttcactctacctgtcgacacgtaccgtacgggaaatcggtcgctcggacaacgtagttggttacggagttaggtacgttacggccgtaccgttcccggaggacggacggtccgttaggaggtcggtacgtagggaacgtacttaattacgtaccgtaccgtaggtggtaacgtacgaagtactagtcgagtaactacgttcgttgtaggtcggtacggttcgtctacgtaccctacgtacccaacccgtagaaccgtacctaaccgtaagacgtacgtaccgtccctaccctaccaacttagtacttcctacgtcctacccgtaccgaaccgactacgtatttagtttacgttacgagtacgacggtagactcgtacgtnttacggtctacccgtacgttaccgtacgaccgttaccgggccgggtaacgttcgggtaacccg

SEQ ID NO: 212616 - DNA, 706 bp, Homo sapiens
  misc_feature: GYAE6OF01AV3QC.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgcacagccagtcagtctatcgctgacttggtagcctacggtaccagcagaaatcgtcggccacggcctcccgaggcctaccgtctacgttttaccgcgcctactcccaccgacgggccctacgttggtcgtacccgaggacctaggttcaagggttgggcggtaggtagtttgggactagggttacgttttcctacgtaccacctactacccgcgtacccgaccctaagaacgtaggtacgtaagtattcggttacggtacttaacgtttttactttccgacgtccctaaggtaactaaatttaacttaacgtttaccggtcggtacccgttccggtaccgggttaccggtaacccgggtttaccggaaccggtaacccggggaaccgttaaacggggtaaagaaacccggttaacgaaaaccgggtactttcgggaccggtacttaacggtacccaacgttactttacgtccgtttacgtttaccccg

SEQ ID NO: 212617 - DNA, 666 bp, Homo sapiens
  misc_feature: GYAE6OF01A36MG.21.27.C05.1.454.CMB.1.raw
  modified_base (161)..(161): a, c, t, g, unknown or other
  misc_feature (161)..(161): n is a, c, g, or t
  modified_base (265)..(265): a, c, t, g, unknown or other
  misc_feature (265)..(265): n is a, c, g, or t
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatgggggtntcctgtcacagatacaaactacagctagtctggtccaggactgggtgacggcccctgcacgtaccctttcactccacctgtagacatcgtacgggaaatgtcgntgcaacaagtggtgagttggataggcagtcccgtagagnggtccttggngtggtcgtaggaacgtaccgtaattacgtacgtaccgagttacggtagtagaaacgacttagtcgactaagtacttacgtggtacgtaggtcggttcgttctaccaaccgtacttcccgaaccccgacgtaacctaccgtaaccaaggaaactccgaaccgtccctacccctaacctaaccttacgtacgttcctacgtacctaacccgtacccgtaaccgaccgtaccgggttatttaacggttttatttacggtacgtacgtaaggacggtactacctattacgttcggtaactacccgttacccttcgttacgtaccgttcccgggtacgggtccgtaaggggttaccg

SEQ ID NO: 212618 - DNA, 922 bp, Homo sapiens
  misc_feature: GYAE6OF01BCDDW.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatacaaactacagcagtctggtaccaggactggtgacggccctcgcacgtaccctttcactcaccgtgtagactacgtacgtaccggggaaatgtcgcgttggaccaacgtaagttgggttaggtaagtttagggaagtttacgggacctaccggttcccccgtacggaggtacgggtccgtttaggtacggttggtacgttaggggaaacggtaccgttacgtttacgtaacccgttcccgtaacggttagggttaacgtacggaaacggtacgttaagtacggtacgtaaggttacgtttaccgtaggtacggtacggtaccgggtttcccggttaccgttaccgtaacccgttaaccttacccgaacccccgtaacggtaacccgtaaaccccgtacccgtaaaggtaaaccgttacccgtaacgggtttaccccttacccccttacccgtaaacccgtttaaccggttttacggttaccccgtttaccggttacccgtaacccccggttacccccggtaacgggtaacccgtaacccggggtttaaccttttaacggttttttttacggttttttaccggtaaccgggttaaccgtaaacggggttaccggggtaacttaccggtaacgtttaaccgggtttacccggtacggttaaacccccgtttcccgtttaccccggtttaccggtacccggtttaccgggtcccggggtaaacccgggttaacggggttttaaacccccggg

SEQ ID NO: 212619 - DNA, 636 bp, Homo sapiens
  misc_feature: GYAE6OF01BVWN3.21.27.C05.1.454.CMB.1.raw
  modified_base (161)..(161): a, c, t, g, unknown or other
  misc_feature (161)..(161): n is a, c, g, or t
  modified_base (456)..(456): a, c, t, g, unknown or other
  misc_feature (456)..(456): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtntcctgtcacagatcaaactacagcagtctggtccaggactgggtcgacggccctcgctacgtaccctttcactcacctgtcgacatccgtaccggggaaatcgtcgctcggacaacgtagtcggttaggaagttggtagttaggcctaccggtaccccggtaggacggtacggtccttggaggttggtcgttagggaacgtacttagttacgtaccgtcccgagttacggtagtacggtaagtactagtgactagtattcgtagtgagtcggtctctacactactaccacccganacacgtacaagactacgacgtcctaccctacctactatctctactcctaccgtacccgacgaccgtacgttacttatttacgttcgacgacgtaaggtacggtactcgtaacgtgttacggtacctaccttacccgttaccgtacgtacccgttccggcgggtaccggtggttaacccgg

SEQ ID NO: 212620 - DNA, 910 bp, Homo sapiens
  misc_feature: GYAE6OF01B2SB7.21.27.C05.1.454.CMB.1.raw
  modified_base (160)..(160): a, c, t, g, unknown or other
  misc_feature (160)..(160): n is a, c, g, or t
  modified_base (230)..(230): a, c, t, g, unknown or other
  misc_feature (230)..(230): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgaccgtgctgggcctccagtggggtntcctgtcacagatacaaactcagcagtctggtccaggactgggcgacggccctcgacacgtacccctttnacctccacctgtacgacattccggtaccggggtaaatcggtccgcgtcggacctaacgaagttcgggttaggtaacgttaggtagttacggaccgtaccggttccccggtacggacggtacgggtcccgttaggtacgggtcgggtacgtttacgggaaacggttaccttaagtttaacgtaccggtacccgtaaggtacggttagtacgtaaacggtaactagtacggtacgaaggttacgtttacgtacggtacggtacggttacccgggttcgttcctacccgtaaccctacgtaaccccctaaccccgtaacggtaacccgttaacccggtaaaccctaaaacgggtaaccttacccgggttaacccggttacccccttaacccccgttaaaccccgttaaccgttaaccgtttaccggtttaccctttaccggtacccttaacccccgttaaccccgggttaaacccggaacccggttaacccgggtttaccttttaaagggtttttaccgtttttacggtaaacggtacccggttaaaaggggtaccgttaaccgttaccgtaaccgggtttaccggtttaaccgggttccgtaaaccccgtttacccgtttaccgttccggttacccggtttaccgggtacgggggtacccgttaacggggtttaaccccggg

SEQ ID NO: 212621 - DNA, 654 bp, Homo sapiens
  misc_feature: GYAE6OF01CULTZ.21.27.C05.1.454.CMB.1.raw
  modified_base (160)..(160): a, c, t, g, unknown or other
  misc_feature (160)..(160): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtntcctgtcacagatcaaactacagctagtctggtccaggactgggtgacggccctcgcacgaccctttcactcacctgtgacatcgtaccggggaaatgtcgcgtggacaacaatggttagaattggataggcacgtcccgtgagagtcctgagtcggactggaagtacctattataccgtccaggtcgtagtagaaagtctatcgctagtattctggtgacggtcggtcgtactcaaccgtatcccgaacccagtaccaacgtaccgaaagtaacgtccgtacggtaccctcccctaccgtaaccttaacttgtcccgttagtaccctaaccgttacccggaaccgtaaccgtacgggtacttacgttttaacgttttcgagtaccgtaaggtacgggtacttcgtaacgttagtttacgggtaccttaaccttacccgttcccgttacgtacccgttcccgggtacggggtacccgtaaggggtttaacccgg

SEQ ID NO: 212622 - DNA, 682 bp, Homo sapiens
  misc_feature: GYAE6OF01C4XFA.21.27.C05.1.454.CMB.1.raw
  modified_base (207)..(207): a, c, t, g, unknown or other
  misc_feature (207)..(207): n is a, c, g, or t
  modified_base (327)..(327): a, c, t, g, unknown or other
  misc_feature (327)..(327): n is a, c, g, or t
tcagtcgtcgctcgcacgaccggtgctcgatttagacgcgatcgaagggtttgggggaggaactgctcagttaggacccagacccccggagccatggaagccccagcgcagcttctcttcctcctgcttctctggctccagacaccactggagtgattgtgatgacgcagtctccagccaccctgtctgtcgtctccgagggggacnccgccaccctctcctgccacacgccagtcagtctatcgctagacttggtacgccgtaggtaccagactaagaatcgtcggacacggtcctaccgacggtcctcctacttacgtttaccgngtactacgtacccaaccgacgggtccacgttggcctaccgagacgtaggtcaggtcggcggttggtaaggtttcgggatagttattttccacgtacaccgtatcgtacgccgtacctaagacgtagtacgtaaagtagttacgttgttacgttagttttatttccgtcgtaccgtaagtactaaattacgttaaattcgttacggtccttaggtaccgttacgggttaccgttacgggaaccggtaaacgggtaccggtaaacggttaacggtaaacgtaaaccggtaaacgtaacgttacggtacgggaccgttacgtaacccctacgttacttaccgttgttcccgtttaacc

SEQ ID NO: 212623 - DNA, 801 bp, Homo sapiens
  misc_feature: GYAE6OF01DNQCT.21.27.C05.1.454.CMB.1.raw
  modified_base (204)..(204): a, c, t, g, unknown or other
  misc_feature (204)..(204): n is a, c, g, or t
  modified_base (258)..(258): a, c, t, g, unknown or other
  misc_feature (258)..(258): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgcccacccttctccctggccacagccagtcagtctatcgctgactggttacncctggtaccagcaagaactcgtggccaggtcctcccgaggtcctcctactacgtttaccgtgacctacgtcccgaccgacgggccctacgttggtccgtaccccgaagaccgtagggtttccaaggggttcgggaccgggttaggtaggttttacggggaaccttagggttttaccgtttttccgaccgttaccgtaaacccgtagtttcccggaacggtccccggtaaccccgttaaccggtaagggtaacgggttaacggtaaacggtacgttttacgggtttaccgtaacggttttaaacgttttttaccgttttaccgtaccgggtaccccttaaagggtaacctttaaaagtttaaaccgtttaacgtttaaccggttaccggtacccgtttacgggtaccggtttacccggtaacgggtttacccgggaaccggtaaaccgggtaaccgtaagggtaacggtaaaccgttaaccgaaacggttacgtcggtacggtaactaccgtaacctacctaagttccgttagttccgttaccg

SEQ ID NO: 212624 - DNA, 749 bp, Homo sapiens
  misc_feature: GYAE6OF01B3S90.21.27.C05.1.454.CMB.1.raw
  modified_base (206)..(206): a, c, t, g, unknown or other
  misc_feature (206)..(206): n is a, c, g, or t
  modified_base (229)..(229): a, c, t, g, unknown or other
  misc_feature (229)..(229): n is a, c, g, or t
  modified_base (257)..(257): a, c, t, g, unknown or other
  misc_feature (257)..(257): n is a, c, g, or t
  modified_base (311)..(311): a, c, t, g, unknown or other
  misc_feature (311)..(311): n is a, c, g, or t
  modified_base (475)..(475): a, c, t, g, unknown or other
  misc_feature (475)..(475): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtcgtctccgaggggggacnccaccaccctcgtcctgcacacnccagtcagtctatcgctgactggttacnccgtgtacagcaagaatctgccacggtcctccaggcctcctactactttccggngcctactccgaccgacgggcccacgttcggtcgacccgagaccgttaggttaccgtaggtcggggtacggttgggtagtttcgggactaacggttagttttcctacctcccgtaactacgtaccgacgtcccgtaccctacgtaggtaacggttagaacggttntacggtttcggactttaacgtttttatttccgacggttaccgaagttacgtaaacctttaatttaaactttaccggttacggccggtttacggaaccgggtttccgttaaccggggttccgggtaacccggtaacccgggggtaaacccttaaagggggtaaaccggtaaaaaccgttaccccgggaaaaggtttaaccggttcggggtaacggttacccgaccggtaaccctacccgtttaacttacccgggttgtttaacccccgtttaacc

SEQ ID NO: 212625 - DNA, 733 bp, Homo sapiens
  misc_feature: GYAE6OF01D56FH.21.27.C05.1.454.CMB.1.raw
  modified_base (99)..(99): a, c, t, g, unknown or other
  misc_feature (99)..(99): n is a, c, g, or t
  modified_base (124)..(124): a, c, t, g, unknown or other
  misc_feature (124)..(124): n is a, c, g, or t
  modified_base (157)..(157): a, c, t, g, unknown or other
  misc_feature (157)..(157): n is a, c, g, or t
  modified_base (178)..(178): a, c, t, g, unknown or other
  misc_feature (178)..(178): n is a, c, g, or t
  modified_base (229)..(229): a, c, t, g, unknown or other
  misc_feature (229)..(229): n is a, c, g, or t
  modified_base (632)..(632): a, c, t, g, unknown or other
  misc_feature (632)..(632): n is a, c, g, or t
  modified_base (654)..(654): a, c, t, g, unknown or other
  misc_feature (654)..(654): n is a, c, g, or t
  modified_base (677)..(677): a, c, t, g, unknown or other
  misc_feature (677)..(677): n is a, c, g, or t
tcagtcgtcgctcgcacgaccggtgctcgatttagacgcgatcgaagggtttgggggcagagcctgctgacttctggctgaccagggcagtcaccgganctccagacaatgtctgtctcctccnatcttcctgcccgtgctgggcctccagtgggtntcctgtcactgatacaaactnagcagtctggtccaaggctggtacgcgcccctaggcctaacgtcccctttnactaccgtaccgtgtacgactacgttcggtaaccggggtaaaagtcgtccgacgtaggaacctaaacgtaagttgggttaggtaagttcggtaagtttaccggaccgtaccggttaccccgtagggaacggtacggtccgttagggacggtacgggtacgttacgggtaaccgtaaccttacgtacgtaccgtaccgtagtagtagtacgaagtactagtcgagtaattagttctggttacggacggttcggttaccgaccttacgaccctaataccccgaaccggaatacctaccgtacgtaaacagtacccgtaggcccttaccccacaaaccgtttatccgttactcgactacccgtacccgaacgtcccgtaaggttaccttagtttttacgttacggngaaacggtaacgtcggtaaacnccgtagtcgtttacccgggtaanacccgttcccttactccgggtaccttaccgggtcggtaacccggttagggttaccc

SEQ ID NO: 212626 - DNA, 758 bp, Homo sapiens
  misc_feature: GYAE6OF01B0KUD.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagccaccctgtctgtgtctccgagggggnccgcccaccctctcctgcacacgccagtcagtctactcgctgtacgtggttacgcccgttcggtaacccagacaagaaacgtcgtcggccgacggccctccccgaacggtcctcccgttacgtacttttacccggtgaccacgttccccgaaccggacgggcccgtacgtggttccgacccgagacgtacggttccgaagggtcgggtacggtggtacggtttaggggacctagtttacgttttcctactacccgtactacgttaccgacggtccgtaccccgtaagaggtaacgttaggaaacgtgttacgttcgttacgtttagttttaacgtttccgtacggaccgtaagttactaaacgtttaaattaacgtttaacgttcggtacccggttggtaccgggtttcccgggtaaccgggttccccgggtaccggtaacccgggggaaccgttaaacggggtaacggtaaacgtttaaaccggaaaccggtaaccggtgggttacgggtccgtacggtaccctaacctacggtcccttcgtttcgtttaccccg

SEQ ID NO: 212627 - DNA, 849 bp, Homo sapiens
  misc_feature: GYAE6OF01EKLCT.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggncgccaccctctcctgccacagccagtcacgttctagtcgctgtacgtggttacgccgtaggtaccagacaagtaaactcgtggccacgggtcctaccccgaggtccctaccgttaccgttaacgttttaccggcgacctactaccccgaccggacgggaccctacggttgggtacccgtacccgacggacgttacggttcgaggggtcgggtaccgggttagggtacggttttacggggaactaagggtttaccgtttttcctaccgttaccgtaacccgtagttacccggtaccggtaccccgtacccccgttaaacgggaacgggttaacggttaggtaaacggttaacgtttcgggtttaggttaccgttttaacgttttttacgtttcccggtcgtaacccgttaagtaccttaaaatttaacgttaaaccgtttaccggttaccgggtaccttaccggggttaccgggtttaacccgggtaccgggtttacccgggaaacccgggtaaccggggtaaacccggttaaaggggttaacccggttaaaacgtacccgggtaaaaccgggttacgttcgggttaaccggtaccgttaccggttaaccctacttttccggttaacgttttcccgttactaccccgg

SEQ ID NO: 212628 - DNA, 883 bp, Homo sapiens
  misc_feature: GYAE6OF01DUDUT.21.27.C05.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgtcttctctggcctccagacaccacgtggagtgattgtgatgacgctagtcctccacgcctacccgtgtctgtacgtccgtacgggacgggggcncccgcccgtaccctcgtccgtcgaccacgacgccgtaagtcgtacgttacctacgtccgtcgttaggtacgttacggtttaccgcccgttacggaaccacgaacgtaaagtaaccgttcggtaccggacccggtaccggtaccctaccccggtacggtccctttaccgttaccgtttaacgtttacccgcgtaccctaacccggtacccgaaccgggtccggtaaccgttacggttccggttacccgaacccgaaggtaccggttacggtacgaggggttacggggtaggttacggttacgggtttacggaactttacgggttttacgttccctacgtaacctaccgtttacgaccggtacccggtaacccgtaccgtaaaggtacggtaacgggttaaacggtaagttcgggtttaccggttaacggtttaactttttacgggttttactacccggtaacgtaacccgttaaagttaaacctttaaatttaacgtttaaccggttaacccggtcgttacccgttccgggttaccccgggttaacggtacccgggttaacccggaaccgggtaaacccgggtaacgtaaaccgggtaacgtaaaccgtaaaccgtaaacgtcggttacggacttaacgcgtaactcgttattcgtccttgttacccg

SEQ ID NO: 212629 - DNA, 554 bp, Homo sapiens
  misc_feature: GYAE6OF01BNQ5X.21.27.C05.1.454.CMB.1.raw
  modified_base (202)..(202): a, c, t, g, unknown or other
  misc_feature (202)..(202): n is a, c, g, or t
  modified_base (320)..(320): a, c, t, g, unknown or other
  misc_feature (320)..(320): n is a, c, g, or t
  modified_base (329)..(329): a, c, t, g, unknown or other
  misc_feature (329)..(329): n is a, c, g, or t
  modified_base (369)..(369): a, c, t, g, unknown or other
  misc_feature (369)..(369): n is a, c, g, or t
  modified_base (403)..(403): a, c, t, g, unknown or other
  misc_feature (403)..(403): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctgctaggctccccaggctcctctatttaccgtgcatccacagggccatggtntcccagacnggttcagtggcggtggatttggggactaggtagttttccnctcgacctatccagccgccctacagagtgaaagntgtgctaggttttattctcgccagtcaaagttataatttactggcctgcgttcggtaccgttcggaccgaacgggtaccaagggtaggaaacgtccgaaaacggtactaggtcggtactacggtaccaaccgatccgttgttcttaacccg

SEQ ID NO: 212630 - DNA, 755 bp, Homo sapiens
  misc_feature: GYAE6OF01BV06C.21.27.C05.1.454.CMB.1.raw
  modified_base (205)..(205): a, c, t, g, unknown or other
  misc_feature (205)..(205): n is a, c, g, or t
  modified_base (266)..(266): a, c, t, g, unknown or other
  misc_feature (266)..(266): n is a, c, g, or t
  modified_base (337)..(337): a, c, t, g, unknown or other
  misc_feature (337)..(337): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtcgtcgtccgagggggganccgcccaccccttctcctgccacgagccctagtcacgttctagtccgcttgacttggtacnccgtacggtaccacgacaagaaactcgtacggaccaggtacctcccgaggtcctacctcttacgtttccgnctactaccgaccgacggtacccacgttcggtacctacccgaacgtaccgttacggttcgcgggtacgggtccggttagtacggttacggaacgtgtttacgttttcctaccgtacctaactctaccgtacgtcccgacctaacgaggtaacggtagtaagtacgttgtacgtacgttactttacgtttacgacgtacgtaagtaactaacgttaacgtttaaccgttacgttaccggtacgttaccgtaccggttaccgggtaaccggtttacccggaacccgggtaaccgggtaaacccgtaagggttaaacccggttaaacgtaaacccggtaaaccggttaacggtacggttaccgggacccgttaaccgtaaccctacggttaacctttcggttaccgttccgtttaaaccccg

SEQ ID NO: 212631 - DNA, 623 bp, Homo sapiens
  misc_feature: GYAE6OF01AB8DZ.21.27.C05.1.454.CMB.1.raw
  modified_base (204)..(204): a, c, t, g, unknown or other
  misc_feature (204)..(204): n is a, c, g, or t
  modified_base (258)..(258): a, c, t, g, unknown or other
  misc_feature (258)..(258): n is a, c, g, or t
  modified_base (325)..(325): a, c, t, g, unknown or other
  misc_feature (325)..(325): n is a, c, g, or t
  modified_base (434)..(434): a, c, t, g, unknown or other
  misc_feature (434)..(434): n is a, c, g, or t
  modified_base (591)..(591): a, c, t, g, unknown or other
  misc_feature (591)..(591): n is a, c, g, or t
  modified_base (596)..(596): a, c, t, g, unknown or other
  misc_feature (596)..(596): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtcctccagccacctgtctgtgtctaccgagggggganccgccacctctcctgcacagccagtcagttctatcgcttagaccgttggttacnccgtaggtaccacgcaagaaactctaggcctaggcctccgacggcctccgtcgtacttttacccggngcctaactcccgaccgacgggtacccacgttcggtcgtaccccaggacgtacggttccgaaggttcggcgggtttaggtaacgtttcggggactagttcggttttaccncgcctacgtactcgacgtccgacctacgagtacgtgaagtagttcgtagcgttaatttttctagtcggactagactaagtattaaccgttgtaggccttaggcgttacgcgttcgacccggaggtaccgagtacgaaagtccgaaagtacgttcggngtacncgtacacgtactcggtacttcttacgg

SEQ ID NO: 212632 - DNA, 891 bp, Homo sapiens
  misc_feature: GYAE6OF01DHJ1S.21.27.C05.1.454.CMB.1.raw
  modified_base (230)..(230): a, c, t, g, unknown or other
  misc_feature (230)..(230): n is a, c, g, or t
  modified_base (877)..(877): a, c, t, g, unknown or other
  misc_feature (877)..(877): n is a, c, g, or t
tcagtcgtcgctcgcacgaccggtgctcgatttagacgcgatcgaaggggtttgggggaggaactgctcagttaggacccagacggagccatggaacgccccagcgcagtcttctcttcctcctgtcttctctcggcctccgaagaccaccacgtggagtgattgtgatggacgcgagttccaccgacgcccctacccgttgtctgtcgtccgaccgggaggggggaccnccgaccctaccgtctccgtgaccaccgacgcctagtctaagtctacgcgtactggtacgttcggtacgccgttacggacctagaacgtaagtaacgtcgcggaccgtaccggtccacccggtacgtcccttaccgttacgttaccgtttaccggactacccgtaaccgtaccccgaaccggtacgggtacccctacggggttaccggtaccgtaacccggaggtaaccggttacgggtaaccggttgggggtaccgggttagggtttaggggttaacggtttaacggggaaccgttttaacggttttaccgttttaccctaccggtacctaccgtaacggttaccccgtaccggaaccccggttaaccctaagggaacggttaacggtaaagtaagttaccggtggtttaaacccggttacttttaagggttttacccttcggaccgttaaccaaagttaaagttaactttaaacttccggtacggttccgaacggttccgttacccggttaccgggtccggtaaacccgggtacccggaacgggttaaacggtaaaacggtaaaccgaaaacggtacccgaaaaccgggttacggtcgggttacgaaccccttacccggtaccgttaccacgggtttacccttttntaacccggttaccc

SEQ ID NO: 212633 - DNA, 609 bp, Homo sapiens
  misc_feature: GYAE6OF01EI6TK.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtgacatcgtccggggaaaatgtcgctggcaacagtggtggattggattaggcacgtcccgtcgagacggccttggagtggtcttagggaacggtacctattagtacgtccgtagtcggtatcgaagactatgcagtattacgtgtggtaggtcggttctcgtccaactactcccaccccgaagtaaccgaccgtaccaagaacgtccacgtccctcccgtaccaccgtatcgtctctcaccgtacccgacgacctacgtcttagttttacgtttagcgacgtaaggtagggacttacgacgttagttaccgggtagtacccttacccttccgttcgaaccgttccggtcgggtacccggtaaggtttacccgg

SEQ ID NO: 212634 - DNA, 774 bp, Homo sapiens
  misc_feature: GYAE6OF01EUN3W.21.27.C05.1.454.CMB.1.raw
  modified_base (160)..(160): a, c, t, g, unknown or other
  misc_feature (160)..(160): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccagtggggtntcctgtcacagatacaaactacagcagtctggtaccaggactgggtgacggccctcgacacgtaccctttcacctcacctgtgactacgtccgaacgggtaaatcgtacgcgtcggacaacagttggttgaagttggtagttacggcgacgtccccgtaggagacggtccgttggagtggtcgttaggaacgtaccgttattaagtaccgtacccgtaggtacgtagtagaacgtactagtagtacgtagtattacgtggtacggtaggtccggttcgtacctacctacccgtacttacccgaaccccgtacgtaacgtacccgtaaccgtaaagtacgtacgtaccggttaccctaccccgtaccctaaccgttaacgttcgttaccgtccgttacccgtacccgttaacccggaacccggtaaccgtaacccgggttaaccttttaacgggtttttacgtttttacgggtcggtaacgtaaacggggtacgggtaacttaccggttaaccgttaggtttaccggttaaccgttaaccctttacccgtttacccgtacggttacccggtacccgggttaccgggggttaaccgtacggggttttaaacccggg

SEQ ID NO: 212635 - DNA, 789 bp, Homo sapiens
  misc_feature: GYAE6OF01C7TPI.21.27.C05.1.454.CMB.1.raw
  modified_base (213)..(213): a, c, t, g, unknown or other
  misc_feature (213)..(213): n is a, c, g, or t
  modified_base (348)..(348): a, c, t, g, unknown or other
  misc_feature (348)..(348): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccacgtggagtgattgtgatcgacgcacgtcctccacgcccaccttgtctgtcgtccgtcgggagggggacnccgcctacctctcctgacacgcgccagtctagtctcgccgtacgtgtacgttggttaccgccgttaggaccaggactaaagtaacgttccgacggacctacggcctccgacgtcctaccttcgttacgttccgtnacctactcccgacgtacggcctacggtcgtaccgtcccgaagtcggtacggtcgagggtcgggtagttacggttacgttcgggaactttacggttttctttcccactacccgacgttaccgtacggtacccggtcccgttaacccgttaaggaacgggttacgtaacgggtaatttacggttttcgggttaggtttaaccgtttttaaacggttttcttacccggtaccgacgttaaaccgttaattaaacgtttaaccttttacgggttaccggtcggtaacccggtttcgtaacccgggttacggttacccggggtacggaaccggggttaccgtaaacgggtaccggtaaaaaggaaccgtaaccgggtaaaccgttggttcggtaccgtacggttaacctacctaccgttagttacccgttgtacccttttaacccg

SEQ ID NO: 212636 - DNA, 921 bp, Homo sapiens
  misc_feature: GYAE6OF01EYHFT.21.27.C05.1.454.CMB.1.raw
  modified_base (254)..(254): a, c, t, g, unknown or other
  misc_feature (254)..(254): n is a, c, g, or t
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (644)..(644): a, c, t, g, unknown or other
  misc_feature (644)..(644): n is a, c, g, or t
  modified_base (673)..(673): a, c, t, g, unknown or other
  misc_feature (673)..(673): n is a, c, g, or t
  modified_base (675)..(675): a, c, t, g, unknown or other
  misc_feature (675)..(675): n is a, c, g, or t
  modified_base (840)..(840): a, c, t, g, unknown or other
  misc_feature (840)..(840): n is a, c, g, or t
tcagtcgtcgctcgcacgaccggtgctcgatttagacgcgatcgaagggtttgggggcagagcctgctgacttctggctgaccagggccgtcaccggagctccagacaatgtctgtctccttcctcatccttcctcgcccgtgcgtcgggcctcccgagtggggtgtcctgtcacagactacaaactacagcagtctggtccaggacgtggtgacggtcctcgcacgtaccctttcacctccacctgtcgaccntacgtaccgtaccgggaaaacgtacggtccggtccgtacggacgcccgtaacgttagggtttaggggtaagtttagggtaacgnaaaancgggtaccgtaaccggnttaccccccggttaccgggtaacgggtaacggggtacccgttttacgggtaacgggttacggggtaccggttacgggtaaacgggtaaaccccgtttaacgtttaaacgttaaccggttacccccgtaacgggttacggggttaacgttacggtaaaacggtaacgttaacgttacggtaccgtaacggttacgtttaccgtttacgggttacgggtaacgggtacccgggtttacccggttacccgttaaccccgtaaaccccgtaacccgttaacccccgtnaaacccccccgtaacccgggtaacccggncnccggtttaccccgtaaaacccgggtaaaacgttacccgtaaaccggggttaccccggttaacccccccgttaaccccgtaaccccgttaaaaccgttaccggttacccgttaccggttacccgtaacccgttacccccggtaacccggtaacccgtaacccgggnttaccgttaggttttacgtttttcggttacggtaccgtaacggtacgggtaacgtaccgtaccgtacgttaccgggttccg

SEQ ID NO: 212637 - DNA, 609 bp, Homo sapiens
  misc_feature: GYAE6OF01AGXJ2.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatacaaactacagcagtctggtccaggactgggtgacggccctcgcacgtaccctttcactcacctgtgacatcgtaccgggaaatgtcgctggcaacaatggttggattggattaggcagtccccgtgagaggccttgagtggctggaaggactattatacgtccagtggtatgaaagactagtgacagtattcgtgtaggtacggtcggtcgtctccacctatccctaccccagacctacgtaccaagtaactcacgttccctaccctacccgtaccttaactcgttctaccgttcctaacccgtccccgtaaccgaccgtaccggactttaagtttttacgttttgacgtacgaaggtaacggtactaccgtactagttccggtactaccttcccttccctagtaccctccggttcggggccgtagggttaccg

SEQ ID NO: 212638 - DNA, 735 bp, Homo sapiens
  misc_feature: GYAE6OF01DYW4R.21.27.C05.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtcgtcctccggagggggacnccgcccaccctctcctgacacacgccagtcagtctatcgactgactggttacgccgtaggtaccagacaagtaaatcgtggccaaggcctacccgacggtcctaccttactacgttttaccgcgacctactacccgaaccgacgggaccctacggttcggtaccgtacccgacgtaacgtacggttcgaagggtcggaccgtagggtcgggtaccgtagggtaactacgtacgttcctacgttcgtactacgttactagttaaccggactacggtaaccgtacgggtacgtacccgttaagggtaacgttacgttttaccggaaccgttaggtttacgtttaacttacggttacgtaacgtacgtaccgttaaggttaacgttacgggtaactttcccgtaacgttcgttacggtccgggttaacccgggaacgaaacgggttaaacccgaaagggttaaaccgtaaagtacggtaaaacgtacggttaggaaccgtcgtaacgacccgttaacctgtttcccgttaacg

SEQ ID NO: 212639 - DNA, 824 bp, Homo sapiens
  misc_feature: GYAE6OF01EO0TQ.21.27.C05.1.454.CMB.1.raw
  modified_base (207)..(207): a, c, t, g, unknown or other
  misc_feature (207)..(207): n is a, c, g, or t
  modified_base (620)..(620): a, c, t, g, unknown or other
  misc_feature (620)..(620): n is a, c, g, or t
tcagtcgtcgctcgcacgaccggtgctcgatttagacgcgatcgaagggtttgggggaggaactgctcagttaggacccagacggagccatgggaagccccagcgcagcttctcttcctcctgcttctctggcctcccagacaccacgtggagtgattgtgatgacgcagtctccagcccacctgtctgtgtcgtccggagggggcnccgccctaccctcttccgtgcaacgtgaccagtacctagtctactccggtcttacggacgtttggttacgcccgttaggtaaccgacgaccgtaacgtaaagttccgcgggacccgagggtccccttaccccggaggtcccttacccttccgttaacgtttacccggtgcccaccgttaccccgaaccggtacgggccctacgttcggtacccgtacccaaggacgttacgggttcgacggggtcgggtacggttagggttacggtttacggggaactttacggggtttaacctttttccggtaccttaaccgtaccctaacggtaccgtaccgtcccggtaacccgtagtaacgggtaacggttaaggtaacggttacggtttaggttacgttaccgtttaacggttttttnttaccggtaccggtaccctaaaggtaacctttaaagtttaaacgttaaaccgtttcggtccggtttaccgttacgggtacccgttacggttaccgggttacgggtacccgggtaaaccggaacgggtaaaggtaacgggtaaacgtaccgaaaggtacggtcgggttacgaccgttcgaccgtacttagttccttgtcttaccg

SEQ ID NO: 212640 - DNA, 766 bp, Homo sapiens
  misc_feature: GYAE6OF01BRCSH.21.27.C05.1.454.CMB.1.raw
  modified_base (124)..(124): a, c, t, g, unknown or other
  misc_feature (124)..(124): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcncatcttcctgaccgtgctggcctccagtcggggtctcctgtcacagactacaaactacagctagtcgtggtccaggtactgggtcgaccggtccctcgacctacgtacccctttcacctcctaccgtgtacgactacgttaccggtaaccggggaaagttcgtacggtcctaggacctaaacgtaaggttcggttaggtaacgtttagggtattacgggtacctaccgggtccccggtaggaacggtcgggtccttgggacggtcgggtacgttagggtaacggtaacctttagtttaccgtaccgttaccgaggttcggtaatcggaaacgtacgttacgtcgacgtaagtcttacgtagtacggtacggtccggttcgtcctaccaaccgtactacccgacccgagaccgtaaccgtaacgaacgtaacgtccgacgttcccctacccgtacctaacgtacgttcgtccttacgacccttaccggacccgtaccggtaaccgtcggttacttttaaccggttttgtttaccgagtcggtaaacggtgtaaaccttcggaaacgtttcggttacccggtacgtaccgtttccttaccgtacgtcccgttacggggccggtaaccgggttcggttaacccgg

SEQ ID NO: 212641 - DNA, 890 bp, Homo sapiens
  misc_feature: GYAE6OF01AF3ZL.21.27.C05.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagaccaccacgtggagttgattgtgatcgacgctagtcctccagcccacccgtgtcctggtcgtccgtccgggagggggacnccgccctaccccgttcgtcctcgaccaccgacgaccacgtcgacgttcctacgtccgcgttaggtaccgttggttaccgcccgttacgggtaacccaggctaaaacggtactccggtcggccgaccggtcctacccggacgtcccttccgtacttacccggtttaccgcgaccctaccgtaccccgaccggtacgggtaccccttagggttccgttaccggtaacccaacggtaaccggtacggtcgggtaacgggttcgggtacggggtttacgttaggtttacggaccttacggtttttcccgtttaccgtacccgttaccccaacgttcgaaccccggtaccggtacccgttaacccgtacgggtaagggtaacgtttaacggaaacggttcggtttccggtttaacgttaacgttttaaccggttttaccgtacccgtaaccggaccgtttaaacgtacgtttaaacttttaaccgttaacggtttcccggtaccggtttaccgcgggtttaccgttacccggttaaccggggtacccgaacccgggaaacggttacgggttaaacgggtaaagttaaaccgaaccggttaaacggtaccggttggacccgtttaccaacccggttacctaacgttccgttttacccgtcggtttacccttacccgg

SEQ ID NO: 212642 - DNA, 888 bp, Homo sapiens
  misc_feature: GYAE6OF01EAB0X.21.27.C05.1.454.CMB.1.raw
  modified_base (211)..(211): a, c, t, g, unknown or other
  misc_feature (211)..(211): n is a, c, g, or t
  modified_base (267)..(267): a, c, t, g, unknown or other
  misc_feature (267)..(267): n is a, c, g, or t
  modified_base (350)..(350): a, c, t, g, unknown or other
  misc_feature (350)..(350): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccacgcccaccctgtctgtcgtccgtccggaggggggacnccgccaccctctcctcgcacacgccagtcagtctactcgctcgacgttgggttacnccgtacggtaaccagacaaaggtaaactcgtacggaccgacggtcctaccccgacggtccttaccttacttaacgtttaccgngactacccccccctaggaccgtacgggaccctacggtcggttaccgaccaacggtacggtaggttacgaggggtcggggtacgggttaggtacgggtttacggggacttaacgggtttacgttttcctaccgtaacctaccgtacgtacccgtacggtaccccgtaccccgttaaggaacgggttaacggttaacggtaaagggttacgtttaacgggtttacggttaacgtttttaacgtttttttaacccgtttccggaacgttaaccccgttaaggtttaaaccttaaaacggtttttaaaccgtttaaaccggtttaacggttcccgggttaacccgttacggggttaccccgggttaaccggttaccgggtttaccccggggaaccccgggtaaaccggggtaaaccgggttaaacggggttaaaaccgggtaaaaccttaaaacccgggtaaacggttaacggttccggggtaaccggtcctaaccggtaccctaaccggttacgttttcccgttagtttcccttaaccccg

SEQ ID NO: 212643 - DNA, 724 bp, Homo sapiens
  misc_feature: GYAE6OF01EYGLG.21.27.C05.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (314)..(314): a, c, t, g, unknown or other
  misc_feature (314)..(314): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagcccaccctgtctgtgtctccgagggggganccgccacccgtctcctagcacagccagtccagtctatcgctgactggttagccgtggtacagcaagaaatcgtggccaggcctcccgaggcctcctntacgtttaccgngtaccactcccaccgtagggccctacgtggtctacccgaagtaccgtaggttccagggtcggacggttggtaagtttcggggaaccttaaggttacgtttttcgacctcctaacctattaccgacgcccgtacccctaacgaacggtcgttaaggaaacgttagttaggtttacgaccgtttaacgggttttttactttaccgtaccggtaacccgtaacggtaacccttaaagtttaacgtttaaacgttttacccggtcgggttaacccgttcgggttaccggttacccggtaaccgggtttcccggacccgtaaccggggtaaccgtaaacgggtaacgtaaaacgtacccgtaaaacggtacgtacggtacggactacgaccgtacaacttcgtccgtacttaccg

SEQ ID NO: 212644 - DNA, 845 bp, Homo sapiens
  misc_feature: GYAE6OF01CY19V.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtcctccttcctcatcttcctgcccgtgctcgggcctcccgagtcggggtgtcctgtcacagactacaaactacagctacgtcgtcggtccagggtactgggtacgcgggccctcgcctacgtaccctttcactccacctgtacgactacgtacggtaaccggggtaaatcggtcgacgtacggaactaaacgtaagttggttaggtaagtttacggtaacgtttcggaccgtacccgggttaccccggacggtaacggtaccgggttccgttagggtacgggttcgggttacggttacggggtaaacggttaaccgttaagtttaccgtaacccggttaccgtagggttaacggttacgtaacggtaaacgttaccgtaggttacgtaacgttacggttacgtttccggttagggtacggtaacgggttccggttaccgttacccgtaccgtaacccgtaacccgtaccccgtaaacccgtacggtaacccgtaaacccggtaacctaaacggtaaccgttaccggtacccgttaccccttaccccgtaacttaaccttacgttacgtaccttacgtacccctacccggttaaccgaaccggtaccgtaccggttacgttttaagtttttaccgttggaacgtacggtaagtaccgggtataccgtaacgttcggttacgtactaccttccgtacgttcgtaccgtcgggacggtcgttacggtttaccg

SEQ ID NO: 212645 - DNA, 760 bp, Homo sapiens
  misc_feature: GYAE6OF01BVHO8.21.27.C05.1.454.CMB.1.raw
  modified_base (204)..(204): a, c, t, g, unknown or other
  misc_feature (204)..(204): n is a, c, g, or t
  modified_base (254)..(254): a, c, t, g, unknown or other
  misc_feature (254)..(254): n is a, c, g, or t
  modified_base (333)..(333): a, c, t, g, unknown or other
  misc_feature (333)..(333): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccggagggggganccgcccaccctctcctgcacagccagtcagtctatcgctgacttggttancccgttaggtaacccagacgaaagtaaactcgtcgggaccacggcctccccgaggtccttcctactacgttttacccgngacctactacccgaaccggacgggtcccctaacgttgggttccgtaacccgagggtaaccgtacgggttacgtagggtcggggtacggttaggggtaacggttttggggaaccttaggtttacgttttcctccgttacacctagtaccacggccctaccctaagaaggtaagtacgaaagttacgttggtttacgtacgttttaagtttttacttcgtcggacccgtaaagtacttaaagttaacgtttaaactttacggtaccggtcccgttagggttacccgttaccggggttacccggttacccgggaccccgtaacggggtaaacccgttaaggggtaacccgaaaagtaaccggtaaacggacggtttggtaccggtaccgtacggtaccctaacgtagttcctttaacggttccttaaccg

SEQ ID NO: 212646 - DNA, 681 bp, Homo sapiens
  misc_feature: GYAE6OF01BGHMZ.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatacaaactacagcagtctggtccaggactgggtcgaggccctcgcagtacccctttcacctccacctgtgactagtcgtaccggggaaaatgtcgctggcaacaatggttggaattggattagcgacgtccccgtcgagacggcctggagtcggcgttagggaacggaccttattacgtacgtccgacgtggtatgaaagtactaacgtgacgagtattcgtagtgagtcggtcgtctacgaccacgtaccaccccgacgaccgtaccgtaacctaaagtaactaccgtacggtaccctaccccgtaccctaaccttaacgttacgttcctacgtcccgaacccttaccccggaacgaccgtaaccgtccgtttaacgttttacgttttacgtacgtacgtaacggtacgggtaccttacgaaccgttagttaccggtacgttaacccttaccgtccgttaccggtaccgttaccggtcggggtacccggtaacgggtttaacccggg

SEQ ID NO: 212647 - DNA, 664 bp, Homo sapiens
  misc_feature: GYAE6OF01DR8KC.21.27.C05.1.454.CMB.1.raw
  modified_base (360)..(360): a, c, t, g, unknown or other
  misc_feature (360)..(360): n is a, c, g, or t
  modified_base (483)..(483): a, c, t, g, unknown or other
  misc_feature (483)..(483): n is a, c, g, or t
  modified_base (539)..(539): a, c, t, g, unknown or other
  misc_feature (539)..(539): n is a, c, g, or t
  modified_base (567)..(567): a, c, t, g, unknown or other
  misc_feature (567)..(567): n is a, c, g, or t
tcagtcgtcgctcgcacgaccggtgctcgatttagacgcgatcgaagggtttggggggaagaggaagactgacggtcctgccacaggtggtgctgggcacggtgggccctcgcagaccctttcactcacctgtgacatcgtccggggaaaatgtcgctggcaacaatggttggaatttggattaggcagtccccgtcgagaggccttgagtggcttggaagacctatatacgtcccagtggtatgaagctatgcagtattctgtgagcggtcgtctcacatccacccagacacgtcaagatcagtctccctcacctatcgtctgtcacctccgaacacacggtactacgttttattttgngacgtaaggacggtatcgaacgtagtttcggtagtaccttacccttccgttacgaaccgttccggtagggggtacccaaggggttaaccgttttcgtacccgttaacccgtccttaccgtacnccggtcccctacccgaacccgtaacggcccctaagtcccggttccccttaccccgnggcccctacccgtgccctacgacggacnccctaccgcgtaagcgccacggaccggcccggtaccgtcggggcctccggccgttacggactaaaccggcctttaacccggtcccggaggtaacccg

SEQ ID NO: 212648 - DNA, 1046 bp, Homo sapiens
  misc_feature: GYAE6OF01BXEM1.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctcgggcctcccagtggggtgtcctgtcacagatacaaactacagcagtcgtggtccaggactggtgacggccctcgcacgtaccctttcacctccaccgtgtcgacacgtccgtaccggggaaaagttcggtcgcgtcggaaccaaaccgaaagttgggtttagggtaaagtttacgggaagtttaacgggccgtaccggttaccccccggtacgggaacggtacgggtccccgttagggtaggttacggggtccggtttacggggaaacgggttaacccgttaaagttttaacgttaaccccgttaccccgtaaggtttacggggttaacgttacggtaaacggtaaccgttaagtacggtaaccgtaacggttaactttaccggttagggtttacgggtaaacgggttcccggggtttacccggtttaccccgtttaacccgtaaccccgtaaccgttaaccccccgtaaacccccccgtaaccgggtaaaccccgttaacccccgggtttaaaaccccggtaaaacgtaaaacccgtttacccggttaaacccggggtttccccttaacccccccgtttaaccccctaaaaccccgtttaaaccgtttcccgttaccgtttaccggttacccccgttaaaccccgttccccccgggtaaaccggtaaccccgttaacccggggttaaccgttttaaccgggtttttttaacggttttttaccggtaacggtaacccggtaaaacgggtaacggggttaaacccgttacccgttaaacgttacccggttttaccggttaaccggttaaccccgtttacccgttaccccggttttacccggtacccggtttaccccggggtaccgggggttacccggttaaacccgggggttttaaacccggg

SEQ ID NO: 212649 - DNA, 1049 bp, Homo sapiens
  misc_feature: GYAE6OF01AN28I.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctcccagtggggtgtcctgtcacagatacaaactacagcagtctggtccaggtactggtgacggccctcgctacgtaccctttcacgtccaccgtgtacgactacgttaccggtaccggggaaaatcggtccgccgtagggaccaaaccgtaaggttggggtttaggtaaagtttcgggtaacgtttacgggacctaacgggttccccccgggtacggtaacggtaacgggtccccgtttaggggtaacgggtttacggggtaccggttttaacggggtaaacgggtaacccgtttaacgttttaaaccggttaaccccggttacccccggtaagggtttacgggttaaacggttaacggaaaacggttaaccgttaacgtacgggtaccgtaacggttaacgttttccggttacggggttacggtaacgggttcccgggtttacccggtttacccgttaaccccgtaacccgtaacccgttaacccccgtaaacccccggtaacggtaacccgtaaccccgggttaacccgtaaaacgggttaaacccgtttacccggtaacccggggtttacccccttaacccccggttaaccccctttaaacccgtttaaccgttacccggtttaccgtttaaccccgggttaacccgttaaccccggtaacccccggtaaaccggtaacccgtaacccgggtttaaccgtttttaacgggttttttaccggttttttaaggtaccggttaaaccggtaaacgggttaaccgggttaaccgttaacccggtaacgtttacgggtttaacccgggttaccgttaaacccgtttacccggttacccgtttacggttaccccggttacccgggtaccggggttaacccggttaaccgggggttttaaacccgg

SEQ ID NO: 212650 - DNA, 828 bp, Homo sapiens
  misc_feature: GYAE6OF01DOKDO.21.27.C05.1.454.CMB.1.raw
  modified_base (241)..(241): a, c, t, g, unknown or other
  misc_feature (241)..(241): n is a, c, g, or t
  modified_base (293)..(293): a, c, t, g, unknown or other
  misc_feature (293)..(293): n is a, c, g, or t
  modified_base (441)..(441): a, c, t, g, unknown or other
  misc_feature (441)..(441): n is a, c, g, or t
tcagtcgtcgctcgcacgaccggtgctcgatttagacgcgatcgaagggtttgggggagaactgctcagttaggacccaggacggagccatggaacgccccagcgcagccttctcttcctcctgcttctctggctcccagaccaccactggagtgattgtgatgacgcagtctccagcccactgtctgtgtccgcggagggggcccgcccaccctctcctgccacgcgccagtcagtctancgctgacgtgttacgcgtgaccagacaagaactcgtggccgtagccctccgnggtccttacctacgttactttccggacgacctacgtaccaaccggacggtcccaggttcggacccgtaccgaaggtacgtacggttacgaggggtcggtacgggtagggttacggtttacgggaaccgtttaacggttccgttttacncccgttaacctacgtaacgttccgaacccggtcccgttaaccccttaagggaacggttaacggttagggtaaacgttacggtttaggtttaccggttttaactttacggttttttaactttccgggtacgtacccgttaacgttaacctttaaagtttaacctttaaacggttttaccgggacggtttaccccgttcgggtttacccgggttaccggttaaccggttacccggggaaacccggttaaacccgggggttaaacgaaacccggggttaaaggaaacccggttaaaaacccgggtaaagttaacggggttccgaaccgggttcccggaccgtaacccgttaaccgttacttttaacccggttccgttaccgtttaacccc

SEQ ID NO: 212651 - DNA, 757 bp, Homo sapiens
  misc_feature: GYAE6OF01CQKL2.21.27.C05.1.454.CMB.1.raw
  modified_base (126)..(126): a, c, t, g, unknown or other
  misc_feature (126)..(126): n is a, c, g, or t
  modified_base (236)..(236): a, c, t, g, unknown or other
  misc_feature (236)..(236): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctnatctctgccctgctgggcctccatgggggtctcctagtcacagatcaaactacagctagtctcggtaccaggactggtacgacggcccctggaccacgtaaccccttttnactcacctgtcgacacgtcgtaccggggaaatcgtcgactggacaactagttggttacggtaattcggagttgctacggtccccggtagagacggtccgttagacgtcggtacgttaggaacggtaccttacgtttacgaccgttacccaggttcggtaacgtcgaacgtacgttacgtagtacctaggtacttaccgtggttacggaggttccggttaccgtaccttccaaccgttaacttaccccgaacccccgtaagtaacccgtaaccccgtaaccgtaaagttaaaccgtccgtaacccgggttacccgttaacccccttaccgaaacccgtttactaccgttccgttacgtaccgtaacccttaccccggaaccggtaacccgtaccggtacgttttaacgttttacgtttacgtcgttaaccgaacggttacggtactacgtacgttacgttacgtaccgtacccttcgtaccttagtacccgttccggtacgggtacgtaacgggtttaaccg

SEQ ID NO: 212652 - DNA, 734 bp, Homo sapiens
  misc_feature: GYAE6OF01BRII9.21.27.C05.1.454.CMB.1.raw
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (331)..(331): a, c, t, g, unknown or other
  misc_feature (331)..(331): n is a, c, g, or t
  modified_base (447)..(447): a, c, t, g, unknown or other
  misc_feature (447)..(447): n is a, c, g, or t
tcagtcgtcgctcgcacgaccggtgctcgatttagacgcgatcgaagggtttgggggaggaactgctcagttaggacccagacggagccatggaacgccccagcgcagcttctcttcctcctgcttctctggcctcccagacaccacgtggagtgtattgtgatgacgcagtcctccacgccaccctgtctgtcgtcgtcggagggggcnccgccaccctctccngcacgatccatcacgttcatcgctgacgttggttacgcgtacggtacagacaagtaaatcgtagaccgacgtccaccgacgtccttccgtacttaaccgtttccgngcctaacctcccgaaccgacgggtacccaggttacggctaaccctaggtaaccgtcggttacgacgggtacggtgggtaggttaggtttacgggaactacgttttcggttttaccncgtaaccgaacctagttacccgacggtccccgttaaacctaacggaaggttaacgtaacgtaaaacgtggtttcgttaggttacgtttaagttttacgttacctcggaacctaagtaacttaagttaattaaccggtacgtacggttccgtacggtaccgtaccgggtaacgttaccccggaaggtaccgggtaaaaccgaagggtaacggtaaaacctaaccggtaaaactacggtcggtaccgtgtaacccgtaaccttaccgattttacgtccgttaactcccg

SEQ ID NO: 212653 - DNA, 738 bp, Homo sapiens
  misc_feature: GYAE6OF01APV9V.21.27.C05.1.454.CMB.1.raw
  modified_base (217)..(217): a, c, t, g, unknown or other
  misc_feature (217)..(217): n is a, c, g, or t
  modified_base (293)..(293): a, c, t, g, unknown or other
  misc_feature (293)..(293): n is a, c, g, or t
  modified_base (317)..(317): a, c, t, g, unknown or other
  misc_feature (317)..(317): n is a, c, g, or t
  modified_base (698)..(698): a, c, t, g, unknown or other
  misc_feature (698)..(698): n is a, c, g, or t
tcagtcgtcgctcgcacgaccggtgctcgatttagacgcgatcgaagggtttgggggaggaactgctcagttaggacccagacggagccatggaagcccctagcgcagcttctcttcctcctgcttctctggcctcccagaccaccacgtggagtgattgtcgatcgtacgcacgttctccagcccaccctgtctgtgtcctaccggaggggggacnccgcccggaccctcgtccctgcgtaccgcgtccagtcagttcctgtcgactgacgttggtacgtccgtaggtaccngaccaaggtaattcgtacggaccncggtacctccccgacggtccttcctacgtacttacccggtgtcctacgtaccaccggtaggccctagtccggtacacccgaagtacgtacggttacgaggttacggcggttaggtaaggtttcggggaactacgggttttacgttttccgtaccgtaacgtaccccgtacttaccggaaccgtaccccgtaccccttaacggaacgggtacggttagaaacggttacgttgttaacccgtacgtttaacgttttcgttacgtacccgtactaacgtaacgtaaactttaataaccggtttccgtcggttaaccgtcggtccgttacgtacggttcccggaccgtacggacgtaagtacggaaacgttaccgaaagttccgnggtaacgctacgtaccgtactagtttccgctttcgtaccg

SEQ ID NO: 212654 - DNA, 639 bp, Homo sapiens
  misc_feature: GYAE6OF01DP1OM.21.27.C05.1.454.CMB.1.raw
  modified_base (516)..(516): a, c, t, g, unknown or other
  misc_feature (516)..(516): n is a, c, g, or t
  modified_base (593)..(593): a, c, t, g, unknown or other
  misc_feature (593)..(593): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtcgtcctgtcactagatcgaaactacagtcagtctggtccaggactggtgacggtccctcgctacgtacccctttcacctcaccgttgtcgactacgttcgtaccggggaaaatcgtcgcgtcggactaaacgtaagttggtagaagttggattacggcctacggtccccgtacgagacggtaccgttggaacggtggtacgttacgggaaacgttaccgtaattacgtaaccgtccaaggtggtatagaagtacctagtcgatagctttcgtggtacgacggtcggttccgtacgtcctaaccgtactacccaacccgtagtaaccacgtaccaagtaactcgaacgtctaccccncgtaactagtctctcgcaaccgtccgaagcacgtcttatttacgttgagtacgtaaggcgtcacgtactagtcggtntaccttacgtccgttaacgtactcggtaccgggctagggttaaccg

SEQ ID NO: 212655 - DNA, 624 bp, Homo sapiens
  misc_feature: GYAE6OF01AR5LN.21.27.C05.1.454.CMB.1.raw
  modified_base (203)..(203): a, c, t, g, unknown or other
  misc_feature (203)..(203): n is a, c, g, or t
  modified_base (249)..(249): a, c, t, g, unknown or other
  misc_feature (249)..(249): n is a, c, g, or t
  modified_base (303)..(303): a, c, t, g, unknown or other
  misc_feature (303)..(303): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtancctggtacagcaagaatcgtggccaggctccgaggcctcctctacgtttaccgngacactcccgaaccgcgggcctacgtcggtccgtcccgaggtacgtacggttcgagggtgggcgggttagagtttaggggactaggttacgttttctctaccacctatcgacgcccgtaccctaagacgtaagtagaagtattggttgacgttgttttacttcgtacgactagtactaattaataacgttaccgtcggtaccttcggtacggttaccgtacggttaccggaacccggacggtaaccgtaagggtaacggaaacgtaacgtaaacgtacggttcggacgtacctggaacctacgtattcgtacgttctaccg

SEQ ID NO: 212656 - DNA, 806 bp, Homo sapiens
  misc_feature: GYAE6OF01BI1Q4.21.27.C05.1.454.CMB.1.raw
  modified_base (125)..(125): a, c, t, g, unknown or other
  misc_feature (125)..(125): n is a, c, g, or t
  modified_base (668)..(668): a, c, t, g, unknown or other
  misc_feature (668)..(668): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttccncatcttcctgcccgtgctggcctccagtggggtctcctgtcatagatacaaactacagcagtcgtcggtccaggactgggtcgacggccctgacacgtaccctttcacctcacctgtcgacacgtccggtaaccgggaaattcgtacggctacggactaaacgtagttgggttagtaagttcggaagtttacggacctaaccggttcccccggtaggtacggtaccggttacctttagggtacggttacgggttaccggttaggggtaaaacccgggttaaccctttaaacggttttaccggttaaccccggttacccggtaacggtttaggggtaacctagggtaaaacgttacgtttaaaggcggtacgttaaacgttcgtttcggtgggtacggtaacggttccgggttaccttccgtaacccgtaccgaaccttacccggaaccccgtaggaacccgttaccgtaaaccggtaagtaaccgtaccgtaccggttaccccttacccctactaacccttaagttccgttcctacgtacccnccgtacccgacgtacgtacgttcttaaggttttcgttcgacgtacggtaagtacgacttaccgtacgttacggttacgtcccgtaccttacccgtacgttaccgacggtcccggtcgggtacgttacggggtttaccc

SEQ ID NO: 212657 - DNA, 734 bp, Homo sapiens
  misc_feature: GYAE6OF01AYCYY.21.27.C05.1.454.CMB.1.raw
  modified_base (206)..(206): a, c, t, g, unknown or other
  misc_feature (206)..(206): n is a, c, g, or t
  modified_base (337)..(337): a, c, t, g, unknown or other
  misc_feature (337)..(337): n is a, c, g, or t
  modified_base (437)..(437): a, c, t, g, unknown or other
  misc_feature (437)..(437): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccactggagtgattgtgatgacgcagtctccagcccaccctgtctgtcgtctccggagggggacnccgccctaccctctcctgcacacgccagtcagtctatcgctgacgttggtacgccgtaggtaaccagacaacgtaactcgtacggacctaggccctacccgaggtcccttccctacttacgtttacccggnaccgacgttaccccgaacgacgggtcctacgtcggtacctaccgagtacgtacggtcgaggtcgggcggttagtacgtttggaacgtagtttacgtttcncgtacgtactacgtcgaccgtccgtaccctaagtacggtacggtaagtaacgttacgtttaggttacgtacttttacggttttacgttccgtacgtacctaggttaacttaaagtttaacgttaacgtttacggtccggttaccttacgggttaccgttacccggttacccggttacccgggtaaacccggtaccgggtaaaccggtagggtaaaaccggtaaactaacccggtaaagtacggttcgacggtaccgtcggtaaccctacgttacgttccttacggttccttaacccg

SEQ ID NO: 212658 - DNA, 660 bp, Homo sapiens
  misc_feature: GYAE6OF01BZITQ.21.27.C05.1.454.CMB.1.raw
  modified_base (203)..(203): a, c, t, g, unknown or other
  misc_feature (203)..(203): n is a, c, g, or t
  modified_base (323)..(323): a, c, t, g, unknown or other
  misc_feature (323)..(323): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagccaccctgtctgtgtctccgaggggggnccgccaccctctcctgcacagccagtcacgtctatcgctgacgttggttacgccgtaggtaccagtacaaggtaaactcgtaggccacggtcctcccgaggcctcctctacgtttaccgngccactcccgaaccgacgggcctacgttcgggtactacccgagaccgtaggttacgacggtgggacgggtggtacgtttgggaactaggttacgtttctctacctactacgtcacgccgaccctaagagtacgtagaacgtagttgttagtcgttaagttttctacgtacgaccctaagtacttaagttaattaacgtttaccgtcggtacccttaggtaccggttcgttaccgggtaccggtacccggtaaccgggtaacgtaaacgggtaaggtaaactacggaaaaccgtcggtagtccggtacaacggtacctaacctattcttcgtccttac

SEQ ID NO: 212659 - DNA, 632 bp, Homo sapiens
  misc_feature: GYAE6OF01C680X.21.27.C05.1.454.CMB.1.raw
  modified_base (404)..(404): a, c, t, g, unknown or other
  misc_feature (404)..(404): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctcccatggggtgtcctgtcacagatacaaactacagcagtctggtccaggactggtgacggccctcgcacgtacccctttcactcacctgtacgacatccgtaccgggaaaatcgtcgctggacaacaagtggttaggtaattggaagttaggcgtacggtccccggtcgaaggacggtccgttgaggtggtcgttgggaagtaccttagttacgtacgtccctaggtggtatagaagtaactatgactagtacttntgtagacgtcggtcgtctcacctacacccacccgagaccaccgtacaatactcgacgtcctccctaccacgttaactcgtactcgtaccacctacccgaacgtaccgtacgtacgttagttttagtttcgacgtacgtaacggacggtactacgtacgttacgttcggtccttaccgttaccgttccgttaccgtactccggttacgggcgtaacgggtttaacccgg

SEQ ID NO: 212660 - DNA, 829 bp, Homo sapiens
  misc_feature: GYAE6OF01APBN7.21.27.C05.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagacgcgatcgaagggtttgggggaggaactgctcagttaggacccagacggagccagtggaagccccagcgcagcttctcttcctcctgcttctctggctccagacaccactggatgattgtgatgacgcagtctccagccaccctgtctgtcgtcgtccggaggggggacnccgccctacccgtctccgtacgccacgacgaccagtcgaacgttctactccggtcgtcgtaccgttggttacgtcccgttacgggtaacccaggtaccgtaaagaaacgttccggtacggaccgtaccggtccctaccccggtagggtccccttaccgttaccgttaaccgttttacccgggtctacccgtaaccgttaccccgaaccgggtaccggtaccccgttaacggtttcgggtaccgttacccgaacggtaaccgttacggttacgtacgggttcggggaacggtttgggtacggttacgggtactaacgggtttacgttttcgaccctcgtaacccgtacgtaccggtacgacccgttacccgtaacgacgggtaagtaacggtacgttacgtacgggttacctacggtttaacgttttacgtccgtacgtaaccgtataactttaaacttaacgttaccgttacggtccgtaacgtcgtaccggtaccgttacgggtacccgccgggttaaaccgtacgggtaacggtaaccgtaaacggtaacccgtaaaggtaccggtacggtaccgtagtacccggtacaacgttccttacggtttccgtaccgtttacccg

SEQ ID NO: 212661 - DNA, 648 bp, Homo sapiens
  misc_feature: GYAE6OF01BHMK0.21.27.C05.1.454.CMB.1.raw
  modified_base (209)..(209): a, c, t, g, unknown or other
  misc_feature (209)..(209): n is a, c, g, or t
  modified_base (633)..(633): a, c, t, g, unknown or other
  misc_feature (633)..(633): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccacgcccaccctgtctgtgtccgtcggaggggggacnccgcccaccctctcctgccacgacgcctagtcagtctatcgctagtacgttggttacgccgtacggtaaccagacaaagtaactcgtacggaccgacggtccctacccgacggtcccttccgttacttacgtttaccgcaccactacccgaccgacgggcctaggttcggtaccgtaccaaggtacgtacggttcggagggtcgggtcggttagtaggttacgggacgttacgtttcgtttcctccgtaccacgtactccgaccgtccgtaccgtaagacgtagtacgaagttgttgtatatttagtttctcgcactatacttaatagtacgtacgtcgtcgtcggtcgtacgtacggtacgaacggacggtaacgtaggaacgtaagtacgtaacgtaggtgtaccgtcgactacctacgttntacgttcgttctacc

SEQ ID NO: 212662 - DNA, 812 bp, Homo sapiens
  misc_feature: GYAE6OF01BGO3N.21.27.C05.1.454.CMB.1.raw
  modified_base (100)..(100): a, c, t, g, unknown or other
  misc_feature (100)..(100): n is a, c, g, or t
tcagtcgtcgctcgcacgaccggtgctcgatttagacgcgatcgaagggtttgggggcagagcctgctgacttctggctgaccagggcaggtcaccgganctccagacaatgtctgtcctccttcctcattccttcctcgcccgtgcctcgggaccctcccgagtcggggtcgtcctgtacactagactacaaaactcgagctagtcgtcggtaccaggtacgtgggtacgaccggcccctacggacctacgtaccccgtttacaccgttaccaccgttgacgaacgtaccgtaccggtaacggggtaaactcggttccgacgttacggacgtaaaaccgtagggttcggttaaggtaacgtttacggtaacggttacggaccggtaccggtttccccgggaacggtaacgggtaaccggtccgtttaggggaccggtttacgggtcgttaaacggggtaaacgtacctttaagttaaccgtaccggttacccggtaaggttacggtaacttaacgggaaactaacggttcgtaacgccgtaaagttcgttcggttaagcggtaacggcgttcgactactaccgtactacccgtacctaacgtaccgtacgaaaccgtacgtaaccgtacgttacccgtccgttaccccacttaaccgtactacggttcctaccgtacgttaaccccaccggtacaaccgtcgtactttagttacgttacgagacgtaacgcgtaaatccgtacgtacgttacgggtctacccgttacggtctacgggtacccgttacggcggtaaccggtgttaacccggg

SEQ ID NO: 212663 - DNA, 679 bp, Homo sapiens
  misc_feature: GYAE6OF01D45NB.21.27.C05.1.454.CMB.1.raw
  modified_base (203)..(203): a, c, t, g, unknown or other
  misc_feature (203)..(203): n is a, c, g, or t
  modified_base (418)..(418): a, c, t, g, unknown or other
  misc_feature (418)..(418): n is a, c, g, or t
  modified_base (445)..(445): a, c, t, g, unknown or other
  misc_feature (445)..(445): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactgttacgccgtggtacagcaagtaaatctggaccacggcctcccgaggtctaccctctacgtttacccgtgacctacgtcccaccgagggccctacggttcggtccggtacccaggtaccgaggtttccgaggtggggtccggtaggtaggtttcgggactaggttcgttttcnctccaccgtatcacgccgtccctaacngtaacgtgaacgtagttgtgtacttagttttcttacgtcgacctagactaaattacgttaaacgttcgtacggtacccgttggtaccggtaccggtacggttaccgggaccgtaaaccggggtaacgtaacggggtaggtaaaacctaaccggtaaaggtaacccgttgggtaccggtaccgttaccgaccgttaaaccctaggtttacccgttaccgtttccgtttaaccccg

SEQ ID NO: 212664 - DNA, 858 bp, Homo sapiens
  misc_feature: GYAE6OF01CMOCR.21.27.C05.1.454.CMB.1.raw
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (341)..(341): a, c, t, g, unknown or other
  misc_feature (341)..(341): n is a, c, g, or t
tcagtcgtcgctcgcacgaccggtgctcgatttagacgcgatcgaagggtttgggggagaactgctcagttaggacccagacggagccatggaagccccagcgcagcttctcttcctcctgtcttctctggcctacccgagaccaccacgtggagtgattgtgatgacgcacgtcctccagcccacctgtctgtcgtcgccggaggggcncgcccacctcgtcngccacgacgcgtagtcagtctacgtcgactgtacgtgtacgccttaggacagtacgaaagtaactcgacggacctacggccctaccggacgtcctacccgtactacgtttaccgacncctaaccgtcccgaaccggtacgggtaccctaacggttccggtccgtaacccgaaggttaccggttggttaccggaggttcgggggtacggttagggttaacggttgggaaccgttaaggttttccctttttaccgacgaccgttaaaccgtcgtaaccgtacccggtacccgtacccgtaaccggtaaggtaccggttaaaggtaacggttaacgtttacggttacggtttaaccgtttaacgttttaccgttaccggtaccgtaaccgttaaaccggtaactttaaaacgtttaacgtttaaccgttaccggttaccggtacccgttacggttacccggttaacccgggttaccgggttacccgggtaaccccgggtaaaccgggttaaccggtaaaaccgggttaaaccggtaaaccgttaaacccggtaacggtaaccggttacggttaaccggtccgttaaacggtacccgtaacgttaccctttacggttccgtttaacccgtttacccgg

SEQ ID NO: 212665 - DNA, 761 bp, Homo sapiens
  misc_feature: GYAE6OF01BQ9CG.21.27.C05.1.454.CMB.1.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccacgccacctgtctgtcgtcgtccggagggggacnccgacccaccctctccgngcacncgccagtcagtctactcgctcgtacgttggttacgtccgtacggtaaccacgacaagtaaactcgacggaccacggcctaccgacgtcctacctacttacgtttaccgcgaccactcccgacgacggacctacgtggtaccgtaccacgtacgtaggttcgaggtgggtacggtaggtacgttcggaacgttacgtttacgtttctaccgtactaccgtacgttccgaccgtcccgtaaccgtaacggaagtaacggtacgtaaagttgttacggtacgtttacgtttaacgttttacgttccgtacgtacgtaacgttacttaaacgttaacgttaaacgttcggtaccgtaccggttaccggttaccggttaccgggttccggttaaccgggacccggtaaacccggggttaacgtaaaccgggtaaaccggtaaaacgttaacccggtaaaagtaccgggttacggtacggttccgtaaaccgtaacccttaacgttaccgtttaccggttcgtttccccgtaacccg

SEQ ID NO: 212666 - DNA, 569 bp, Homo sapiens
  misc_feature: GYAE6OF01AL3XK.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactgggtgacggccctcgcacgtaccctttcactcacctgtgacactcgtaccggggaaaatgtcgctggcaacaagtggttggaattggattaggcacgtccccgtcgagacggtccttgagtggcttggaacggtacctattactacgtcccagtggtatggaagactagtgcagtattctgtgaggtcggtcgtctcaccactaccaccccagaccacgtaccaagactcacggtcctccctaccacctaatcgtctcgtcacctcccgacacgtacggacttagtttactttgacgtgaagaggatacgactagttcggtctaccgttacctccgttacgcctccggtgggtaccgtagggttaccgg

SEQ ID NO: 212667 - DNA, 809 bp, Homo sapiens
  misc_feature: GYAE6OF01CMKN8.21.27.C05.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccacgtggagtgattgtgatgacgcgagtcctaccagcccaccgtgtctgtcgtcgtccggagggggcnccgccctaccctctcctcgaccacgacgtccaagtcgtaacgttctacgtccgtcgtagtaccggttggttacgtcccggttacggaccgagacgtaaagtaacgtccggcggacgacggtccctaccgacgtctcctacttacgttaccgctaccgaccgttaccgaccggtacgtaccctacggttcggtaccgtacccgaagtaccggtaacggttacggacggggtcgggtacggttaggtttaacggttacgggtaacgttaacgtttttaccgtttctaaccgttaccgtacctaacgtaccgtaccgtaccccgtaacctaacggtaagggtaacgttaggtaaacggtaaggttcgttaacggttagttttaccgtttaagtcccgtaacgtacccttaaagttacttaaagtttaacgttaacgttccgtaccggtcggtaccggttaaccgtcggtacccgggtacgaaccgggtaaggaacccggtaagggtaaaccctaaagtaacccggaaaagggtttcctaacggggtacgtaccgtaaacggttcccctaagtttaccggtcctttaccggtctttaaccccg

SEQ ID NO: 212668 - DNA, 990 bp, Homo sapiens
  misc_feature: GYAE6OF01DZT21.21.27.C05.1.454.CMB.1.raw
  modified_base (99)..(99): a, c, t, g, unknown or other
  misc_feature (99)..(99): n is a, c, g, or t
  modified_base (125)..(125): a, c, t, g, unknown or other
  misc_feature (125)..(125): n is a, c, g, or t
  modified_base (160)..(160): a, c, t, g, unknown or other
  misc_feature (160)..(160): n is a, c, g, or t
tcagtcgtcgctcgcacgaccggtgctcgatttagacgcgatcgaagggtttgggggcagagcctgctgacttctggctgaccagggcagtcaccgganctccagacaatgtctgtcctccttcncatcttcctgcccgtgctcggcctccagtggggtntcctgtcacagatacaaactacagactagtctcggtaccaggtacgtggtcggaccgccctcgactacgtaccctttcactcactgcacagtcgtacgggaaatcgtcgcgtaggacaacgtaagtaggttacgtaagttggtaagttacggacgtaccggtccccgtacggacgacggttcctaggtagggtcgtacgttaggtaacggtaccttaagttaacgtaaccgtaccgtaaggttaccggtaaagttacgtaaacgtaccgttaagtacgtacgtaaacgttacgtttacgtagggtacggacggtttacccggttacgttacccgtaaccgtaaccctaccgtaacccccgtaaacccccggtaacgtaaaccccggttaaaccgtaacccgtaaaaacgttaaccgtttaaccccggtaaaccgggtttacccccttaaccccccggttaacccgtttaaaaccccgtttaaaccggtttccggtttaacccgttaccggttaacccgttaaccccccgttaacccccggggaaaacccggtaaaccccgggttttaacccggttaaccgttttttaaaccggttttttttaacggtttttacccggggttaaaccggtaaaaccgggttaaacgggttaaccccgggtaaacgtttaacccggttaaacccgggtttaaaccggtttttaccccggggaaccctttaaacccccgttttaaccccgttaccgggtttaaccccggttaacccgggtttaacccccggggttaacggggtaaccccccggggtttaaaagggggttttaaaccccccggg

SEQ ID NO: 212669 - DNA, 775 bp, Homo sapiens
  misc_feature: GYAE6OF01AHPE6.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccagtggggtgtcctgtcacagatacaaactacagctagtcgtggtccaggtactggtgacggccctcgcacgtaccctttcactcacctgtagacacgtaccgtaacggggtaaatcggtccgcgtggaccaacgtaagttgggttacggtaagtttaggagtttacggaccgtaccggttcccccggtacggtaggacggtacccgtttaggaggttcggtacgttagggaaaccggtaccttaacgtttaacgtaccgtacccgtaggttacggtaacgtagaaacgtacgttagtcggtaactagtagttacgtggtaggtacggtccgggttacgtccgtaccgaccctacgtaccccgaaccccgacgacccgtaaccgtaaccgaaacgtaaccgttacgaccgggttacccctaccccgttaacccgtaaccgttaacgttccgttaccgtaccggttaacccaacccgtaccccggtaaccgtaaccgttaccggtacgttttacgttttacgtttacggcgtaacggaggtacggtacacgtacgtacgttacggtcctaccgttaccgtccgttacgtaccgtaccggtacgggtacccggttagggttaacccg

SEQ ID NO: 212670 - DNA, 753 bp, Homo sapiens
  misc_feature: GYAE6OF01DFXJN.21.27.C05.1.454.CMB.1.raw
  modified_base (160)..(160): a, c, t, g, unknown or other
  misc_feature (160)..(160): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctcccagtggggtntcctgtcacagatacaaactacagctagtctggtccaggactggtcgacggccctcgcacgtacccctttcactccacctgtagacagtccgtaccgggaaatgtcgctcggacaacagtggttagaattcggattacggcctacggtccccggtacgaggtacggtccgttggaggtcggtcgttagggaacggtacttagttactaccgtcccgtaggttggtagtagaacgtactagtagactagtacgttcgtgtagacggtccggttcgtctaccgacctaccgtacccgaaccccaacgtacccgaaccgttaccgaaacggtaacttacccgaccgggttaccctacccccgtaaccctaacccgttaactttccgttaccgttaccggttacccgtaacccgttacccccggaaccggtaacccgtaccgggttaccttaacggttttttacgtttacgtacgtaacggtaacggtacgggtacctacgtaacgttacggtttaccggtacgttaaccccttaccgttaccgtttaccgtacccggttccgggttacggggtaccggttacgggtttaacccggg

SEQ ID NO: 212671 - DNA, 772 bp, Homo sapiens
  misc_feature: GYAE6OF01BCKOY.21.27.C05.1.454.CMB.1.raw
  modified_base (207)..(207): a, c, t, g, unknown or other
  misc_feature (207)..(207): n is a, c, g, or t
  modified_base (259)..(259): a, c, t, g, unknown or other
  misc_feature (259)..(259): n is a, c, g, or t
  modified_base (306)..(306): a, c, t, g, unknown or other
  misc_feature (306)..(306): n is a, c, g, or t
  modified_base (548)..(548): a, c, t, g, unknown or other
  misc_feature (548)..(548): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattggtgatgacgcagtctccagccaccctgtctgtcgtctccggaggggggacncgcccaccctctcctgcacacgccagtcagtcttactcgctgacttggtacnccgtaggtaccaggactaagaaacttcgcggccgaggtcctacccgnggtccttcctactacgtttaccgcgacacgtccgaacccggacggtaccctacgttcggtaccgtcccgaaggtaccgtacggttcgaagggtcggggtacgggttaggtacgtttacggggaacttacgggtttacgttttccctaccgtaccaaccgtacttacccggacgtaccccgtacccgtaaggacggttaagtaacggtaacgtaggtttacgtagttacgtttaacgtttttntacccggttacgacttacggtaacttaaacgtttaattaaccggtttaccggtcggtaccctttacggtcccggttaccggttaccggttcccgggaacccggtaccgggggtaactaaacgggggtactaaaaacccgggtacgtaaaacgggttacggttcgggtaccgtaaccgtaccgaccccgtaccgttacgtttacccgttccgttcgttaaccccg

SEQ ID NO: 212672 - DNA, 699 bp, Homo sapiens
  misc_feature: GYAE6OF01EIX13.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctcctctcatcttcctgcccgtgctgggcctccagtggggtgtcctgtcacagatacaaactacagcagtctggtccaggtactgggtcgacggtcccctcgaccacgtacccctttcacctccaccttggtcgactaagtccgtaaccgggggaaaattcgtcgcgtggacaaactaagttggttaggaagttggtattaggctacggtccccgtggagacggtccttggagtggacttagggaacgtacctattacgtcgtaccagtggtatacgaagtactagtcgacgtagtattcgtagtacgtacggtcggttaccgtctacctaaccgtactacccgaaccccaggtaacctacgtaacctaaggacttaccgacggttcctacccctcctaaccttaagtgtaccgttcgactcccgtacccggaccgtaacctaccggtactttaagtttttattttaccgggctaacggaacggtagggtaacctaccgttaacgtacggtttcgggtccctaacccgttacccttcccgttagtaccgttacccgggtcggggaccgtaaggggtttacccg

SEQ ID NO: 212673 - DNA, 879 bp, Homo sapiens
  misc_feature: GYAE6OF01DVZ03.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctccagtgggtcgtcctgtcacagatacaaactacagctagtcgtcggtaccacggtacgtgggtcgacggtccctcgccacgttacccctttcaccgtccaccgttgtagacctacgtaccgtaccggggtaaaatggtccgcgtacggactaacgtaagttcgggttaggtaagttggtaacgttacggctaaccggtccccggtacgaggtacggtccgttggacggtcggtcgtagggaacgtaccttattactacgtcccgaggtcgtagtagtaagactgtaggactagtacttcgtgtaggacggtccggttaccgtactaccgtacccgtaactaccccgaaccccgtaaacgtacccgaaacccgttaaccgtaaaacggtaaccgttaccggaaccgggtttacccccttaccccgtaacccctaaaccgtttaacgttaccgttcccggtttaaccgtacccttaaaccccgtacccccgggttaacccggtaaccgttaaacccgggttaccggtttttaaagttttttaccgttttttacgggaacgggtttaaaacccggttaaacgggtaccgggttaacttaaccccgggtaacgtttacccgggtttaaccgggttaccgttaaaccccgttaaccccgtttcccggtttaacccggtaccccggtttacccggggttcccggggtaacccggttaaacggggttttaaccccggg

SEQ ID NO: 212674 - DNA, 850 bp, Homo sapiens
  misc_feature: GYAE6OF01DYEVH.21.27.C05.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatcgacgtcagtcctccacgtcccacctgtctgtcgtctccggaggggggacnccgccctaccctctcccgtgaccaacgacggtacctaggtacctaagttacctacgttccggctaggtaccgttagggttacgcccgttagggaccacggacaaggtaacgtccggtacggacccgtaacgggcccttacccggagggtcccctaccttacgttaaccgttttaccggacgacctacctacccgtaaccggtacgggcccttaaccgggttccggttacggaaccccgaggtaccgttacgggttacgtacggggtacggggtacggttaagggttacggtttacggggaacttaacggggttttaccgtttttcctaaccggtaccctaaacccgtagtccccgacggtacccccggtacctaacggtaaggtaacgtacggtaaacgtcggttagttacggtactttttaacggtttactttccggtaccgtacgaaacgttaccttaaagtaacgttttagtaaccggttcgacccggttaggtaccgggtacggttacccgggttaccgaaccggggttaaccggggtaaccggtaaagtaaacgggtaaaacgtaccggtaaaccggtcgtttacggcggttaacccgagacctacccgtaaagttcgttcttacccgttaccg

SEQ ID NO: 212675 - DNA, 733 bp, Homo sapiens
  misc_feature: GYAE6OF01CYRPU.21.27.C05.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagccaccctgtctgtgtctccggagggggacnccgcccaccctctcctgaccacgacgccagtcagtctactcgctgacgttggttacgcgtagtaccagacaagaactcgtacggaccgaggccctaccgacggtcctacctactaactttaccgcgacctactaccccgaacgtacgggccctaaggttcggtaccgtacccgaagtaccgtacggtttaccgagggtcggggtaccggttggtaacgtttcggggaacttagggtttactttttccaccgtacctaaccgtagtccgacggtcccgtaacccgttaagaagtagtaggaaagttactcggtttacgacgttttacggttttacttccgtacgaccctaagttaacaaagtttaacttaagttcccggcggtacctggtaccggtacttaacccgggttacgacccggtaaccgggggaacgtaaaaggggtacgtaaaaacgtaacccgtaaaacgggtacttcggttacgggaccttacggaacccttaagtacgttcttccggtttacttacccg

SEQ ID NO: 212676 - DNA, 905 bp, Homo sapiens
  misc_feature: GYAE6OF01AR08W.21.27.C05.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatacaaactacagcagtctggtccaggactggtgacggccctcgcacgtaccctttcactcacctgtcacntccggtacgggaaatcgtacgcgtggacaacgtagttggttaggaattaggagttcggacgtaccggtccccggtaggacggtacggtccgttaggaggttcggtcgttacggggtaacgtaaccttaagtttaccgtacgttcccgtaggttacggttaagtaggtaacgtaacgttacgtcggtacgtaggttaccgtttagttacgggtagggtaccggttccggttaccggtttaccctaacccgtaaccttaacccgtaacccccgtaaaccccgtacggtaaacccgttaacccggtaaaccggaaaacttaaccggtaccggttaacccggtttaccccttaccccccttaaacccgtttaaacccttaacggtttaccgtttacccgtacgttaaccccgtaaccccggtaaccccgggttaacccggtaaccgttacccggtttaagttttaccggttttttaaggttttaccccggtaaggaacccggttaaaagggggtaccggttaaacgtaaccccggtttaaggttaccccgggtttaaccgggttaacccgtttaacccgtttaccccggttttacccgttaccgggttaacccccgtttaccggggtacccgggggttaacccgttaaaccggggggttttaaccc

SEQ ID NO: 212677 - DNA, 749 bp, Homo sapiens
  misc_feature: GYAE6OF01BD4NB.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagactacaaactacagcagtcgtggtaccgaggtacgtggtgacggcccctcgccacgtacccctttcaccgtccaccgtgtcgactacgtaccgtaccggggaaaatcgtacgtcgtacggactaacgtaagttagggttaggtaagttaggtaacgttacggtccgtacggtccccggtacggacggtacggtccgttaggaggtcggtcggttacgggtaacggtaaccgttagtttaccgtaccgttaccgtaggtggttacgtaagtaaacgtacgtagtagtacgtaagttacgttacgtcggtaggtacggtccgggttccgtccgtaccgcctacctacccgaacccgacgaacccgtaccgtaaccgaacgtaccgtacggtaccgttaccctacccctaaccctaaccgttactcgttacgtaccgtccacccgttaccccgacgaccgtacggtacttacgtttttagttacgtacgtagtacggtagtaccgtacgtacgtagttcggacttacccgttacttaccgttacgacggttacccggtacgggtccgtaacgggttaccg

SEQ ID NO: 212678 - DNA, 767 bp, Homo sapiens
  misc_feature: GYAE6OF01DSOA6.21.27.C05.1.454.CMB.1.raw
  modified_base (99)..(99): a, c, t, g, unknown or other
  misc_feature (99)..(99): n is a, c, g, or t
  modified_base (126)..(126): a, c, t, g, unknown or other
  misc_feature (126)..(126): n is a, c, g, or t
  modified_base (163)..(163): a, c, t, g, unknown or other
  misc_feature (163)..(163): n is a, c, g, or t
  modified_base (440)..(440): a, c, t, g, unknown or other
  misc_feature (440)..(440): n is a, c, g, or t
tcagtcgtcgctcgcacgaccggtgctcgatttagacgcgatcgaagggtttgggggcagagcctgctgacttctggctgaccagggcagtcaccgganctccagacaatgtctgtctccttcctnatcttcctgcccgtgctcgggcctcccgagtggggtntcctgtcacagactacaaactcagcagtcgtggtccaggacgtggtcggacggccctcgctacgtacccttcacctcaccgttgtacgactacgtaccggtaaccggggaaatcggtcgtcgtacggactaacgtaagttggttacgtaagttaggtagtacggcgtaccggtccccggtagtaggacggtccgttaggacggttacggtcgttagggaacgtaccgttaattaccgtaccgtcgtagtggtaacgtagaacgtatagtgactagtntttacgtggtagtacggtcggttacctctaccaccgtactaccccgaaccctacgaaaccgtaaccgtaccgaaacgtaaccttcggacccgttccctaccccgtaccttaaccttaggttccgttaccgttacgtacccgaccccgttacccggaaccggtaaccggttaccgttacggttttactttttacgtttggaaccggtaacgtaaggggtacggtacctaaccgtcgtttaaaccgggtcggttaacccttacccgttaccgttccgttacccggttaccggtccgggttaccggggtaccgttaaggggtttaacccg

SEQ ID NO: 212679 - DNA, 709 bp, Homo sapiens
  misc_feature: GYAE6OF01CU1QM.21.27.C05.1.454.CMB.1.raw
  modified_base (202)..(202): a, c, t, g, unknown or other
  misc_feature (202)..(202): n is a, c, g, or t
  modified_base (698)..(698): a, c, t, g, unknown or other
  misc_feature (698)..(698): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgcacagccagtcagtctagtcgctgacgttggttacgcccgtaggtaacccagtaccaaggtaaaacttcgtacgggacccaggtccctaccccgaggtcccttacccgttactacgttttaccgtcgacctaccttccgaaccgacgggtccctacgttcggtccgtacccaaggaccgttagggtttaccaggggtcgggtaccggttaggtaggtttcgggaacgttagttacggtttttcaccgttacgaccgagttccgaacgtcccgtacccgtaagaggtacgtagaagtagttcggttcgtacttagttttacttcgtacgacctagtacgtaattaactaacgttctcggtccgtacggtcgttacgtaacggttcggaaaccggtaacgggtaaccggtaaagggtacggtaaaacgtaccgaaaacgttacggtcggtacgtagtacgtaccgtaactattacccggttnttccgttaccg

SEQ ID NO: 212680 - DNA, 799 bp, Homo sapiens
  misc_feature: GYAE6OF01EFUCN.21.27.C05.1.454.CMB.1.raw
  modified_base (99)..(99): a, c, t, g, unknown or other
  misc_feature (99)..(99): n is a, c, g, or t
tcagtcgtcgctcgcacgaccggtgctcgatttagacgcgatcgaagggtttgggggcagagcctgctgacttctggctgaccagggcagtcaccgganctccagacaatgtctgtctccttctcatcttcctgcccgtgcgtggccctccagtggggtcgtctgtacacagactaccaaactacagctacgttcgtcggtccgacggtacgtgggtacggaccggcccctcggacctaccgttacccctttcaccgtcctaccgttcgtcgaactacgtaccggtaaccggggtaaactcgtcgcgtcggacaactagtacggttaggtaacgttggtaagttacggctaccggttccccgtaggacggtacggtccgttaggtacggttaggtcggttacgggaacgtaccttaagttacgtaccgtaccgtaggtaggtaacgtaggtaaacgtactagtacgtacgtagttacgttcggttaggacggtaccgggtacgtttccgtacccttaaccgaccctaaccctaccccgaacccgtaacgtaaccgtaacccgtaacaaaccgtacgtaccgtacccgttacccttaacccctaccgtaaccgttaacttcggttacctaccgtaccgaaccccgttaccgaacccgtacgtaccgttattttaacgtttgtttacgacgtaacggtaggtacggtacctaacgttcggttacgttacggtaccgttacccgttaccgttaccgttacgaccgttacccggggtacggtaaccgggttacggttacccgg

SEQ ID NO: 212681 - DNA, 688 bp, Homo sapiens
  misc_feature: GYAE6OF01EOTST.21.27.C05.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctacccaggcctcctctactttaccgngtccaatcccgaaccaggggcccctacgttggtcgtaccccgaagtaccgtacggttacagggtcgggtccgggtaggtagtttacgggaactaggttacgttttcacgtacaacctagtccaggcccgtaacccttacgaaggtacgttacgaaaacggtgttcggtttacgacgtttaaggtttttaacttttccgtcgtacctaaggtactaaattaacttaaactttaccgggtcggtacccgttacgtccggttaaccgttacgggtttaccggaaccgtaaaccggggaaccgttaaacgggtaacggtaaacgtaaccgtaaaagtacggtagggtcgtaccgttcgaccgtactaattcgttcgttccgtttaccg

SEQ ID NO: 212682 - DNA, 750 bp, Homo sapiens
  misc_feature: GYAE6OF01BCNS2.21.27.C05.1.454.CMB.1.raw
  modified_base (159)..(159): a, c, t, g, unknown or other
  misc_feature (159)..(159): n is a, c, g, or t
  modified_base (229)..(229): a, c, t, g, unknown or other
  misc_feature (229)..(229): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtntcctgtcacagatcaaactcagcagtcgtggtccaaggctgggtcgacggccctggcacgtacccctttnactcacctgtacgactctccgtaccgggaaatcggtcgctcggcaacgaagttggttaggaattggagttacggctacggtccccgtacggacggtacggtccgttaggacgtggtacgttagggaacgtaccttagttactaccggtccctaaggtcgtagtaggaacgtacgtagtacgacgtaagtacttacgtgtaggtacggtccggttacgtccgtaccgtaaccgtacttacccgaaccccgtagtaacccgtaccgtaaccgaaacgtaaccttaccggaaccggttcccctaccccgttaccctaacccgttaacgtcgttaccgtacggttaccctacccggtacccgtaaccggtaccgtacccggttacgtttacgtttttagtttacggtacgtaacgtaaagggtacggtaacttaccgtacgttaacgttaccggtacgtaacccgttaccgttacccttacggttaccgtacccgggttacgggtccgttaacgggtttaacccg

SEQ ID NO: 212683 - DNA, 725 bp, Homo sapiens
  misc_feature: GYAE6OF01DCE3H.21.27.C05.1.454.CMB.1.raw
  modified_base (202)..(202): a, c, t, g, unknown or other
  misc_feature (202)..(202): n is a, c, g, or t
  modified_base (445)..(445): a, c, t, g, unknown or other
  misc_feature (445)..(445): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgcccaccctctcctgccagacgccagtccagtctagtcgctgacgtgttacgccgtaggtaccagacaagtaaactcgtcggaccgacggcctcccgacggtccttccttacttacgtttaccggtcgaccacctacccgacccggacgggccctaacgtcggtaccgtcccgaacgtacgtaggttaccgaggtcggggccggttaggttagtttacgggaacttaggttacgtttttcncctactacctacgttacgaccgtacccgtacccgtaacgacgtaacggtagtaacggttacgttagtttacgtgtttaacgttttacttccgtcgtacctaagtaacgttaattaactttaacgttaccgtcggtcccgtacggtaccggtacccgttaccggttcccggaccggtaacccgggaaccggtaaacgggtaacgaaacgttaaccgaaaccggttaacggtcgggtacgtacgtacgtacgtaaccacgtttaccgtgtttaccgttaccg

SEQ ID NO: 212684 - DNA, 811 bp, Homo sapiens
  misc_feature: GYAE6OF01BRRWI.21.27.C05.1.454.CMB.1.raw
  modified_base (209)..(209): a, c, t, g, unknown or other
  misc_feature (209)..(209): n is a, c, g, or t
  modified_base (230)..(230): a, c, t, g, unknown or other
  misc_feature (230)..(230): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccacgccaccctgtctgtcgtccgtccggaggggggacnccgacccacccttcttcccgngccaacgacgcccgtagtccagttctagtccgctcggtacgttggttacgccgttacggtaaccgagacaaagtaacttcgtacggaccgacggccctcccgaggtcctttccttacgtacgttttacccgcgtacctaccgtacccgaaccggtacgggtccctaacgggttcggtccgtaacccgaacgtaaccggttacgggttaccgaaggggttcggggtacgggttaggttaacgggttttacggggaactttacgggtttaccgtttttccgacccttacccgtaacccgtaattacccggacccgtaccccggtaaccccgttaagggtaacgtaaggggttaacggaaaggttagtttaccgggtttaccgttacgttttaacgtttttacgttaccgtaccggttaacccaaggttaaactaaagtttaactaaccgtttcgtacggtccgtacgtcgtaccggtaccggtaccggaccgtaaccgggtacgaaagtaacgtaacgtaaaccgaacgtacggttcggacgtaccgtcgtaccctaactccgttacgttccgtcgtttaccc

SEQ ID NO: 212685 - DNA, 758 bp, Homo sapiens
  misc_feature: GYAE6OF01AM7L9.21.27.C05.1.454.CMB.1.raw
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
  modified_base (268)..(268): a, c, t, g, unknown or other
  misc_feature (268)..(268): n is a, c, g, or t
  modified_base (342)..(342): a, c, t, g, unknown or other
  misc_feature (342)..(342): n is a, c, g, or t
  modified_base (731)..(731): a, c, t, g, unknown or other
  misc_feature (731)..(731): n is a, c, g, or t
tcagtcgtcgctcgcacgaccggtgctcgatttagacgcgatcgaagggtttggggggaggaactgctcagttaggacccagacggagccatggaagccccagcgcagcttctcttcctcctgcttctctggcctcccagacaccacgtggagtgtattgtgatgacgcagtcctccacgccctaccctgtctgtcgtctccggagggggacnccgccctaccctctccngcacacgccagtcacgtctatcgctgacgttggttacnccgtcgtaccagactaagtaactcgtacggccacggtccctccgacggtccctaccgtactacggtttacccgngtacctacctacccgaacccggtacggtcccctacggtcggtacccgtaccctaacgggtaccgttaacggttccgtaaggggtcgggtacggggttaggttacggtttacgggaactttacgggtttaccgttttcctcccgtaacgtacccagttaccgacccggttacccgtacccgttaacgaggtaaaggtacggtaaagttcggtttcgttagttaaccgttttgttttacgttcccgtaccgtaagaacgtttaaacgtatttaaacgttaccgtttacggtcggtacccttcgggtacccggttcggtacccggttccggaacccgtaacgggtaaccggtaagtacgaaacgttaccgaacgttggtacgtcgaccgtanaccgtactagtacggtccttcgtaccg

SEQ ID NO: 212686 - DNA, 915 bp, Homo sapiens
  misc_feature: GYAE6OF01DQPRT.21.27.C05.1.454.CMB.1.raw
  modified_base (167)..(167): a, c, t, g, unknown or other
  misc_feature (167)..(167): n is a, c, g, or t
tcagtcgtcgctcgcacgaccggtgctcgatttagacgcgatcgaagggtttgggggcagagcctgctgacttctggctgaccagggcagtcgaccggagctccagacaatgtctgtcctccttctcatcttcctgccgtgctcggcctccagtgggtctctgtcanagtactacaaactacagcagttctcggtaccaggtactgggacgacggccctcgactacgtaccctttcacctaccaccgtgtacgactacgtaccggtaaccgggtaaagttcggtacgtcgtacggtaactaaaccgtaaggttcggttaggtaaagtttcggtaacgttacggtacgtaccggttaccccgtagggacggtacggttaccgttaggtacgggttacggtacggtttaacggggaaaccggttaacctttaacgtttaacggtacccgtacccggttaaggttagggttaacgtaacggtaaacgtaacgtaagtacggtaacgtaagttaacgttcgtacggtacgggtacggtccgggttaccgtcttaaccggtaacctacttacccgaaccccggtacgtaaacccgttaacccggtaaaccgaacgttaaaccgtaccggtaaccgggtttacccctaacccgtttaaaccccgttaaccgtttaaacggttccgttaacccgtttacctaccccggtaacccttaacccggtacgaaaccccggttacggttaccgttttaacgttttttacggttcgtaaacggtaacggtaaccgggtaacggttaacctaccgggtaaccgttagggttttaaccggtacccctttacggttaccccgttaccggttaacttaccccggttaaccgggggtccgggttaaaacccgggtttaggggtttaaccccgg

SEQ ID NO: 212687 - DNA, 792 bp, Homo sapiens
  misc_feature: GYAE6OF01AQCEP.21.27.C05.1.454.CMB.1.raw
  modified_base (203)..(203): a, c, t, g, unknown or other
  misc_feature (203)..(203): n is a, c, g, or t
  modified_base (312)..(312): a, c, t, g, unknown or other
  misc_feature (312)..(312): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgccacagccagtcagtctatcgctgactggttagcctggtaccagcaagaaactcgtcggccaggcctcccgaggccttcctctacgtttaccgngcctactcccaccgagggccctacgtcggtcgtacccagtaccgtaggttcaaggtgggtcggtagggtactttggggaactaggttacgtttttcctcctaccaaccgtactccgtacgtcccgtacccctaacgtaacggtacggttaggaaacgtacgtttagggtttcgtaaccgtttaacgggtttttacttttacccgtacgggtacccctaacggttaaccttaaaattttaacgtttaaaacgttttaaccggttaccgggtacccgttcgggttaccggtttaacccgggttaaccgggtttacccgggtaacccccgggtaaccgggggtaaacccgtaaaacgggggttaaccgggtaaaaaaccgttaccggtaaaaaaccgggttacccggttagggtaccggggtacccgttaccggtaacccgttaaccccgtaactttccggtttaacgttcccgttttaaccg

SEQ ID NO: 212688 - DNA, 857 bp, Homo sapiens
  misc_feature: GYAE6OF01CDH7V.21.27.C05.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacacccatggagtgattgtgatgacgcagtctccacgcctaccctgtcgtgtgtcctcggagggggnccgcccaccctctcctgaccactacgccagtcagtctatccgagtgacgttggttacgaccttcggtaccaaggtaccaaagtaaacttccgtacggaccgaacgggtcccctaccccgaggtccctttcccttacgttaaacccgttttccggtacgtacccgaaccttacccgaaccggtacccggggtaccctaaccggttgggttccccgtaccccaaggtaacccgtttagggtaccgtaaggggtttcggggcgggttttaggacgggttttaccgggaaccgttaagtttacggttttttcccaacccttaaccggtacctacgttaccgaaccgtccccgtaccccgttaaacgtacgggtaaggtaaaggtaaaggttacgtttacggttcggttacgtttaacgtttttacgtttacggtaccaccgttaacgtaacttaaacgttaacgtttaacgttaaccgtacgggttactcgggttacccggtacccgggttaccgggttaccgggaaaccgggtaaaccgggtaacggtaaaaccggggtaaacgtaaacccgggtaaacgtaaaccggtaaaccgtttggacgggttaccacggttaacctaccgtaccgtttccgttgttccctttaacccgg

SEQ ID NO: 212689 - DNA, 740 bp, Homo sapiens
  misc_feature: GYAE6OF01BP8GW.21.27.C05.1.454.CMB.1.raw
  modified_base (203)..(203): a, c, t, g, unknown or other
  misc_feature (203)..(203): n is a, c, g, or t
  modified_base (536)..(536): a, c, t, g, unknown or other
  misc_feature (536)..(536): n is a, c, g, or t
  modified_base (545)..(545): a, c, t, g, unknown or other
  misc_feature (545)..(545): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgacttggttacgcctggtaccagcagaactctcggccaggcctccccgaggtcctccgttactacgttttaccggtcgactaccgtcccgaacccggacggggtccctaccggttcgggttaccggttaccccgaaggtaaccgttaagggtttaccgaaggggtttcgggggtccggggttaggggtttaacggtttttacgggggaaccttaagggtttacggttttttcctaccgttaccctaaccgttacttccgaacgtcccggtaccctaacgaaggtagtaggaagtnttaggtttnacgtttattttcgttacgcgtacctagtactaaattaattaacgttacgtcgtaccgttcggtacgttccggtaacggttccgggacgaaacccggggtaaccgtagggttaaacggtaaaacgtaccggtaaaacggtacgttcggtacggtacgtacgtacccgtacttaaccgttcttcgttccgttacccg

SEQ ID NO: 212690 - DNA, 616 bp, Homo sapiens
  misc_feature: GYAE6OF01A73MC.21.27.C05.1.454.CMB.1.raw
  modified_base (125)..(125): a, c, t, g, unknown or other
  misc_feature (125)..(125): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttctnatcttcctgccgtgcgtggcctccgagtggggtcgtctgtcacagatacaaactacagctagtcgtcggtaccaggtacgtgggtgacggtccctacggaccacgtacccctttcacctccaccgttgtacacgtagtaccgtacggggaaatcggtacgcgtagacaactagtggtagtagttagtatcggcacgtccgtagagacgcgtgagtgtgtgaacgtacttagtacgtacgtacgtagtgtacgtagagactagtgactagtagtagtcgtgacggtcgtcgtcgtacacgtacaccaccagactacgtaacaagtactacgaccgtccctaccgtactacgtactacgttctacgtcctaccgaccgacgaccgtacggtccttagtttacgttagtagaccggtagacgtacgtacgacgttcggtacgttacgtacctaccgtcgttacgaccgttacggacggtacgtacgggttaccg

SEQ ID NO: 212691 - DNA, 804 bp, Homo sapiens
  misc_feature: GYAE6OF01DSZRH.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccagtggggtcgtcctgtcacagatacaaactacagcagtctcggtccgaggacgtggtgacggccctcgctaacgtaccctttcactccaccgtgtacgactacgtccgtaaccggggaaaatcggtacgccgtcggacaaacgtaagttgggttaggaagtttaggagttaggtaccgtaccggttccccggtacggaacggtacggtccgttaggtacggtggtacgttacgggaacggtaaccgttagtttaacgtaccgtcccgtaaggttacggttaagtaggaaagtacctaagtagtacgtaagtaacgtttcgtgtaggtaccggtaccgggttaccgttccgtacctaaccgtaccctacccgaacccccgtaacggtaaccctaaccggttaaacccgaaacggttaaccgtaccggtaaccgggtttaccctaccccgttaacccttaaaccgtttaacgttccgttccgttacgttaccctacccgtaaccccggaaccgtaaccggtaccgttacgttaacgttttttacgtttacggtaccgtaacgtaacggacggtacgttacgtacgttacgttacggtacctaccgttacccttcgttacgtaccgtacggtaccgggtcgtaacgggtttacccg

SEQ ID NO: 212692 - DNA, 576 bp, Homo sapiens
  misc_feature: GYAE6OF01BEJ03.21.27.C05.1.454.CMB.1.raw
  modified_base (201)..(201): a, c, t, g, unknown or other
  misc_feature (201)..(201): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
tcagtcgtcgctcgcacgaccggtgctcgatttagacgcgatcgaagggtttgggggaggaactgctcagttaggacccagactgagccatggaagccccagcgcagcttctcttcctcctgcttctctggctcccagacaccactggagtgattgtgatgacgcagtctccagccaccctgtctgtgtctcgagggggcncgccaccctctcctgcacagccagtcagtctagtcgctgtacgtggttacgccgtaggtaccagacaagaaactcgtgccgaggcctcccgagtcctcctctacttaccgtcgcactccaccgcggccacgtgtcgcccagacgtggtcngtcggnggtggtagttgggactagtacgtttctacctcgacctactcgaccggtaccgacctacgaggtagtagaagtattggttgtacgttaatttcgtttgcctacgagtactaattattaattcgtcgtccgtagtcgtacgtccggtcggaccgacggtaaccgaaggtaacgaacgttacgaaacggtcgtggacgcgtacgcgactcgtcgttgttacc

SEQ ID NO: 212693 - DNA, 594 bp, Homo sapiens
  misc_feature: GYAE6OF01DRI2O.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttacgcctggtaccagacaagtaaatctggccaggcctcccgaggcctcctctactttaccgtgccactccaccgacgggcctacgtcggtacgtcccgagactaggttcgaggtggcgggttggtagtttgggactaggttacgttttctctacacctagtccacgccgtaccctagagagtagtaagtatggttacgtacttagttttacttcgtcgacctagactaattaatacttacgtacggtctagtcgtcgtacggttaccggacgtaaccgggtataagggtagaaacgtacgaaacgtacgttggacgtctacgtaccaactagttctcgttcgtacc

SEQ ID NO: 212694 - DNA, 907 bp, Homo sapiens
  misc_feature: GYAE6OF01C1EJH.21.27.C05.1.454.CMB.1.raw
  modified_base (99)..(99): a, c, t, g, unknown or other
  misc_feature (99)..(99): n is a, c, g, or t
tcagtcgtcgctcgcacgaccggtgctcgatttagacgcgatcgaagggtttgggggcagagcctgctgacttctggctgaccagggcagtcaccgganctccagacaatgtctgtctccttctcatcttcctgcccgtgcgtcggcctccgagtggggtctcctgtcaactagactaccaaaactcagctagttcgtcggtaccaggtacgtgggtcgacgggcccctgacctacgtacccctttcactccgtaccgtgtacgacacgtaccggtaacgggaaatcgtcgcgtggaccaagtaagttggttagtaagttaggtagtaggcgtaaccgttccccggaggaggtacggtccgttaggacggttacgggtacgttaagggtaaaccggttaccttaagtttaaaccgtaccggttacccgtaaggttcggtaaagttaaggaaaacgtacgttaaggttcgaacgtacgtagtttcgtaggtcggaacgggttcgtaccgtacttaccaaccgtactaaccccaacccgtaacgaacccgtaaaccggtaaccgtaaaacgtaccttaaccggtaacccggttacccctttaaccccgtaacccctaaaccgtttaacgttccggtttaccgtacccggttaacccctaaacccccggttaaccccggtaaaccggtaacccggtaaccggtttaaccgtttttaacggttttttaacggttttaccgggtaacggtaaccgggtaaacggggtaccggtaaacgtttaaccgttaccggtaaggttttacccgggttaaacccgttaacccctttaccccgtttaaccgggtttaccgaacccggtttaccccgggggttacggggtaaacccgggttaacggggttttaaaccccgg

SEQ ID NO: 212695 - DNA, 843 bp, Homo sapiens
  misc_feature: GYAE6OF01CQ87T.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttctgaccgtgctggcctccgtagtggggtctcctgtacacagactacaaactcagctagtctcggtaccaggtacgtgggtacgacggtccctacggacctacgtacccctttcgaccttacctaccgtgtacgactacgtaccgtaaccgggaaatgtacgcgttcggacaacgtaagttcggttaggtagttaggtagttacggcgtacggtccccgtaggacgtacggtccgttaggacggtacgggtcgttacgggaacgttaaccgttaagttaccgtaccggttacccgtaagggttacggttacgtaaggtaaacggtaacgttaacgtacgtaacgttaagttacgtttaccgttgggtaggtacgggttaccgggttacgttaccttaccgtaacccctacgtaccccgtaacccccgtaggtaaccctaacccggttaaccgaaacgttaaaccgttccggtaaccgtttacccctaccccttaaccgtaacctttaacggtttaccgtcgttaacccgtcccgtaacccgtaccccggtaaccgaaccggtaccggttaacgtttacgtttttacgtttacggacgtaaacggtaaggtaacggtactacgtaacgtacggtttacggtaaccttacccgttaccgttaccgtttaccgtacccgttccgggttaccgggtagtacccgggttttaacccgg

SEQ ID NO: 212696 - DNA, 715 bp, Homo sapiens
  misc_feature: GYAE6OF01C2JX7.21.27.C05.1.454.CMB.1.raw
  modified_base (158)..(158): a, c, t, g, unknown or other
  misc_feature (158)..(158): n is a, c, g, or t
  modified_base (288)..(288): a, c, t, g, unknown or other
  misc_feature (288)..(288): n is a, c, g, or t
tcagtcgtcgctcgcacgaccggtgctcgatttagacgcgatcgaagggtttggggcagagcctgctgacttctggctgaccagggcagtcaccggagctccagacaatgtctgtctctctcatctcctgcccgtgctcgggcctccgagtcggggtntcctaggtcaacagaacttacgaaactcgacgctagtccgtggaccaggtaactgggtacgcggtccctcggactaacgtcctttcaactcgaccgttgacgactacgtacgtaaccgggaaatcgacgngtgacgaagtagtggtagtagttaggacgttacggactccggtacccgtgtaacggacgcgtttacggaaggtcgtacgtagggtaacggtacttaacgtaacgtacggtaaccgtaggtggttaacgagaaacggtacctaagtcgacgtagtaagtcgtagtaggcggtacgtaccgtacgtcgacctagtacccaccgaacgtaccgaacgtaaacgaagtaaccgttgaacgttacccgttaccgacctaaacgttctccgttaactcccggtaccgtaaccctaccggtacgtaaacgtcccggttaaatttacggtttacgtttacggaacgtaccgggtaatcgggtaacttcgaacgttagttccggtaacgtactacccgttgtaccgaacggttccggcggtaacggtcggttaccg

SEQ ID NO: 212697 - DNA, 729 bp, Homo sapiens
  misc_feature: GYAE6OF01AXPN9.21.27.C05.1.454.CMB.1.raw
  modified_base (204)..(204): a, c, t, g, unknown or other
  misc_feature (204)..(204): n is a, c, g, or t
  modified_base (424)..(424): a, c, t, g, unknown or other
  misc_feature (424)..(424): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggganccgccaccctctcctgccacacgccagtcagtctatcgctgactggttagcctggtaccagcaagtaaatcgtcggccaggcctcccgacggtccttcccgtctacgtttacccgtgtcctactcccgaaccgacgggacctaccgtcggtaccgtcccgaagacgtacggttcgaggtacgggcggttaggtagtttcggggactaggttcgttttacncgtaccacctactacgacgtcccgacccgtaacgaggtagttaggaaagtacttcggttacgtcgttaagttttactttccgtaggtacctacggtaacttaaagtttaacttaacgttttaaccggtacggtcccgttacggttaccggttacggttaacccggttaccgggtaacccggtaaaccggggtaaccggtaaaggggttaacggtaaaaccgttaaccggaaaaccggttaaacggttcggtacgggtaccgttacggtccctaaccgtagttcccgtttacgttccgtttacccg

SEQ ID NO: 212698 - DNA, 832 bp, Homo sapiens
  misc_feature: GYAE6OF01BG24X.21.27.C05.1.454.CMB.1.raw
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtcgtcgtccggagggggganccgcccaccctctcctgcacagccagtcagtctagtcgntcgacgttggttacgccgttacggtaccagtacaaggtaaacgtcgtcgggacccacgggcccttaccccggacgggtcccttaccgtaccttaacggttttacccggtaggaccctaaccgtccccgaaccggtacggggacccctacggttccgggttaccgtacccgaacggtaccgtacggttaccggaggtcggggtcgggttagggtaggtttacgggacttaggttcgttttactctaccgacctacgtcctaccgccctacccgtaacgacggttaagtaacgtaaaggtgtttacggttacgttacgttaagtttttaccttacgtacgtaccgtagtaacttaaaagtttaacttaaactttaccggtaccggtaccgttacggttacccgggttaaccggtacccggggtttacccggggaccccggtaaacccgggggtaaaccggtaaacggggttaaaccgtaaaaccggtaaaccggtaaaacccggtaccgggtttacgggtaacccggttcccggtacggtaaaccccgttaacgttaacggttcccttttaggttaacccgttaccccg

SEQ ID NO: 212699 - DNA, 788 bp, Homo sapiens
  misc_feature: GYAE6OF01AUZ2B.21.27.C05.1.454.CMB.1.raw
  modified_base (206)..(206): a, c, t, g, unknown or other
  misc_feature (206)..(206): n is a, c, g, or t
  modified_base (226)..(226): a, c, t, g, unknown or other
  misc_feature (226)..(226): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagcccacctgtctgtgtcgtccggagggggacnccgccaccctctcctgcacngccagtcagtctagtcgctgtacgtggttacgccgtaggtaccagactaagtaatcgtcggaccacggtcctccccgacggcccttccttcgtaacgttttacccgtcgtccacctacccgaaccggaccgggccctaaccggttcgggtccgtaccccgaaggtaccgtacgggtttcgacggggttcggggtcggggttaggttaacggttttacggggacgtttaagggttttaccgttttttcctaaccgtaccgtacctacgttccgaaccggcccgtacccgttaacgaaggtacgtagtaaacgttagttagtttcgttacgtttaagttttacgtttccgtacgtaccgtaacgtaacttaacgttaactttaacgtttaccggtcggtaccgttcggtacccggttaccgggtaaccggttacccgggaacccgggtaaccggggtaaccggtaaaaggtaaccgggtaaaacggttaccgaaacgggtaacggtggttaccgggtactaaccggtacccgttaacgtacgtttaccttcgtttcttaacccg

SEQ ID NO: 212700 - DNA, 743 bp, Homo sapiens
  misc_feature: GYAE6OF01EA7W8.21.27.C05.1.454.CMB.1.raw
  modified_base (155)..(155): a, c, t, g, unknown or other
  misc_feature (155)..(155): n is a, c, g, or t
  modified_base (163)..(163): a, c, t, g, unknown or other
  misc_feature (163)..(163): n is a, c, g, or t
  modified_base (409)..(409): a, c, t, g, unknown or other
  misc_feature (409)..(409): n is a, c, g, or t
tcagtcgtcgctcgcacgaccggtgctcgatttagacgcgatcgaagggtttggggcagagcctgctgacttcgtgctgaccagggcagtcaccggagctccagacaatgtctgtctccttctcatccttcctgcccgtgctggcctccagtggngtctcgtnacacgagtcaacaactagcgtactcgtggtcgacgacgtggtcgacggtccgtcgcctacgtaccttcctacacctaccgtacgtgactacgtaccgtaccgggtaaacgtagtcggtccgtagtcgaactaacgttaggtggtagttaggtctagtaccgccgtaccgtcggagtacggtctcgtaggtggtacctaggtaacgtaacgttacgttaacgtccccgtaacgtcggtaaggtttanaacggtaacgaacccgttacggtataacgtacgttaagttccgttaggtggtaacggtccgttaccggacttaccgtaaccaccgtaccaacccgtaccgtacgtaacccgtacgtaaacggtataccggtacctaccgtccctaccgtacctacgtacgtcctacggtcctaaccgtaccggaaccgtccgtactcggtttaatttacgttcgttacgggacctaagggttaacgcgttaaccgtacgttacccgttaggttaccgtaccgtttacctaacccggttgaaacccggttccggtaaccgggttaccggtaacggtttaacccgg

SEQ ID NO: 212701 - DNA, 777 bp, Homo sapiens
  misc_feature: GYAE6OF01EXB4Y.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttctcatcttcctgccgtgctggcctccatggggtctcctgtcacagatacaaactacagcaggttctggtccaggactgggtagacggccctcgcacgtaccctttcactccacctgtacgactagtccgtaccggggtaaaatcggtacgcgtacggaccaaacgtaagttggttacggtaagttaggaagtttacgggactaccggttcccccgtaggacggtacggtccgttaggtacggttacgggtcgttaacgggtaacggttacccgtttaagttaaccgttaaccggttcccgaaggttacggttaacgtacggaaacgtaccttagtacggactacgtagtttcgtggtacgaacggtccggttacgttcctaccgaacctacctacccgaacccgacgtaaccctaaccggtaaccgaaacgtaacgttaccgtaccgttacccttaccccctaacctaaccgttaacgttcggttacctcgtaccgtaacccgtacccgaacgaccgtacggttaactttacgttttgttttacggacggtaacgtaaggtacggtacttaccgtaacgttaggtacgtaaccgtaccttacccgttcgttaaccgtccggttacgggtaccgggttacggtaaccgggtttacg

SEQ ID NO: 212702 - DNA, 782 bp, Homo sapiens
  misc_feature: GYAE6OF01DOSJ7.21.27.C05.1.454.CMB.1.raw
  modified_base (159)..(159): a, c, t, g, unknown or other
  misc_feature (159)..(159): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctccagtggggtntcctgtcacagatacaaactacagctagtctggtaccaggacgtggtgacggccctcgctacgtacctttcactccaccgtgtacactacgtacgtaaccggggaaatcggtacgcgtcggacaactaagttgggttaggtaagttggtaagttacggcctacggttaccccggtacggaggtacggtccgttaggacggttggtacgttaggaacgtaccttaagttacgtaccggtaccgtaggttagtacgtaacgaagtacgtacgtacgacgtagtacttacgtaggtcggtacggtccggttcgtaccgtacctaaccgtacctaccccgaaccccgtaagaacccgtacgtaaccgaaacggtacgtaccgtacccggttaccccttaaccccgtacccgttaaacttaaccgtttcgttaccgttacccgttaccgtaccccgtaacccgtaccggtacgtaccggttacgttttacgtttttaaggttcgaacggttaacgtaacggtacggtaacttaccggtaacgttaccggtttacgggtacccttaccgttacccgtttacgttccggtaacccgttaccgggttcggggtacccgtaacgggtttacg

SEQ ID NO: 212703 - DNA, 819 bp, Homo sapiens
  misc_feature: GYAE6OF01BYUCT.21.27.C05.1.454.CMB.1.raw
  modified_base (203)..(203): a, c, t, g, unknown or other
  misc_feature (203)..(203): n is a, c, g, or t
  modified_base (258)..(258): a, c, t, g, unknown or other
  misc_feature (258)..(258): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggcnccgcccaccctctcctgcacacgccagtcacgtctatccgctgacgttggttacnccgtaggtaccagacaagtaactcgtacgaccgaggtcctcccgacggccttccctacgtaccgtttaccggtcgacctaccgtacccgaaccgacgggtcccacggttcgggtccgacccgaacggtaccgtacggttccgagggttcggggtacgggttaggtacgggttttacgggaacgttagggtttacgtttttccgtacctacccgaaccttagtcccgaaccggtcccgtaccccgttaaggaaggtacggttaacggaaagtttacgttcgggttttacgtacgttttacggttttttaaccgttcgtaacccgtaccgtaacggttaaccttaaagtttaacttaaacgttttaccggtacggttcccgttacggtacccgggtttacccggtaaccgggttacccgggaacccgggaaccggggtaaacccggtaaaggggtaaacgttaaaccggtaaacccggtaaaaccggttaacgggttgggttacccggaccgttaccggtaaaccgtacccttaggttcccttaaggtttcccctttaaccgg

SEQ ID NO: 212704 - DNA, 789 bp, Homo sapiens
  misc_feature: GYAE6OF01C1L0P.21.27.C05.1.454.CMB.1.raw
  modified_base (129)..(129): a, c, t, g, unknown or other
  misc_feature (129)..(129): n is a, c, g, or t
  modified_base (228)..(228): a, c, t, g, unknown or other
  misc_feature (228)..(228): n is a, c, g, or t
tcagtcgtcgctcgcacgaccggtgctcgatttagacgcgatcgaagggtttgggggaggaactgctcagttaggacccagacggagccagtggaacgccccagcgcagcttctcttcctcctgcttcncgtcggcctccagaccaccagtggatgtattgtgatagacgcgtacgtcctaccgacgccctaccgttgtcgtcgtcgtccggccgggacgggggaccncccgacccctacctccgtccgcgaccacgtaccgacctacgtacgtacgtctaccgtcgtatacggttaccgttcggttaccggtccgtaggtaacccaaggtactaaacgttaacgccggcggaccgacggttcccacccgtcggttaccttcccgttaaagttcccgttaagccgtaccaccgtacccggaacggtaccggtccgtacgttccggaccctaaccgcggtaacgtcgggttccggtagggtcgggaggttacggttacggttacggaacgttttacgttacgtttacgccgtaaccacgtccgacgtacgtaccgtaaccgaggtaacgtacgaggttaatcggttctacgttatttgttacgttcacctagtaactactaagtttaacgcgttacgtccgtagtccgttaccgtacgggtacccgtacggacccgtaaacgggtaacgtaaagggttaaaccgtaacgaaccggttaacggtccggtaacggtacgtaacccgtcccgtaacgtacgttaccgttacgtttaccgtaccggttaccccg

SEQ ID NO: 212705 - DNA, 865 bp, Homo sapiens
  misc_feature: GYAE6OF01ENSWA.21.27.C05.1.454.CMB.1.raw
  modified_base (217)..(217): a, c, t, g, unknown or other
  misc_feature (217)..(217): n is a, c, g, or t
  modified_base (396)..(396): a, c, t, g, unknown or other
  misc_feature (396)..(396): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccacgtggagtgtagttgtgagtcgacgcagtcctccgacgccctaccgtgtcttgtcgtccgtcggagggggacnccgccctacccgtctccgtcgaccaccgacgccctacgtctaacgttcctacgtccgtacgtacggtacgttacggttaccgcccgttacggtaaccaggaacctaaagtaaccgtcgtacggaccgtacgtccccgtaccgtacggtcctttacccgttacttaccggttttacccgngtaccctaaaccgttccccgaaccggtaacgtccctaacggtttcggtcccgtaaccgaaggtacgtaaggtttccgagggtcgggtacgggttagtacggttacggggtactaagttttcccggtttacacccttacgaaccttggtacccgaccgtaacccgttaccgtaacgtagtaacggtaggtaacgttagtttacggtacgtaccgttttagttttaccgtagtaccgtaccgaagttaacttaaacgtttaacttaacgtttaccggtaccgttaccgggttacggttacccggttaaccggttaccgggtacccggtaaccgggtaaaccccgggtaaacgggttaaaagggtaaacccggttaaaacgtaaccggttaaaaccgccggtttaacggacccgtacgtaccgtaaccccttaaagttacccgtttaaccgtttcgtacccgttttacccgg

SEQ ID NO: 212706 - DNA, 860 bp, Homo sapiens
  misc_feature: GYAE6OF01B70NM.21.27.C05.1.454.CMB.1.raw
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccactggagtgattgtgatgacgcagtcctccagcccaccctgtctgtcgtccgtccggagggggcccgcccaccctctccgtagaccacgacgtcctagtcacgttctacgtccgcgtagtacgttgggttacgccgtacggtaccagtacgaagtaactcgtcggaccgtacggtcctccgacggtccttccttacttaccgtttaccgcgaccacctacccgaccggacggtcctacggttcggtaccgtacccgagtaccggttaggttacgacggggttcgggtacgggttagggtttacggtttacggggtaacttacgggttttacgttttaccctaccgttaccgtaaccctacgtttacccgaccgggtaccccgtacccggttaacggtacggtaacgggttaggaaacgttaggtttacggtttacgttacgttttaaggtttttaccgttaccgtacggtaacctaaaggtaactttaaaacgtttaacgtttaacggtttaccggttccggttacccggtttacgggtacccggtttaacccgggtttaccccgggtacccgggttaacccgggtaaacccgggtaaaccgggtaaacggggtaaaccggttaaaccggtaaacccgtaaacgggttaccgggttcggttacccgtacggtacccgtaacgttaccgttactttaccggttctttaccgttacccg

SEQ ID NO: 212707 - DNA, 723 bp, Homo sapiens
  misc_feature: GYAE6OF01DJAPV.21.27.C05.1.454.CMB.1.raw
  modified_base (158)..(158): a, c, t, g, unknown or other
  misc_feature (158)..(158): n is a, c, g, or t
  modified_base (203)..(203): a, c, t, g, unknown or other
  misc_feature (203)..(203): n is a, c, g, or t
  modified_base (253)..(253): a, c, t, g, unknown or other
  misc_feature (253)..(253): n is a, c, g, or t
  modified_base (404)..(404): a, c, t, g, unknown or other
  misc_feature (404)..(404): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacacccactggagtgattgngatgacgcagtctcaagccaccctgtctgtgtctccgagggggancgccgaccctctcctgcacacgccacgtcagtctatcgctagactggtancgtgacagcagaatctggccgagctacccaggctcctcgtacgtttaccgtcgactacgtaccacgtacggcctaacgtcggtaccgcccgtaagaccgtacggttacgaggtcgggcggtacggtagtttcgggactaggtacgttttcnccttacgactatccacgtccgaccctaacgtacgacggtagtaagacgtttcgtacgttacgtagtttttactttcgtacgtacccgtagtacgtaaacttaacgttaacgttaccggtaccggttcccggtacgggttcccggttacgggttacccgggtttacgggtaaaccggtaaacccggggtaaccggtaaaaccgggtaaaggggtaaaaccgtaaaacggtaaaacccggtaaaccggttacgggtaccgggtaaccggttaacccgacccgtaaacccgttatttccgtttaaccgtttccttaaacccg

SEQ ID NO: 212708 - DNA, 714 bp, Homo sapiens
  misc_feature: GYAE6OF01DF7UW.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctcctctcatctctgccgtgctggcctccgagtggggtctcctgtcacagatcaaactacagctagtctggtccaggctggtcgacggccctcgactacgtacccttcacctctacctggacacgtacgtccggtaacggggaaattcgtcgacgtacggactaacgtaagttgggtagtaagtaggaacgttggccgtacgtcccggtacgaggtcggtcttaggaggtcggtacggttacggaacggttacttaagttaccgtaccgtaccgtagggttaagtacgtagaacgtaacgtgtacgtactagttacttacggtagtacggtacggttcggttcctacctacgtaaccgtacctacccgtaacccgtacgaaccgtaaccgtaacgaacgtaactccggtaccgtccctacccgtactacttagttccgtctaccgtaccaccggtacccgtacgaccgttacgtagttttacgtttacgttacgacgtaacggtacgtacggtctacggtaacgttggtttacggtacttacccgttaccttcgttaccgttacccgtacggggtacggtacccggtaggtttaaccg

SEQ ID NO: 212709 - DNA, 941 bp, Homo sapiens
  misc_feature: GYAE6OF01BNA1S.21.27.C05.1.454.CMB.1.raw
  modified_base (242)..(242): a, c, t, g, unknown or other
  misc_feature (242)..(242): n is a, c, g, or t
  modified_base (925)..(925): a, c, t, g, unknown or other
  misc_feature (925)..(925): n is a, c, g, or t
tcagtcgtcgctcgcacgaccggtgctcgatttagacgcgatcgaagggtttgggggaggaactgctcagttaggacccagacggagccatggaacgccccagcgcagcttctcttcctcctgtcttctctggcctcccagaccaccacgtggagtgtagttgtagagtcggacgtcgtacgttcctaccacggtccctacccgttgtccgtcggttcggtccgtccggggaggggggaccncccgaccccgtacccgttctcccgtcgaccaacgacgcccgtagtccgtagttacctacgtccgtcgtacgtaccggttacggttacgtccgttacggtaaccaggtaacgtaaacgtaaccgttcggacccggaaccgtaccggtcccttacccggtacggtccctttaccgttactttaccggtacccgtagaccctaaccgtacccggaaacccggtcggaacccttacgggttaccggtacccctaacccgggacggttaaccggtttacgggttaccggttaacggggtacgggggtttaccggttaagggtttaacggggtttaaccgggtaaaccggtttaccggtttttaaccggtttttaaccaccccggttaaccgtaaaccggtccgggtttaaacccgacccgggtaaccccgttaacccgttaacgggtaacgggttaaacggggttaacggaaacggttttcgtttacggggttaacccgtttaggttttaaccggttttaccttacggtaaccgaccgttaaacgttaaattaacggttaacgtttacgtccggttacgtcgttacgggttccccgggtaacgttcccgggtaaccgacggtaaaccgggaacgttaaaggtaactaaacggtacgtaacgtcggtacgcgtacgtcaacttaccgtnttaccgtgtacctacg

SEQ ID NO: 212710 - DNA, 620 bp, Homo sapiens
  misc_feature: GYAE6OF01ANUUJ.21.27.C05.1.454.CMB.1.raw
  modified_base (396)..(396): a, c, t, g, unknown or other
  misc_feature (396)..(396): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttctcatcttcctgcccgtgctgggcctcccgagtggggtgtcctgtcacagatacaaactacagctagtctggtccaggtactgggtgacggccctcgctacgtacccctttcactccaccgtgtcgactacgtcggtaaccggggtaaaatcggtcgctggacaacatggttagaagttggattaggcacgtccgtacgagacggtccttgagtggcgtaggaacgactatactacgtccagtgtactagaatatatgctagtattcgtgtagngtcggtcgtctcacctataccgccagaccactacaagtactctacgtcctacctcctactaacgtcgtactcgtacacccgtaccgacgaccgtaggtactttacgtttaagtttcgtacgtagtaacggtagggtactaccgtacggtagtttcggtacgttaacccttccgttacgttaccggtacgttcccgggtacgggtaccgtaggggtttaacccgg

SEQ ID NO: 212711 - DNA, 723 bp, Homo sapiens
  misc_feature: GYAE6OF01EBY2C.21.27.C05.1.454.CMB.1.raw
tcagtcgtcgctcgcacgaccggtgctcgatttagacgcgatcgaagggtttgggggggaagaggaagactgacggtcctgccacaggtggtgctgggcacggtgggccctcgcagaccctttcactcacctgtgacatctccgggaaaatgtcgctggcaacaatggttggaattggattaggcagtcccgtcgagaggccttgagtggcttggaaggacctattatacgtcccagtggtatgaagactatgcagattctgtgagcggtcgtctcaccatccacccagaccacgtccaagaactcgacggtcctccctaccaacctaatcgtctcgtccaccgtcccgacgacacggacttacgttttattttcgtagtacgtaagaggtactaccacgtacgtttcggtactaaccttacccttccgtttacgtacccgttccgggtacgggcccgtaaacggggttaaccgttttcgtaccgtacccgttccttaccgtccaaccgtccccgttacccacccggtaacggccccgtacttcccggtttcccttcccccgtcggtccccgcccccgttgtccccgtaccgacggtacccgacccgttaccctccggaacgtcgacccgtaccgacccggtccggccccgggtggtcccgaccggtccgttacggtaaccggaaccgggttaccttaacccggttccccggaggtacccggg

SEQ ID NO: 212712 - DNA, 922 bp, Homo sapiens
  misc_feature: GYAE6OF01AEDS5.21.27.C05.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggacnccgccaccctctcctgccacagccagtcagtctatcgcgtgacgttggttacgccgtagggtaacccaggactaaggtaaacttccggtacggacccgaacgggtccccttaccccgacggggtccccttacccgttacttaacgttttacccggtgtaccctaacctaccccgaacccggtaccggggtacccctaacggttcgggttcccgttaaccccgaaggtaccgggttaaccggtttcgaaacggggttcggggtaccggggtttacgggtttaacggtttttacgggggaaacccttagggttttacccgggttttttttacccacccggtttaacccgtaaaccccgttacgttacccgtaaccgggtacccccgttacccccgttaaaggtaacgggttaacggttaaaggtaaacggtacgtttacgggtttaccggtaccgttttaacggttttttacgttcccgtacggtaaccctaacggttaacttaaacgtttaacgttttaacgtttaaccggttacggtacccgtttcgggtacccggttaccgggtacccgggtttacccgggaaccccggtaaccggggtaaccggttaaagggtaaaccggtaaaccgttaaacggaaaccggttacggtacggttaccgggtactaccggtacccttacccggtaagtttacccgttcggtttacccttacccgg

SEQ ID NO: 212713 - DNA, 701 bp, Homo sapiens
  misc_feature: GYAE6OF01A3XSR.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtgtcctgtcacagatcaaactacagcagtctggtccaggactgggtgacggccctcgcacgtacccctttcacctcacctgtgacagttccgtacggggaaaatcggtacgcgtaggacaacgtaagtggttaggtaatttgggacgttagggtccacggttcccccggtggaacggtacgggtccttcggtaggttacgggtccgttagggtaaacgggtaccctttaagtttaacgttaccggttaccccgtaggtcgggttaacgtacggaaacgtactaagtcggacctaggtacgtttcgtaggtcgtaacggtcggtaccgtccgttcacctacgtacccaaccccgagacctacgtaccaaagtaactacgacggtccctacccgtaccctaacgtaactgtcctcgttaccaccgtacccgacgaccgtacgtaccttacgttttagtttacgagtacaacggtaggactacgtacgtattccggtactacctccttaccgtcgtaccttaccggcgggtccgtaagggttacccg

SEQ ID NO: 212714 - DNA, 770 bp, Homo sapiens
  misc_feature: GYAE6OF01CB6OV.21.27.C05.1.454.CMB.1.raw
  modified_base (203)..(203): a, c, t, g, unknown or other
  misc_feature (203)..(203): n is a, c, g, or t
  modified_base (317)..(317): a, c, t, g, unknown or other
  misc_feature (317)..(317): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggacnccgccaccctctcctgcacagccagtcagtctatcgctgactggttacgccgtaggtaccagacgaagtaaatcgtggactacggcctcccgaggtcctcctctactttaccgngacctactacccgaccgagggtccctacgtcggtcgtacccgaagaccgtaggttccaggggttgggaccggttgggtagtttcgggaacgtaacgtttagtttttcccacgtaccgtaccctagtccgaacggtcccgtacccgtaacgaggtagtacggaagtaggttacggttcgtaccttaagtttttacgttccgtacggtaccgtacgtaaccttaagttaacttaaacgttaccgttccggtaccgttacgggtaccggtttacccggttaaccgggttccccggggtaacccggaaccggggggttaaaccgtaaacggggttaaaaccggttaaaaccgttaaaccgggtaaaaaccgggttacgtttacggggttaccggtaccggttaccgggtaaccccttaccggttaacttcccgtttccggtttaccctttaaccccg

SEQ ID NO: 212715 - DNA, 902 bp, Homo sapiens
  misc_feature: GYAE6OF01EBPEX.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctcctctcattcttcctgccgtgcgtcgggcctccgtagtcggggtctacctgtcacagactacaaactacagctagtcgtcggtccaggtacgtggtcgacggtccctacgacgtaccgttaccctttcaccttaccgaccgttgacgtacctacggttaccggtaaccggggtaaattcggttaccgtcgttacggaacctaaacggttaaggtttagggtttaaggttaaagttttagggtaaacgtttacgggaccgttacccgggttaccccggttagggaacgttaccgggttaccgttagggtacgggttaccggttacggtttaacggggaaaccgttaaccgtttaacgttaaccggttaacccggtacccgtaagggtttacgtaaacggttacggtaaacgtacgtagtacggacgtaaagttacgttccggtaggtaggtaaccggtcgttaccgtacccgtacgtaaccctacctacccgtaaccgacgtaacccgttaacgtaaccgaacgtaacgtacccgttaccgtaccccgttaccctaaccgtacttagtacccttacgtccgtaccgtacccggtacccgtaaccggtacccgtaacgggtttaacgtttaacgtttttacgttacggtaacggtacggtaacggtaaccgtaccgttaacgtaccgttaccgggtttaaccggacccgttacccttaccccgtttccggttaaaccttacccgggttacccggtaacggggttacccgtaagggtttaaaccccg

SEQ ID NO: 212716 - DNA, 713 bp, Homo sapiens
  misc_feature: GYAE6OF01AWAXG.21.27.C05.1.454.CMB.1.raw
  modified_base (662)..(662): a, c, t, g, unknown or other
  misc_feature (662)..(662): n is a, c, g, or t
  modified_base (707)..(707): a, c, t, g, unknown or other
  misc_feature (707)..(707): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatggacgcagtctccagcccaccctgtctgtcgtcgtccgaggggggagccgcccaccctcctcctcgcaccacgccagtcacgtctatcgctcgacgttcggttacgccgtacgggtaccaggtactaaggtaaacttcgtcggaccctacgggtcctaccccgacggtcctcccgttacttaacgttttacccggcggtccaccgtcccgtaacccggacgggtacccctaggttcgggtaccgtacccgtaggaaccgtacggttacgtaggggtcggggcgggttaggtacggtttcgggaacttacggtttcgttttctcccgtaccgtaacctagtacccgtccggaccgtacccctaacgaagggtaacggtaggtaacgttaacgtttggttagtacgttttaaggtttttaccttcgtacgtaccagtaataacgttaatttaacgttacggtcgtacgtcgtacggttccggtacgtccggtacgaccggganagggtacgaacgtacgaacgtagtcgcgtactcgactagtctctntgtacc

SEQ ID NO: 212717 - DNA, 907 bp, Homo sapiens
  misc_feature: GYAE6OF01CEJNZ.21.27.C05.1.454.CMB.1.raw
  modified_base (124)..(124): a, c, t, g, unknown or other
  misc_feature (124)..(124): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcncatcttcctgaccgtgcgtggcctccgagtggggtctcctgtcacagactacaaacgtcagcagtcgtcggtaccgaggtaccgtgggtacgacggcccctgaccgtaaccgttacccctttcacctccaccgttgtacgactacgtccggtaaccggggaaatcggtccgtcgtacggaacctaaacgtaaggttcgggttaaggtaagttacggtaacgtttacgggaccgtaaccggttcccccgggtacggaacgggtaccggtaccggttaggtacgggttacggtacggtttaaggggaaaccggttaacccgtttaacgttaaaccgttacccggttaaccccgttaagggttacggttaacgttaacggtaaacgttacgttaacgtaggtaccttaaggttacgttttcggtaggtttacggtaaccggttcccgggttaacccgttacggttaaccccaaccgttaacccgttaaccccgaaaccccggtaacgtaccccgtaaccggttaaaccgaaacggttaaccttaccggtacccggtttacccctaaccccttaaccgtaaacccgtttactcggttaccttaccgtacccgacccgttaaccccggacgaaccggttaccggttaactttacggtttttacttccggaaggttaacgaacggggttacgacgttaccgtaacgttaccgggtttacgaccgttaccctaccggtttccgacggtttacccggtacgggtacccgggtacgttaaccgggttaccgg

SEQ ID NO: 212718 - DNA, 826 bp, Homo sapiens
  misc_feature: GYAE6OF01B0RPI.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagactacaaactacagcagtctgtccgaggctggtgacggccctcgcacgtaccctttcactccacctgtcgacacgtcgtaccggggaaaatcggtccgcgtggaccaaactaacgtggttaggtaaattgggtagttacgggacctacggttacccccggtacggtaaggtaccggtccgtttggtacggttcgggtcgtttacggggaaacggtaccttaagtttaacgtaccgttcccgtaggttagggtacgtaggtaaagtaccgttagtacggcgtaacggtatttacgtgtacggtacggtaccgggttcgtacgtacctaacctaccgtaccctaaccccgaacgtaaccgtaacccggtaaccgtaaacgtaacgtaccgtaccggttcccttaccccctaccctaacccgttaagtttcgtaccgttaccggttaccctacccggttacccgaaccggtaaccgtaccgggttacgttttaacgtttttacggttttacgtccgggtaacgtaaacgggtaggtaaccgtacgtaccgtttaagggttacccggtacgttaacccgttacccggttccctttaacccgggttacccggtacccggggtaccgggtaaacccggggttaccgggttaaaccccggg

SEQ ID NO: 212719 - DNA, 842 bp, Homo sapiens
  misc_feature: GYAE6OF01D8JMC.21.27.C05.1.454.CMB.1.raw
  modified_base (100)..(100): a, c, t, g, unknown or other
  misc_feature (100)..(100): n is a, c, g, or t
  modified_base (635)..(635): a, c, t, g, unknown or other
  misc_feature (635)..(635): n is a, c, g, or t
tcagtcgtcgctcgcacgaccggtgctcgatttagacgcgatcgaagggtttgggggcagagcctgctgacttctggctgaccagggcagtcgaccgganctccagacaatgtctgtccttcctcctctatccttcctgcccgtgcgtcgggcccttccgaggttcggggttcgtcctcgtacactagtactacctaaaactacgtaggacctaggtccgttacggtaccgaagggttacgttcggggtacgacccggtccccgtacgtaccgtaaccgttaccccttttaccaaccgttaccacccgttagtaccggaaccttaccgtttaaccggggtaaaccggggttaaacttccggtaccgttaccggtaacgggtaaccctaaaacggttaggtttacggggtaaggttaacgtttacggtaaggtttaccggaccgtacccggttacccggtaggacggttcggtaccggttgggtacggtacggtacggttaaggaccgttaacgttagttacggtaccgtacgtaggtacgtagtaacggtaattacacggtcagtacgttattacgtagcggtcgtaccgtctaccaactaccgaccgtaccctaccggaacgactaccggtaanaacggtactcccgtaccgttcccaccgttaccgtaattaccggtcttaccgtaaccgaccctcccgtacgacccgttagtaccggttttacttagttttcggttacgaagtcggaaagttcctagtaccgtgtttaaccgcgtttacaccccgtttacgtcggttaaccgtccggtaccgggttaggtcccgtaagggtttcccccg

SEQ ID NO: 212720 - DNA, 807 bp, Homo sapiens
  misc_feature: GYAE6OF01BAFFA.21.27.C05.1.454.CMB.1.raw
  modified_base (209)..(209): a, c, t, g, unknown or other
  misc_feature (209)..(209): n is a, c, g, or t
  modified_base (249)..(249): a, c, t, g, unknown or other
  misc_feature (249)..(249): n is a, c, g, or t
tcagtcgtcgctcgcacgaccggtgctcgatttagacgcgatcgaagggtttgggggagaactgctcagttaggacccagacggagccatggaagccccagcgcagcttctcttcctcctgcttctctggcctcccagaccaccacgtggagtgattgtgatgacgcagtctccagcccaccctgtctgtcgtctccggaggggggacnccgcccaccctcctcctcgccacagccagtcgagttactntccgctagtacgttgtacggcctacggtaccaggacaagtaatccgcggcctacgtcctaccccaggtccccttcctacttacgtttcccgagcctactcccgacgacggcctacggtcgtccgtacccgaggtaccgtacggttcagggtcgggtacgggttggtaggttttacgggaacgttacggttacgtttttcccgcttacccgtacacgttacgaccggtccgtacccctagaacgaggttacgaagttacgttgttacgttacgtttaacgttttaacgttccgtacgtaccgtaacgtaacttaaacgtttaacgttaacgtttaaccgttcgggtaccccgtttaccgggttcccgggtttacccggttaacccgggttaccccgggaacccggggttaaaaccccggggtaaccggttaaacggggttaaaaccggttaaacccggtaaaccggtaaaacccgggttaccggttaaggggtaccccgttaccggtaacgtacccgtaacgttaacccgttcgtttaaccccggttctttaacccccg

SEQ ID NO: 212721 - DNA, 891 bp, Homo sapiens
  misc_feature: GYAE6OF01BA2AV.21.27.C05.1.454.CMB.1.raw
  modified_base (149)..(149): a, c, t, g, unknown or other
  misc_feature (149)..(149): n is a, c, g, or t
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggngtgattgtgatgacgcagtctccagcccaccctgctgtgtctccgagggggacncgccaccctctcctgcactgccagtcagtctatcgctgacgttggttacgccgtacggtaaccaggtcaaggaaattccgtacggacccgtaggtacccttacccccggaggtcccttccctaccttaaccgtttttacccggtcgtacctaacgtcccccaacccggtaagggcccgtaaccgtttcggggtaccgttaccccgtaacggtaaccggtacggtttccgaacgggttggggtccgggttagggtacgttttcggggaaccttaacggggtttaacttttttcccgtaccgtacccgtaacccgtacgtttacccgaccggtacccgtaccccgttaaccgtaagggttaacggttacggtaaagttaccggtttgtttaacggttctttaacggtttttacttttaccggtacgtaacccggttaagtaaccgtttaaacgttaactttaaacgttaccggttaaccggtcccgttaacggttcccgggttaaccgggtaacccgggttcccggtaacccgggtaacccggggttaaaccccgggtaaaggggttaaacggtaaaacccgttaaaccggtaaaaccgggttaaccggttacggggttaccggtaccggttaaccggttaccccgaacccgtttaccgtttcccgttcccgtttaccgtttaaccccgg

SEQ ID NO: 212722 - DNA, 764 bp, Homo sapiens
  misc_feature: GYAE6OF01AWFM6.21.27.C05.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctcctcctcatcttcctgcccgtgctgggcctcccagtggggtctcctgtcacagtactacaaactacagctacgtcgtggtccaggtacgtggtgacggccctcgcacgtacccttcacgtccnctgtcgactcgttacgaccgggtaaatgtaccgcgtacggacctaacgtagttgggttaggtaagttaggtacgttacggtacgtaccgggtccccggacggtacggtacggtccgttaggacggtcggtcgtacgggtaacggtacgttagttacgtaccgtaccgtaggttaggttaacgtaggtaacgtatacgtcgacgtagtacgttcgtaggtacggtacggtcgtcgttacgtaccaaccgtactaccctaacccgcgtaacccgtaccgtaaccgtaacgtacgtaccgtaccgttacccctaccctaccctacgttacgttcgtcgtacctacccgtacccgttacccggaccgttaccgtaccggttacgtttacgttttacgtttacgacgggtacgtaaggttaccggtacttaccgtaggttaccgttaccggttaccttaacccgttcccgttaccgttacccgtacggtttacccgggaccgggttaccgggttacgggttaacccgg

SEQ ID NO: 212723 - DNA, 852 bp, Homo sapiens
  misc_feature: GYAE6OF01D0J42.21.27.C05.1.454.CMB.1.raw
tcagtcgtcgctcgcacgaccggtgctcgatttagacgcgatcgaagggtttgggggggaagaggaagactgacggtcctgccacaggtggtgctgggcacggtgggccctcgcagaccctttcactcacctgtgacatcgtccggggaaaatgtcgctggcaacaatggttggaattggattaggcagtccccgtgagaggccttgagtggcttggaaggacctattataccgtccaggtgtatgaagactatgacagtattcgtgtgacgcggtcgtctacacctactccacccagacaccgtaccaagactcgacggtcctcccctacctaaccttaagtcgtccttcgtacctacccgtaccccggaaccgtaccgtaccggtacttacgtttttacttttcggacgtaacgtaacgggtacggtactacgtacgttacgtttccgggtacgtaccctttaaccccgtttaccgttacggtaacccgtttacccgggggtacggggtaacccggttaacgggggtttaacccgtttttcggaccccgttacccccggttactccccgtaccgtacccgtccccgtacccgaaacccggtaacccgggtcccctaaccggtttccccgggttacccccttacccccgggtgggtacccccgtcccgtacggtaccccttacccgggaaggtaccccgtacccctacccggtacccggaacggaccgtacccgaacccggtaccgggggtccccggtacccggttcgggtacccgttcccgggtaccggttaccggtaccggaaacccggttaccccttacccccgggttccggaacccgggtaacccgg

SEQ ID NO: 212724 - DNA, 848 bp, Homo sapiens
  misc_feature: GYAE6OF01ANUBV.21.27.C05.1.454.CMB.1.raw
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
  modified_base (825)..(825): a, c, t, g, unknown or other
  misc_feature (825)..(825): n is a, c, g, or t
tcagtcgtcgctcgcacgaccggtgctcgatttagacgcgatcgaagggtttgggggaggaactgctcagttaggacccagacggagccatggaacgccccagcgcagcttctcttcctcctgcttctctggcctccgagacaccacgtggagtgtattgtgatgacgcgtagtccaccacgtaccctacccgttgtcttgtcggtccgtccgggagggggaccnccgcccctaccctccgtcccgngaccaccgacgtaccgacgtacgtacgttcgtacgacgtctacgtacgttcggtaaccgtcccgtaggtaaccgacgtacgtaaacgtaacgtccggtcggacccgtaccgtccccgttaaccggccgtcccctttacccggttacttaaccggtttacccgcgtaccctaaccccgtacccgaccgggtaaccgtccgtacggtttcccggacggtaccacgggtaactcggtacgcgggttacgggtgttaccggtttagtggggaaactttccgtttaacgttccgtactacccgtacgtacccgaccttaccgacccggttacccgtagtaaagggtaagtacgtaacgggttatttggttaaccgttacgttttacggtttcttccgggtactaccggtaacttaaccttaagttaacgttttacggtacccgtcggtacgtttaccgggtccgtttaccggggacccggtaacgacccggggttaaacccgaaggtaaacccgggttaacggaaacttacggtaaacccggttgttcggtaaccgtacgttacccgacttacgtacccgttntttaacccgtaccgtttaccccc

SEQ ID NO: 212725 - DNA, 877 bp, Homo sapiens
  misc_feature: GYAE6OF01CNP46.21.27.C05.1.454.CMB.1.raw
  modified_base (129)..(129): a, c, t, g, unknown or other
  misc_feature (129)..(129): n is a, c, g, or t
  modified_base (384)..(384): a, c, t, g, unknown or other
  misc_feature (384)..(384): n is a, c, g, or t
tcagtcgtcgctcgcacgaccggtgctcgatttagacgcgatcgaagggtttggggcagagcctgctgacttctggctgaccagggcagtcaccggagctccagacaatgtctgtctcctctcatctcngcctgcgtcggcctccgagtcgggtcgtcctgtacacagaactacgaaacctacacgctagtcgtcggtaccaaggtcgtgggtcgacggtccctccggtaccggttaccttcgtacctcgtaccgtagtacggtaactacgtaccggtaacggggtaaacttcggtccgtacgttacggactaaacgtaaggttgggttagtaaagttggaagttacgcgtacggtccccgtaggacggtacggtcgttaaggngtacggtcgtaacggacgtactttacgtacgtaccgtacgtagtggtactagtaactcgtgtcgacgtatacgttcggaggttacggtcggtacggttaccttaccgtacccgtaccgtacccgttaaccccgaacccggtaaccgggtaaaccctaaccggtaacccgtaaaaacggttacggttacccccgggtaacgtttacccccctttaaacccccggtaaacccgttaaccgtttaacgtacccgtaccgggtttaaccccttacccggaacccccggttaaccccgttaaggaaccccggtttttaacggttaccgttttaaaccggttttttgtaccgtaacgggaaaacgggttaccgtaacggttactacccggttaaagttcccgggtttaccgtaaaccgtttcccctacgttttaccccggagttaaccccgggcccgggggttaaagtccccggtttaacgggttaaccgtttccccgg

SEQ ID NO: 212726 - DNA, 754 bp, Homo sapiens
  misc_feature: GYAE6OF01DGOQU.21.27.C05.1.454.CMB.1.raw
  modified_base (99)..(99): a, c, t, g, unknown or other
  misc_feature (99)..(99): n is a, c, g, or t
tcagtcgtcgctcgcacgaccggtgctcgatttagacgcgatcgaagggtttgggggcagagcctgctgacttctggctgaccagggcagtcaccgganctccagacaatgtctgtctcctctcatctcctcgccgtgcgtcggcctccgagtcgggggtctccgtgtcacgagtactacaaactacaggactagtccgtcggtaccgagggtacgtgggtacgaccggccctcggacctacgtacccttcactccacgtgtacgacctacgtaccggttaacggggaactcggtccggtacgtacggaactaacgtaaggttacgggttaggtaagttaggtaacgttacggtaccgtaccggtaccccggaggtcggaccggttcgttaggtaggtcgggtacgttaggaacgtacttaacgttaccgtaccggttccgtaaggttacggtagtacggtaaagtacgtacgtacgtacgtagtacgttgtcggtacggtacggtcggttactaccgtacacctacgacccaccgagtaccgaccgtacaacgtactacgtaccgtccgtaccctacgtactacgtctacgtcctacgtcccgaaccgtacgtaccgtcgtacgtttagtttcgtttagacgttagaacgtctaacgtacgtacggttacgttaccggtaccttaccttacccggttacgttaccggtaccggttaccgggttaccggggttaccggtaaccggggtttacgg

SEQ ID NO: 212727 - DNA, 702 bp, Homo sapiens
  misc_feature: GYAE6OF01D5SYJ.21.27.C05.1.454.CMB.1.raw
  modified_base (125)..(125): a, c, t, g, unknown or other
  misc_feature (125)..(125): n is a, c, g, or t
  modified_base (639)..(639): a, c, t, g, unknown or other
  misc_feature (639)..(639): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttccncatcttcctgcccgtgctcggcctccgagtggggtcgtcctgtcacagtactacaaactacagcagtcgtcggccaggactggtagacggcctcgcacgtacctttcactctaccgtgtcgactacgtaccgtaacggggtaaatcggtccgcgtacgggtactaaacgtaaggttcgggttaggtaaaggtttacggaacgtttacggaccgtaccggtaccccggtaggtaacgggtaaccggtccgtttaggaagggttcgggtaccgttaggggaacgttaccgttaagttaaccgttaaccggtacccgtaaggtcggttaactacggtaaacgtacgttaagtcggtacgtagttacgttcgtaggtggtacgtcggtcgtactccaacgtctacccgaccgtagacctacgaacagtacgtacgacgttcctacccgtactacgtagtcgtactcgactacctaccggacacgtcgttcttagtttcgtacgctaacggagtacggntcgtacgtgttcgtaccgaccttacggtcctagtacccgtgacgggttcgaagggtttacccg

SEQ ID NO: 212728 - DNA, 803 bp, Homo sapiens
  misc_feature: GYAE6OF01ADLN7.21.27.C05.1.454.CMB.1.raw
  modified_base (143)..(143): a, c, t, g, unknown or other
  misc_feature (143)..(143): n is a, c, g, or t
tcagtcgtcgctcgcacgaccggtgctcgatttagacgcgatcgaagggtttgggggaggaactgctcagttaggacccagacggagccatggaagccccagcgcagcttctccttcctcctgcttctctggcctccagaccnccactggagtgattgtgatgacgcacgtctccagccctacctgtcgtgtcgcgtccggaggggggacccgcctaccctctcctgacacgacgccagtcagtctatccgactgtacgttggttaccgcctacggtaccagacaagaatccgtacggccaggtcctacccgacgtcctcctactacctttaccgcgcaaccgtcccaaccgacgggtcctacgtcggtaccgtacccgatacggtacggttacgacgggttggggtaccggttgggtacgtttacgggggactttacgggtttacgttttccaccgttaccgaaccgttacgttaccgaccggttaaccccgtccctaacgggtaacggtaggtacggtaaaggtttcgttacgggtttacgttacggttttaacgttttacgttaccgtacggtaccgtaacgtacttaaaccgttactttaacggtttaccgtaccgggtacccgttacgggttaccggtaaccggttacccgggttaccgggaaccggaccgggtaaacgggttaaacggggtaaacctaaaccgggttaacgaaaaccggttaccgggtcgggtaaccggtaacgtccggtaacccggttaaccctaggggttaccctttacgtcccgttaaccccgg

SEQ ID NO: 212729 - DNA, 1091 bp, Homo sapiens
  misc_feature: GYAE6OF01AOTHO.21.27.C05.1.454.CMB.1.raw
tcagtcgtcgctcgcacgaccggtgctcgatttagacgcgatcgaaggggtttgggggcagagcctgctgacttctggctgaccagggcagtcaccggagctccagacaatgtctgtctccttcctcacttccttccgtgcccgtgcgtcgggcccttcccgaggttggggtctcctgtcacgagataaccaaactacgagtcacggttcggtcggtaccgagggtaccgttcgggtacgacccgggtcccctacggtaccgacccgttaccccctttacctacccgttacctaccgttacgtacggtaaccgttacggttaacccggggttaaccgggggtaaaacgttccggtccggtacggtacggaaccctaaaacggttaagggtttacggggtttaacggttaacggtttaacggggtaacgttttacggggaaccccgttaccccggggttacccccgggtagggaaccgggttaaccgggtttccgggttttaacggggtacggggtttacccggggtaaggtttaacgggggtaaaaccgggttaccttttaaacggttttccgttaaaccccgggtccggttaaacggttcggggtaaacgttaacggtaaacggttaaacgttactacgggtaacgttacgggttacgtttaccggttacggggtacgggtccggtaccgggttcccttaccgtacccgtaacccttaacccgtacccggtaacccccgtaaggtaaaccccgttaacgtaaacccgggtaacaacccggtttaccggttaccccgggtttcccctaaaccccgttacccgtttaaacccgttacggtttacccgttcccgtttaaccccgggtacccgtaacccgtaccccgggtaacccgtaaccggggtttccgttacccgggttttttaagtttttaccgtttacggaccgggttaaccggttaaacggtcgggttacccgttacgtacccggtttacggttcccggtttaccgttaaccccttaccgggttaccgtttcccgggtaacccggttaccgggggttacccggtaagggtttcccggtttacccgggg

SEQ ID NO: 212730 - DNA, 729 bp, Homo sapiens
  misc_feature: GYAE6OF01EIVLM.21.27.C05.1.454.CMB.1.raw
tcagtcgtcgctcgcacgaccggtgctcgatttagacgcgatcgaagggtttggggaggaactgctcagttaggacccagacggagccatggaacgccccagcgcagtccttcctcttccctcctcgtcttcgtcgtcggcctaccagaccaccacgtggagtgtattcgtagagtcgacgctacgtcctccgacgccctacctgtccgttagtcgtcggtaccggaggggcctaccgtccctaccgtctaccgtcgacacgaccgccgtagacgtacgtcttcgcggtactcggtacgttacggttaccgtacgttacgacccgagggtaaccaagttaaccgtcggacgaccgacgtccctcgacgtacctcacgttaactccgacgtacacctcccgacggtacgcccgtagtccggttccacctaggtaaccggtgttagaccggttggacgggttagtcgtacggtatcggtttcgtccacgtaactaccgtagcgaccgaccggtactacgacgtacgtaagactaggtctacgtacgtttacgttctaccgtacgtaccgtaacgtacttaacgtaattaccgtaacggttctaccgttacggtaccgttcggtacggtaccgtacgaacccggtaggtaaaccggtaacgaacgtaacgtaaggtacgttggacccggtactaccgtaccgtaattcccgtacttacgttccgttacccgg

SEQ ID NO: 212731 - DNA, 615 bp, Homo sapiens
  misc_feature: GYAE6OF01EQ2V9.21.27.C05.1.454.CMB.1.raw
  modified_base (240)..(240): a, c, t, g, unknown or other
  misc_feature (240)..(240): n is a, c, g, or t
  modified_base (398)..(398): a, c, t, g, unknown or other
  misc_feature (398)..(398): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttctcatcttcctgcccgtgctgggcctcccatggggtgtcctgtcacagatcaaactacagcagtctggtccaggactggtgaggccctcgcacgtaccctttcactcacctgtgaccntaccgtccggggaaaatgtcgcgtggacaactaagtggttggaattggattaggctacgtccccgtcgaggacggtccttggagtggcgttggaacggtacctattactacgtcccgagtggtactgaagactatgcagtattctgtgtgcgtcgtcncaccactcccacccagaccacgtaccgaagtactcgacgtcctaccctacctaccgtactgttctctcaccttacccgacgtaccgtacggtacttaacgttttcgtttagtacggtacgaaggtaccgtattaccgtacgttacggttcggtacgtacccttacccgttaccgttacgtaccggtcccggtacggggtcccgaggggtttaacccg

SEQ ID NO: 212732 - DNA, 693 bp, Homo sapiens
  misc_feature: GYAE6OF01DB6FC.21.27.C05.1.454.CMB.1.raw
  modified_base (213)..(213): a, c, t, g, unknown or other
  misc_feature (213)..(213): n is a, c, g, or t
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (280)..(280): a, c, t, g, unknown or other
  misc_feature (280)..(280): n is a, c, g, or t
  modified_base (309)..(309): a, c, t, g, unknown or other
  misc_feature (309)..(309): n is a, c, g, or t
  modified_base (320)..(320): a, c, t, g, unknown or other
  misc_feature (320)..(320): n is a, c, g, or t
  modified_base (420)..(420): a, c, t, g, unknown or other
  misc_feature (420)..(420): n is a, c, g, or t
  modified_base (669)..(669): a, c, t, g, unknown or other
  misc_feature (669)..(669): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagaccaccgactggagtgattgtgatgacgcagtctccagccacctgtctgtcgctccgaggggggccgccacccttntcccgtgccacagccngtcngtctatcgntgacgttgtacgcctgtacccagccagaactctggccnggcctccaggtctccttcactttaccgtncactccaaccngggaccactcggttcgccctaggactaggtttccgagggttgggcgttacgggtagttttgggaccctaggttcgtttttaccgtccttaccgtaaccgngttaccgacgtacccgaccctaccgtaaggaacgttacggaagtagttacggtttgactttgtttagtttaccgtagtacccgtacgtacgttaactttaacgtaccgtttaaccttcggtaccgttcggacggttaccgtaaccggtttcggaaccctaaaccgggggtaactaaaccgggttagggaaaacttacccgtaaaacggtaaccggttcgtcggtaaccgttagtacccgttaaaccccngttccttacggttcgtttaacccc

SEQ ID NO: 212733 - DNA, 713 bp, Homo sapiens
  misc_feature: GYAE6OF01EB28F.21.27.C05.1.454.CMB.1.raw
  modified_base (156)..(156): a, c, t, g, unknown or other
  misc_feature (156)..(156): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttctcatcttctgccgtgctggcctccagtggggtntcctgtcacagatacaaactacagcagtctggtaccaggactggtcgacggccctgcaacgtccctttcactcgacctgtagaccagtccggtacggggtaaaatcgtcggactcggactaactaagttggttaggtaagttagtacgttacggcgtacgtcccggtagaggtacggtccgttggaggtacgtcgttaggaacgtacgtaagttacgtaacgtccgtaggtaggtagtagaagtacgtagtgtaacgtagtattacgtggtagacggtcgtcgtacacgtacactccaacccgagtaccgacgtacgaaagtactcgaacggtcctaccctaccgtacttacgtcgttctacggttacacccgttacccggaaccgtaccgtaccggttacgtttaacgttttacggttttaccgtacggtaaccggtaaaggttacgggaaccttaccgaacgtttacggttacggttacgttacccgtttaacccttaccggttacggtacccgttacccgggtacgggtacccgggtaacgggtttaaacccgg

SEQ ID NO: 212734 - DNA, 761 bp, Homo sapiens
  misc_feature: GYAE6OF01DMEZ1.21.27.C05.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgctttctctggcctcccagacaccactggagtgattgtgatgacgcagtctcacgccctacctgtctgtgtccgtccggaggggggacnccgccctacccttctccgtgaccaacacgacctaggtccacgttctagtccgacgtgtacgttggttacgccgttaggacccagacaaagtaactcgtcggacctacggcctaccggacggtcccttaccgtacgttaacgttttaccggctacccgtacgtacccgaaccggacgggtaccctaacggttcggaccgtacccgaaggtacgttacgggtttacgagggttcggggtacggttacggttagtttacggggaacttacggtttacgttttaccacgtacccgtaacgtacgttaccgacgtacccgtaccgtaacgaagttacggtaagtaagtacgttagtagttacgttagtttttacgtccgtacgtactaacgtaacttaaacgttaacgttaagtttaccgtccggtaccgttacgggtaccgttaccggttacggtaccggaccggtaaacggtaccgtaaacgggtaacgtaaaccgtaacgtaaacggtactcggtacgtacgtacgaccgtactaagttcgtacgttctaccg

SEQ ID NO: 212735 - DNA, 830 bp, Homo sapiens
  misc_feature: GYAE6OF01EWEXD.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctcctctcatctctgccgtgctcggcctccagtgggtctcctgtcactagatacaaactcgagctagttcgtggtaccaggcgtgggtcgacgtcctcgacgtacctaccttcactcctaccgtcgtcgactacgtccggtaaccggggaaatcggtcgcgtacgacgtaagtacggtaggttacggtaagttggtattacggacgtacccgtccggtaggcggtaaccgtcgtaggtcgtacggtcggttaacggtacgtaccttagttaccgtacggttacccgtaggtagttaacgtacgtaacgtactttagacgttacgaacggtttcgttagtacggtacgggtacggttaccggtttccgtaccttaccgtaacccgtaccgtaccccgtaaccgaccgtaaacccgtacccggttaaactaacggttaccgtaacgttacccgggtaccccttaaacccccgtacccgttaaacggttaccttacccgtttaccgaccgttacccctaacccggttaccgtaacccggacgttaaaccggtttcgtttaaaccggttttttcgtacggttacggtaacggtaaacgggtacgttaacggtaccgtaaccgttagttaccggtttaaacgtacccgttacccggttacccttaccggttcccgggttaaccgggtaccgggttaccgggttacggtttaacccgggg

SEQ ID NO: 212736 - DNA, 779 bp, Homo sapiens
  misc_feature: GYAE6OF01BN7I2.21.27.C05.1.454.CMB.1.raw
  modified_base (469)..(469): a, c, t, g, unknown or other
  misc_feature (469)..(469): n is a, c, g, or t
tcagtcgtcgctcgcacgaccggtgctcgatttagacgcgatcgaagggtctgggggcagagcctgctgacttctggctgaccagggcagtcaccggagctccagacaatgtctgtctaccttcctcatcttcctgcccgtgctcgggcctccagtcggggtgtacctgtcacagataccaaactcagcctagtctacggtccaggacctgggtgaccggtccctcgctaacgtaccctttcactaccactgtagacagtccgtaacgggaaatggtcgtcgtcgactaacgtagtcggtaggtaattggtacgttaacgccgtaccgtacccggtagtacggacggtccgttggaggtcggtacgttacgggtaagggtacccttaagttaccgtaccgtaccctaggttcgaagttcgaaggtaccgtagtcgactaaggtatttcgtaggtggtacgtccgggttnttaccgtacctaccgtaccttcccgaaccccgtacgaaccctaaccggtacaaaccggtaatcccgtaacggttaccctaccccgttacctaaacgttaaccgttcgggtaacccttacggtaaccctaacccgggtccccgtaacggaacccggtaccgggttaccctttaagggtttttacgtttaaccggtacgaaacggtacgggtagttaacccgtacctaaggttacggtcccggtaaccttacccctacccgtttaccttaccgggtaccctaccggggttacggtacccggttaaaccgggg

SEQ ID NO: 212737 - DNA, 1012 bp, Homo sapiens
  misc_feature: GYAE6OF01ANEAR.21.27.C05.1.454.CMB.1.raw
tcagtcgtcgctcgcacgaccggtgctcgatttagacgcgatcgaagggtttgggggaggaactgctcagttaggacccagacggagccatggaagccccagcgcagcttctcttcctcctgcttctcgtggcctacccagaccacccacgttggagtgtattgtagtatacgacgcctagttcctaccgacgtccctacccttgtcgtgttcggtccgtaccgggacgggggacgcccgcccgtaccccttccgtcctacgaccgaacctacggcctacgtacctacgtctacgtccgtacgttacgtaccgttacggttacccgtccggttaaccggtacacgtaacgtaaagtacgttaccgtccggaccgtaccggtaccctccccggacggttcccctttacctttacgttaacccgtttccgttacgaccccgttaaccgtacccggacccggtaaccgggtaccctaaccgggtttaccggtacccggtaacccggtaacgggtaccggtttaccggggttaacgtacgggggttaccggggtacgggttaccgggttttaagggtttaccgggtaaccggtttacggtttacccgttttccgtaccgtaccggtaaccttacgaccccgttacgacccgttaccgtaacggtagggttaaccgtaaggtaacggttacgtttttcggtaactttaacggttttttcgttaccttcccgggtaacgtaccgttaaaacttagttttaaaccttaacgggttaacccgttttaaccggtccggtttaccgtacccgggtttacccggtaaacggggggtttacccccccgttaaggggaacccccgggtaaacggggtttaacccgggtaaaaggtttaaaacccgggtacccgtttaaaacccgggtaaacccgggtttcgggttcgggtttaaccccgacgggttacccgaacccgttaccggtttaacccgtttagttaaccccctttccccggtttaacccg

SEQ ID NO: 212738 - DNA, 1031 bp, Homo sapiens
  misc_feature: GYAE6OF01EE1RZ.21.27.C05.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccactggagtgattgtgatgacgctagtctccacgccacctgtctgtcgtcgtccggaggggggcnccgtccaccctctcctgccacagccctagtctacgttctagtccgacttcggtaacgttggttaccgtcccgtacgggtaaccacgaccgtaaaggtaaaccgttccgtacgggaccccgtacgggtaccccgtaccccggtaacggttcccctttacccgttacccgttaaaccggttttttaccccggcggttaacccaacccgttaccccggaaacccgggtaacccggggccctttaaaccccgggtttcggggtttaacccccgttaaccccgaaaacggttacccgggttaacgggttttaccggaacgggggtttcggggggttaaccgggtttaggggtttaacgggtttttaccgggggaaacctttacgggtttttaaacccgggttttttccaccccgttaccggtaaacccttacggttacccgaccgggttaccccttacccggtaaacgaacgggttaacgggttaacggaaacgggttaacggttttcggtttaaccggtacgtttttaacgttttttaacttcccgttaacgtaccctaaaggtaactttaacgttttaacgttaaaccgttttaccgggtaccgggttaccggtttaccggttaccccggggttttaaccggttacccccggggtttaccgggtaaacccccgggttaacccggggtaaaaacccgggtacggggtttaaaaaccgggtaaacgttaaaaccccgggtaaacgggtaaacggttccggttaccgggttaaccttacccggtaaccgtaaccgtttacggtttacccgttaccgttacccgtttcccg

SEQ ID NO: 212739 - DNA, 880 bp, Homo sapiens
  misc_feature: GYAE6OF01DD516.21.27.C05.1.454.CMB.1.raw
  modified_base (96)..(96): a, c, t, g, unknown or other
  misc_feature (96)..(96): n is a, c, g, or t
  modified_base (212)..(212): a, c, t, g, unknown or other
  misc_feature (212)..(212): n is a, c, g, or t
tcagtcgtcgctcgcacgaccggtgctcgatttagacgcgatcgaagggtttgggggaggaactgctcagttaggacccagacggagccatggaanccccagcgcagcttctcttcctcctgcttctctggctcccagacaccacgtggagttgattgtgagtcgacgcagtctccagcctacctgtccgtgtcgtccgtcggagggggacnccgccctaccctcgtcctcgaccgacacgccgtagtaccgtaacgtccttactcgtcgtggtaccggttggttaacgccgtacggttacacgtacgtaacgtaacgtccgtacggtaccgacggcccttacccggacgtccgttaccgttaccgtaacgttttaccgcgtaccgttaccgtacccgacggtaaccggtacctaccgggtacgttaccggttaaccgagtaccgtacgggtttccgaaggttcggggtccggttaggtttacgggtttaacgggacttaacggtttaccgtttttccaccgttacctaacgtaccgttccgaccgtacccggtaacccgttcggtaaacggtacggttacgtaaacggttacgtttaacgggtttacgttacgggtttttaccgtttttacgtttaacccggtccgttaacgtaacggtaacctttaaggtttaaaccgtttaccttaaccggtttcggtacccgtttcggtaaccgggttacccggttaccggtttacccggggaaaccggtacccggtaaaacggtaaaccgggttaacgaaaaccgttaccggaaaacgttcgggttacccggaacggttacggtaaccccgtaactacccgtttaacgttcccgttaagttcccgtttaacccgg

SEQ ID NO: 212740 - DNA, 917 bp, Homo sapiens
  misc_feature: GYAE6OF01DFBGD.21.27.C05.1.454.CMB.1.raw
  modified_base (155)..(155): a, c, t, g, unknown or other
  misc_feature (155)..(155): n is a, c, g, or t
  modified_base (159)..(159): a, c, t, g, unknown or other
  misc_feature (159)..(159): n is a, c, g, or t
  modified_base (180)..(180): a, c, t, g, unknown or other
  misc_feature (180)..(180): n is a, c, g, or t
  modified_base (240)..(240): a, c, t, g, unknown or other
  misc_feature (240)..(240): n is a, c, g, or t
tcagtcgtcgctcgcacgaccggtgctcgatttagacgcgatcgaagggtttggggcagagcctgctgacttctggctgaccagggcagtcaccggagctcagacaatgtctgtctcctcctcattctcctgcctgctggcctccgagtggggtntccngtcactagactcaaactcgancctagtccgtcggtacccaggacgtgggacgacggcccctggacctacgttaccccttancctaccgaccttgagacctaggttccggtaccggggtaaaatcggtccgacgtacggaacctaaacgtaggttaggggttagtaaaggttacggtaagttacgggtaccgtacccgggttcccccggtaaggtacgtacgggttccgttagggtagggttcgggtacggtttaaacgggaaaccggttacccgtttaaagtttacccggttaaacccggtacccgttagggttaacgggttagttaaacgggtaaaccggttaacgttaccggtaagtaccggttaaacggttatttaacccgggtgggtaccggtaccgggtaacccggtttccttaacgtacccgaacccttacgtaccccgaaaccccgtaaggtaaccgtaaccccgtaaccgtaaaggtaaacctttcccggaacccgttcccgttaaccccccgtactaacccgtttacgtaccggtttcctaccggttaccaccccgtttaaccggacccgtacgggttacccgttaacgtttacggtttttaacgttacgtagtaacccggtaagggttaccgggacttacccggtagttaaccggttaaccgggttccttaccctttaaaccccggttcgtaaaccggttcccgggttacccggaaccgggggttcccgtaccgggttttaaacccgg

SEQ ID NO: 212741 - DNA, 797 bp, Homo sapiens
  misc_feature: GYAE6OF01BTOUX.21.27.C05.1.454.CMB.1.raw
  modified_base (228)..(228): a, c, t, g, unknown or other
  misc_feature (228)..(228): n is a, c, g, or t
tcagtcgtcgctcgcacgaccggtgctcgatttagacgcgatcgaagggtttgggggaggaactgctcagttaggacccaggacggagccatggaacgccccagcgcagcttctcttcctctgtcttctcgtggcctccagaccaccacgtggagtgattggtgatcggacgctacgtcctaccacgccctaccgtgttcgtgttcgtccgtccggggagggggaccncccgtacccgtaccctcgtccgtacgaccgaacgaccggacctacgtacgtacgttcctacgtccgtacgtaggtacggttaggttaccggtccgtacggacaggaacgaagtacgtcggtacggaccggtacgtccaccggtacgtcctaccgttacgttaaccgttccggacacccgttaacgacccgaaccgggtacggcccgtacggtccggtaccgaccggtaagtaccggttaggtacggcgggtaggggttaccggttaggttacgggttacggagttaacggttttacctttccgaaccgtacgtaacgtacgtaccggccggtacccgtaacaagtaggtaacgtagtaacgttacgtggtttaacgtacgttttgtttacgtcgtacgtactagttaacttaaatttacgttaccggtacgtcgggttaccgtaccggttaccggttacgggtacccggtaccggaaaccgggtacggaacggttacgaaacggtaaaccgtacggaaaggtcgttacggcgtactacgtaaccttcgtatttccggtcttcgtacccg

SEQ ID NO: 212742 - DNA, 787 bp, Homo sapiens
  misc_feature: GYAE6OF01EHR2N.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgaccgtgctgggcctcccatggggtgtcctgtcacagatcaaaactacagcagtctggtccaggactggtgacggccctcgcacgtaccctttcacctcacctgtcgactactccgtaccggggaaaatggtacgctgggacaaacgaagttgggttaggaagttcggattaggacctaacggttcccccggtggaggaggtccgttggacggtggtcgttaggaacgtaccttaagttactaccgttacccgtaggttggtaactaggtaaacgtactagtcgacgtaagtactttcgtagtaggtacggtcggttcgtacctaccgaacctactacccgaacccccgtaaggtaaccgtaacccgtaccgaaaacggtaacgtaccgtaacgggtttccccttacccccgttaacccgtaaccctttaaacgttccgtttacccgttacggtacccctacccggttaacccccggaacgtaacccggaccgggttaccgtttaacgtttttacgttttacggtacggtaaccgtaaacgggtacgggtactaaccgtacgttaaccgtttaccgggttctaaccgttaccccgttacccgttacgtaacccgttccggttacggggtacccgtaggggtttaaaccccggg

SEQ ID NO: 212743 - DNA, 797 bp, Homo sapiens
  misc_feature: GYAE6OF01BQ7QW.21.27.C05.1.454.CMB.1.raw
  modified_base (160)..(160): a, c, t, g, unknown or other
  misc_feature (160)..(160): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccagtggggtntcctgtcacagatacaaactcagcagtctggtccaggtacgtggtgacggccctcggcacgtacccctttcactcaccgtgtacgacacgttccgtaccgggggtaaaattcggtacgtcgtgggtaccaaacgtaagttgggttaggtaaattgggacttaacgggtacctacggttacccccggtaggacggtaacggtccgtttagggtaggtcggtaccgtttacggggaaacggttaccctttaacgtttaacgtaaccggttacccctagggttacggtaagttacggtaaacggtaccttaaggtcgtacgtaagtacgttcgtaggtcggaacggtccggttacgtacccttacggaacccttacgtaccccaacccgtacgaccgtaccgtaacaaacggtactaccgttacggttccttacccgtaccgttacctaagttccgtactcggtcccgtaacgtccccgaacgtaccgtacggttacgtttacgttttaagttttccggaacgtacgtaaacgggtcgggtaactccggttaacgttaacggttcggtaccgtaacccgttcccgttaccgttacgtacccggttacgggtccgggtacggttaacgggtttaacccggg

SEQ ID NO: 212744 - DNA, 899 bp, Homo sapiens
  misc_feature: GYAE6OF01BIEGD.21.27.C05.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtcctccacgccaccctgtctgtgtcgtccggaggggggacnccgccaccctctcctgcacagccagtcagtctatcgctgactgtacgcgtaggtacagacaagtaactcgtcggaccacggtccctacccgacggtccttccttacgttaacgttttacccgcgtacctaacctacccgaacccggaacgggtacccctaacggttccgggttaccgtaccccgaacggtaaccgttaacgggttacgtaacggggttcggggtaccgggttaggggttaacggttttaacggggaaccgttaacgggtttaccggttttttcctacccgttaacccgaaaccctaacgttacccgtaaccgggtaccccgttaaccccgtaaacggaacgggtaaaggttaaggaaaacggttagtttacgggtttacggttaacgttttaaacggttttttactttaccgtacggtaccctaaaggtaaccttaaaacgttaaacgtttaaaccgttttaaccgtaccgggtacccgttacgggtacccgggttaccggttaacccgggtttacccggggtaacccggtaaacccgggggtaaaaccggtaaacggggttaaaacggtaaaaacccggttaaaccggtaaaaaccggttaaaccgggttacggttaccgggtacccgtaaccggtaccctaaacccgttacgttacctttaccggtttacccttaacccg

SEQ ID NO: 212745 - DNA, 831 bp, Homo sapiens
  misc_feature: GYAE6OF01CNUYX.21.27.C05.1.454.CMB.1.raw
  modified_base (368)..(368): a, c, t, g, unknown or other
  misc_feature (368)..(368): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccactggagtgattgtgatgacgtacagtcctccagcccacctgtctgtcgtcgtccgagggggacccgcctaccctctcctagcaccgacggccagtccgatcgttatccgacgtcgtacgttgggtacgtaccggttacggtaaccaggaacctaaagaaacttcggtcggaccgtacggtcccctacccggacggtccctaccttccttaacgtttacccggtntacctaccgtcccaacggcgggaacctcggttacggtaccggtacccaggtaccgttacggttcgtacggggtcggggtgggttaacgggttacggtttcgggaaacgttacgggtttagtttttcccaccgtaaccgtacccgtaacgttaccggacccgtacccgttaccccgttaaggaacggttagtaacgtaagttacgttaggttacgttagttttaacggtttttctccggtagtacccgttaacgtaactaaactttaagttaacgttacgtccgggttacgttcggtaccggtaccggttaacccggttccgggtaaacccggtaccgggtaaccgggtaaaggggttaaaccgtaaaaccgttaaccggtaaaccggtaaccggttacggtaccgggtacctaccggtaaacctacccccgttaagtttcccttggtttaaccctttccccgg

SEQ ID NO: 212746 - DNA, 835 bp, Homo sapiens
  misc_feature: GYAE6OF01BYA3A.21.27.C05.1.454.CMB.1.raw
  modified_base (133)..(133): a, c, t, g, unknown or other
  misc_feature (133)..(133): n is a, c, g, or t
  modified_base (160)..(160): a, c, t, g, unknown or other
  misc_feature (160)..(160): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttctcatcttccngcccgtgctcgggcctccagtggggtntctgtcacagactacaaactcagcacgtctcggtccaggtacgtgggtacgacggccctacgctacgtacccctttcacgtacctaccgttagtgaacctacgtaccgtaaccgggggtaaaattcggtccggcttacgggacctaaacgtaagttgggtttaggtaacgtttaggacgtttagggacctacgttccccggtacgtaacggacggttccgtttggacgggtttacgggtcggtttacgggaaaacggtaccttaacgttttacgtaacccgttacccgtaagggttcggttaaagttacggaaaacgtaccggttaatacggtaccgtaaaggtcgtttaccgtggtacgggttaacggtcgggttccgttacgttaccaccgtactaccccgaacccgaccgtaacctaaccgtaccgaagtaaacgaccgttaaccggttccctcccttacccgacgtttaacgttacgtcctttacgacctaccgtaacccgtacggaacccttcgggtacctttttacgggttttaagtttcggtaacgtacggaaacggttcggaaccgtttacgaaccgttaggttaccgggttaaacctcccgtttaacccgttcgttaccgggttacccgtaccggttccggggtaaccgtacgggggttttaaacc

SEQ ID NO: 212747 - DNA, 664 bp, Homo sapiens
  misc_feature: GYAE6OF01A69S2.21.27.C05.1.454.CMB.1.raw
  modified_base (203)..(203): a, c, t, g, unknown or other
  misc_feature (203)..(203): n is a, c, g, or t
  modified_base (325)..(325): a, c, t, g, unknown or other
  misc_feature (325)..(325): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtcgtccgagggggancgccaccctctcctgcacacgccagtcagtctatcgctggtacgttcggttacgccgtacggtaccagacaaacggtaaactcgtggccaggcctcccgacggcctcctctacgtttaccgngctactccaccgacggcctacgtcggtacgtccagacgtagtcgagggtggcggtggtacgttcgggactaggttcgtttcgtactacactacactacgcccgaccgtacagggtagtaggtaaatcgttacggtttagtacgtttagtttttacttccgtacgaaccgttaataccgttaaattaacttaaacgtttccggtcggtcccgtacggttacccggttcggttacccgggtaccggacccggaaacgggtacccgaaagggtagtaaaccgtaacgtaaacggtacgttcggtacggactacgtacgacctagtttcgtcgttcgttaccc

SEQ ID NO: 212748 - DNA, 783 bp, Homo sapiens
  misc_feature: GYAE6OF01C1E94.21.27.C05.1.454.CMB.1.raw
  modified_base (129)..(129): a, c, t, g, unknown or other
  misc_feature (129)..(129): n is a, c, g, or t
  modified_base (160)..(160): a, c, t, g, unknown or other
  misc_feature (160)..(160): n is a, c, g, or t
  modified_base (173)..(173): a, c, t, g, unknown or other
  misc_feature (173)..(173): n is a, c, g, or t
  modified_base (210)..(210): a, c, t, g, unknown or other
  misc_feature (210)..(210): n is a, c, g, or t
  modified_base (775)..(775): a, c, t, g, unknown or other
  misc_feature (775)..(775): n is a, c, g, or t
tcagtcgtcgctcgcacgaccggtgctcgatttagacgcgatcgaagggtttgggggaggaactgctcagttaggacccagacggagccagtggaacgccccagcgcagcttctcttcctctgtcttcnctggcctccaagacaccactggagtgattgngatgacgcagtcnccgacgtccacctgtctgtcgtcgtccgggaggggcnccgccctaccttctcgcgctacgcgtcctagtctagttctacgtcgtcgtagtacgttggttacgccgttacggactagagtaagaacgttcgcggtacgtaccggccttaccggtcgtaccttaccttacgttaccgtttaccggacaccgttaaccgtacccgaaccgggtaccggttacccgtaacgggttccggtaaccgttaccccgaaagggttacccggtaggtttaaaccggtcggggtttagggggtacggttacgggtttaacccgggttagggaaccgttttaaccgggttttccgtttttacccacccggttaaccgtaccggtactacccgggttaccgaacccggttacctaaaccggtaggtaacgtacgttaaacgttcgggttaacgtttcgtaacgttttacgtttacgtacccgtggtaacctaaggtacctttaaagttactaaccggtttctacggtacgtcgtacgtaccggtccgtacgaaccgtaggaacgagtacgaacgacgtaaagtcgagttacggacacgtaccacttcgacgttntccgtacc

SEQ ID NO: 212749 - DNA, 809 bp, Homo sapiens
  misc_feature: GYAE6OF01AT98S.21.27.C05.1.454.CMB.1.raw
  modified_base (701)..(701): a, c, t, g, unknown or other
  misc_feature (701)..(701): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtcctccttcctcatcttcctcgcccgtgcgtcgggacctcccagtcgggggtgtcctgtcaacgatactacaaactacagactagtccgtggtaccaggacgtgggtacgaccggtcccgtacgacgtaaccgtaccccgtttaccaccttaccacccgttaggtactaaccgtacgttaccgggtaaccggggtaaaacgttcggttccggccggttacggacccgtaaacgttaaggttagggtttacgggtaacggtttaggtaaccggtttacggacctacccgggttcccccggtaggaacggtacggtaccgtttacgggaggttcggtacggttacgggtaacgttaccgttagttaacgtaccgtacccgtagggtagtaacgtagaagtacgtagtcgacgtacgtgttcgtaggtcgtacggtcgttaccggtacctaccgacctaccgttccccaacccgtacgtaccaaccggtaccaacgtacctacgtaccgtacccttcccgtacccgtactacgtcgtccgtactaaccgccctaaccggaccttaccggtacggttacctttacgtttnttcggacgtaacgagttacgggacttacgtactacggtttaccggcttaacctccccggttacttacccggtacccggtaggtaccgggtaggggttccgttacccgg

SEQ ID NO: 212750 - DNA, 904 bp, Homo sapiens
  misc_feature: GYAE6OF01EUGI1.21.27.C05.1.454.CMB.1.raw
  modified_base (168)..(168): a, c, t, g, unknown or other
  misc_feature (168)..(168): n is a, c, g, or t
  modified_base (241)..(241): a, c, t, g, unknown or other
  misc_feature (241)..(241): n is a, c, g, or t
tcagtcgtcgctcgcacgaccggtgctcgatttagacgcgatcgaagggtttgggggaggaactgctcagttaggacccaggacggagccatggaagccccagcgcagcttctcttcctcctgcttctctggctccgagacaccacttggagtgattgtgagtgaccncaggtcctaccagccctacctgtcttcgtcgtccgtccggagggggactccgtccctaccccttcttacccgngaccacgacgtcccgtaggtacctacggtacttacgtccggtcgttacggtaaccgtttaggttaccgtccggttaccggttaccgaacggtaccgtaaacggtaaacgttaccgtaccggtaccgtaaccggtcccgttaccccggtacccgggtcccttacccgttaccgttaccgtttacccggtacggtaccttacccgtaaccccgtaaccgggtaccccgggtaagccccccttaaaccggttcggggtacccgtttacccccgggaacgttaaaccgggtaccgggtttaccggttagggttacggggttacccggggtaggttacgggtttttaccgggggtacttacgggtttaccggttttaaccccgttcggtacctaaccggttccttacgtaacccggtacccgtccccgtaaggtaacggttacgtttagggtaacgtaggtttacgttttacgcggtttacgttttacctttacgtacggtaactacgttaaccgttaacgttaaccgtttaattaccggttcgggtaccgttacggttcccggttaccggttaccgggttaccgggaccggttaccgggtaaccgacggtacgtaaacttacgggaactacgtggacgtcgtcgtacgtaacttctcgtcgttaccg

SEQ ID NO: 212751 - DNA, 723 bp, Homo sapiens
  misc_feature: GYAE6OF01CF60Q.21.27.C05.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccacgtggagtgattgtgatgacgcagtctccacgcccaccctgtctgtcgtcgtcggaggggcnccgccctacccttctccgtacgaccaccgacgccgagttacctacgttctacgtccgacttacggtacgttggttaccgtaccgtacggtaccaagaccgtaaagtaacgtccgtcggaccgacggtcccctaccggacgtccctaccgtacttaccgtttaccgacacctaccgtacccggaccgacggtcctacggtcgtccgaccgaggtacgtcggttacgaggtcggggtcgtaggttagttacgggacttaggttccttttccacctaccacgtagtccgtaccgtaccgtaccctacgggggtataacggtagtaacgtagttgttacgttacgtttagttttacgttcgtacgtactaacgtaacttaaagttaacgtttacgttacgtccggtacgtcgtaccggttcgtaccgggtaccgaaccggtaaccggtacggtaacgaacgtaaacgtaacgtaaccgtaggtcgtacgtactacgtactaccgtatcgttctacgtccc

SEQ ID NO: 212752 - DNA, 838 bp, Homo sapiens
  misc_feature: GYAE6OF01DXXCH.21.27.C05.1.454.CMB.1.raw
  modified_base (334)..(334): a, c, t, g, unknown or other
  misc_feature (334)..(334): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactgggagtgattgtgatgacgcagtctccagcccacctgtctgtcgtctccggaggggggacccgccaccctctcctgaccacacgccagtcacgtctactcgctgtacttggttacgccgtaggtaccagacaagtaaactcgtggaccgaggcctcccgaggtccttcctacgttacgttttaccggngacctacgtccccaccggacgggtcccctacggttcgggtccgtaccccgaaggtaccgtacggtttacggaacgggttcgggggtaccgggttagggtttacggttttacgggggaaccgttaagggtttaccggtttttcccgtaaccttacccgtaaccctacggttaccgtacgggccccgtaacccgtaacggtaacgggtaagggttaaacggtaaaggttaacgtttacggtttaccggttaacgtttacgtttttaacgtttccgttacgtacccgttaagtaaccttaaatttaaacgtttaaccgtttaccgggttaccggttcccgttacgggttaccggttacccggttaccggggttaccccggtaccggggaaacccggggtaaccgtaaaacgggggttaacgtaaaaccgtaaaccggtaaaaccggtcggttacgggtacgtaccgtacgtaacccgtacgtacgttcccgttagttcccttacccg

SEQ ID NO: 212753 - DNA, 772 bp, Homo sapiens
  misc_feature: GYAE6OF01C3PLT.21.27.C05.1.454.CMB.1.raw
  modified_base (204)..(204): a, c, t, g, unknown or other
  misc_feature (204)..(204): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccacgccacctgtctgtgtcgtccggaggggacnccgcccaccctctccgtgaccacacgcctagtcctagttcgtctcgcgttacgtacgttcggttaccgccgttacggaaccgaacgaccgtaaacgtaacgtccggacggtaccgaccggtcccctaccccgaacggttccctttacccttaactttacccggttaccgtccgtaccctacccgacccggtaccggaaccgggttccctaacgggttccgtacccgttaaccgaacggttacggttacggttaggcgggtttaggggtccggtttagggtacggtttacggacgtttacgtttaccgtttccacgtaccacgtactacggacccgtacgaccgtaagtacggtaacggttagtacgttacgttcggttacgtttagtttacgtttcgtacgtacgtaactacgtaactattaaccgtcgttaccgtcggtccgtaccggttacggttaccggtaccgtaccgggaaccgtaacggtaacggtaacgtaacggtaacgtaaccgtaagtccgggtctacggtcctacgtacgtccctagttccgttacgttccctaccg

SEQ ID NO: 212754 - DNA, 667 bp, Homo sapiens
  misc_feature: GYAE6OF01DVHL6.21.27.C05.1.454.CMB.1.raw
  modified_base (126)..(126): a, c, t, g, unknown or other
  misc_feature (126)..(126): n is a, c, g, or t
  modified_base (644)..(644): a, c, t, g, unknown or other
  misc_feature (644)..(644): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctnatcttcctgcccgtgcgtgggcctccagtggggtgtcctgtcacagatcaaactcagctagtctggtcaggctggtcgacgccctcgcacgtacccttcactcaccgtgtcgacatcgtacgggaaatgtcgactaggacaacgtagttggtagtaatggaattaggctacgtccgtagagtacggtcttggagtggtgtacggaacgtactagttactacgtcctaggtagtactagaagtacgtagtagtaacgtattcgtaggacggtcggtcggttacgtactaccgacctaacgtacccgaaccccgaagtaaccgaacccgttaacgaaacgtaacgtccgtaccggttccctacccgttaccctaacgtacgttacgttacttaccggtacctacccgtaacccgaccgaaccgttaccgttacttttacgttttacgttcgtacgagtaacggtaaggtacctagtacgtcgttacggtacttaccttaccgtcgtacgtccgttacggnggtaaccgtcgggttcgttaccg

SEQ ID NO: 212755 - DNA, 848 bp, Homo sapiens
  misc_feature: GYAE6OF01CEUR3.21.27.C05.1.454.CMB.1.raw
  modified_base (68)..(68): a, c, t, g, unknown or other
  misc_feature (68)..(68): n is a, c, g, or t
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
  modified_base (269)..(269): a, c, t, g, unknown or other
  misc_feature (269)..(269): n is a, c, g, or t
tcagtcgtcgctcgcacgaccggtgctcgatttagacgcgatcgaagggtttgggggaggaactgctnagttaggacccagacggagccatggaagccccagcgcagcttctcttcctcctgtcttctctcggctcccagacaccatgggatgattgagatgacgtcagtcctaccagcccacctgtctgtcgtcgcggaggggcnccgcctacctctcgncactacgccagtacagtcatcgctagtacgtagttcgccgtagacganacgtaaagtaactccgacggaccacggtcctacccgacgtccctccgtacgtttaccgttccggacgtaccgtaacctaccccggaaccgggaccgggaccccgttcggttaccgggttaccgaaccccgtaagggtaaccggtaccgggtttacggtaaggggtttcggggtacggggttaggtttaaccggttaggggtaccgttaagggttttcctttacccgttaccgaaaccctacgtaacgtacccggttaccgggaacccctaaccgtaaacggttaggtaaccgttagggtaaaccgtttagtttacgggtactacgggtttttaacttttaccggtagtacccgtaaggtaaacctaagttttaaactaggttaccgttttaacggccgggtacttaccggggtcggttaccggttaacccgggtttaccggaacccgggaaacggttaaaccggtaagggtaaaacccgtaaaccgttaaaccgggaaagttaccggttaggggaaccggttacctaaacggtaaccctaaccgttaccggtttaagttcccgtttaccggttaaaccc

SEQ ID NO: 212756 - DNA, 931 bp, Homo sapiens
  misc_feature: GYAE6OF01DCHC6.21.27.C05.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagacgcgatcgaagggtttgggggcagagcctgctgacttctggctgaccagggcagtcgaccggagctccgagacaatcgtctgtctccttcctcattcttctcgccgtacgtcggcctccgtagtcgggtgtaccgtgtacgactaaaatacagctgcaacgcgagtccggtcgaaggacgtggacgaacgcccgtgacctaacgtccctctaccgtaacttccgaccgttacgccggtaacacggtcggtaccgggggaatacgttagtaccttanacctaactaacgttagtacgtaggtaagttacggagttacgaggtaccgtaccgtcccgtagaacggtacggtacttaggacggtacgtacgtaacggggtaagtaccgtaacgtttccgtaaacgcggttaaccgtaaggtacgttaccggttagtttaacgttaaggttaacgtttaacgtcggtaccttaggtcgttaaccggtttaaggacggttaaaggtaacgtaaccggtaaggttaaacggtacttaaacgtaaccgtaaacgtttaacccgaaacccgtaaccggtaaacgggttaaaccttaaaccgtaccggtttaacccgttttaccccggaccggtttaacgttaacccgtttaacgggtttaaccgtaaacccggtttacgttaaacccgggttacggttaaccggtaaacccccgttaaccccggggtaaacgggaaacccgtttaaaccgggttaaccgtttaaccgtaaacccgttaaacgggttttaaacggtttaaacccggtaaagtaacccgttaaacccgggtaacgtttaaccccggacggggtaaccggttaaacccgttaaccccgtaaacggtaaccccggggttaccccggg

SEQ ID NO: 212757 - DNA, 796 bp, Homo sapiens
  misc_feature: GYAE6OF01DGROZ.21.27.C05.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgcgatcgaagggtttggggaggaactgctcagttaggacccagacggagccatggaagccccagcgcagcttctcttcctcctgcttctcgtggcctccagacaccacgtggagtgattgtgatgacgcagtctccacgcctacctgtctgtcgtcgtccgggagggggacnccgccctacctcgtccgacgaccacgacgaccgtagtactagttctacgtcgcgttagtaccggttcggttacgtccgtacggtaccgacgacaagtaacgtcgtacggaccgacggtccctaccgtacggccttaccttacgttaaccgtttaccgacgtacctaaccgtacccgaaccggtacggacctaccggtcggtaccgtacccgaacgtacgtacggtacgtagggtcggtacggtaggtaggttaggaacgtagtttacgtttcttaccgtacctacgtacgtaccgaccgtcccgtaaccgtacggtagtaacggtaagtaacgggttagttaccgttaagtacttttacgtttacgtttacgaccgtactaacggtaattaaagttaacgtttaaccggttacggtaccgtccgggtttaaccggtaccgggttacccggttaaccgggtacccgggaaccggttaacccgggaacggtaaaaccgggtaaacggtaaaaccgttaaaccgaaacgggttacgtcgggtaccgtacgtaaccgaccttaaccgtacgttcgtttcgttacccttccg

SEQ ID NO: 212758 - DNA, 777 bp, Homo sapiens
  misc_feature: GYAE6OF01BG476.21.27.C05.1.454.CMB.1.raw
  modified_base (75)..(75): a, c, t, g, unknown or other
  misc_feature (75)..(75): n is a, c, g, or t
  modified_base (99)..(99): a, c, t, g, unknown or other
  misc_feature (99)..(99): n is a, c, g, or t
  modified_base (124)..(124): a, c, t, g, unknown or other
  misc_feature (124)..(124): n is a, c, g, or t
  modified_base (191)..(191): a, c, t, g, unknown or other
  misc_feature (191)..(191): n is a, c, g, or t
  modified_base (423)..(423): a, c, t, g, unknown or other
  misc_feature (423)..(423): n is a, c, g, or t
tcagtcgtcgctcgcacgaccggtgctcgatttagacgcgatcgaagggtttgggggcagagcctgctgacttcnggctgaccagggcagtcaccgganctccagacaatgtctgtctccttcncatccttcctgcccgttgcgtcggccctccgagttggggtctcctgtcacacgtataccaactacgngacctagtcgtggccgaggacgtggtcgaccggcctcggaccacgttacccttgaacctctaaccgtggtacaaccgtactacggtaccgggtaaatcggtacgcgtaggaccaagtagtggttagacgtttggattacggccgaccgtcccgaggaggtacggtccgttggaggtcgacgttaggagtaccttattacgtacgtcgtagttaggtacgagtacgtactcgnggtacaggtattcggaagtcggtacgttccggctttacgaccgtaccctaccgtaccgtaaccgacgtacccgtaaatacccgaagttacccgaggttacccgtaccccttaccggtaccctaaacgttacgtttcccgtactacccgttaaccggtacccgttaaccccggcggtaaacccgttacgtttaaccgtttttaattttaccggtttaggaccgttaaaccgggaacgttaccggtaaccgttaccggttaacgtttaccgggttccgaaaccccgttttaccgttaacccgttccgttacccggacggttacccgggtgggggttaaccttacccggggtttacc

SEQ ID NO: 212759 - DNA, 744 bp, Homo sapiens
  misc_feature: GYAE6OF01DEPHH.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtcttgtcctccttcctcacttcttcctcgcccgtgcgtcggcctcccgagttggggtctcctgtcacagactacaaactcgagctagtcgtcggtacaggtcgtggtcgacggccctcgacctaccgttacccttcacctccaccgtgcgacacgtccgtaacgggaatcgtcgcgtacggactaacgtagttggtacggtaagtggtagtacggccgtaccggtcccggtagacggtcggtcgttaggtacggtcggtacggtacgggaacgttacttaacttacgtaccgtccgtaggtacggtatacggaactacgtagtacgacgtagttacttcggtggtacggtacggtcgttacgtaccgtacctaccgtacctacccaccggtactaaccgaccgtacgaacgtactaccgtaccgttaccccttaccccgtaactaccgttacgtccgttaccttccgtacccgaacccgtacccggaacgtacccgttacgtaacgttttacgtttttacgttcgtaacggttacgtaacggtcgtaacgtaccgttaggttaccgttcggtactaccccgtttacgtaccgttaccgtacggtccgggtaacggtcggttacgggttaaccg

SEQ ID NO: 212760 - DNA, 1033 bp, Homo sapiens
  misc_feature: GYAE6OF01CW8E8.21.27.C05.1.454.CMB.1.raw
  modified_base (127)..(127): a, c, t, g, unknown or other
  misc_feature (127)..(127): n is a, c, g, or t
  modified_base (188)..(188): a, c, t, g, unknown or other
  misc_feature (188)..(188): n is a, c, g, or t
  modified_base (227)..(227): a, c, t, g, unknown or other
  misc_feature (227)..(227): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttcnctggcctcccagacaccactggagtgattgtgatgacgctagtctccacgcccaccctgtntgtcgtcgtccgaggggggacccgaccctaccctctccngacacgacgaccagtcacgtctatcgactagtacgttaggttaccgtccgtacggtaccgaacgaacgtaaagtaaacgtccggacggacccgacggaccctacccgacggtcccttacccgttacgttaaccgtttaccgcgtacctaacccgtacccgaaccggtaccgggtacccttacggttacccggtccgtaaccccggtaacggtaaccggtttaacgggttaccggtacgggggttacggggttaccgggggttaagggtttaacgggttttaaccggggaacgttttaacgggtttttacccggtttttacccgtaaccccgttaaacccgaaacccggttaagtaccccgtaacccgggtaacccccggtaaccccgtaaaacgggtaacggttaaacggggtttaagtaaaccggtttaaggttttaccggtttaacggtttaaccgttttaaacgggtttttaacctttaccggttaccggtaaacccgttaaacggttaaccctttaaagtttaaaaccgttttaaaccgggtttacccggttaacccggtttaaccggttaccgggttaacccgggtttaccggtttaacccgggttaaccgggtaaaccggggtaaaaaacccccggggttaaacgggtaaaaccggggttaaaccggtaaaaaaccggtaaaccccgggtaaaacggtttaaaaccgggtttacgggaaccggttaaccggttaaacccggtaaacccttaacccgggtttaacctttacgttaccccggttttaaccccgttaaacccg

SEQ ID NO: 212761 - DNA, 841 bp, Homo sapiens
  misc_feature: GYAE6OF01DRO1O.21.27.C05.1.454.CMB.1.raw
  modified_base (224)..(224): a, c, t, g, unknown or other
  misc_feature (224)..(224): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctgctcccagcaccactggagtgattgtgatgacgctagtctccagcccacctgtctgtcgtccgtacggaggggggactccgcccaccctcttccncgcacgacgccaggttcagttacctagtcgacttacgtacgttaggttacgtccgtacggtaccagacgaagtaaacgtccgtaggcccgtaacggtccccgtccgacggtccttcccggttacttacgtttacccggtacgcctaaccgtaccctaccggacgggaccccgttacgtcggtccgtacccgtaaggtaccgtaggtttccgaagggttcggggtccggggttagggttagtttacggggaacgttacggtttacgtttttacccgtccctacctaaccgtactccgtacgtcccgtacccttacggaaggttacggtaaggtaaagttacgtttcggttacggttacgttttaggttttaccgttttccgtacggtaccgttaagttaacgttaaacgtttaaacgtttaacttaaccgggttccgttaccgggtaaccggttccgggtttaccggttaacccgggttcccggaaccggtaaacccggggttaaacggaaaacggttaacgggaaaaccgttaaccgtaaaccgggtaacggttcgtacggtaccgtacccggtacctaacccgttagtttccgtaaaccggtttccctttaacccg

SEQ ID NO: 212762 - DNA, 675 bp, Homo sapiens
  misc_feature: GYAE6OF01DECLS.21.27.C05.1.454.CMB.1.raw
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (271)..(271): a, c, t, g, unknown or other
  misc_feature (271)..(271): n is a, c, g, or t
  modified_base (337)..(337): a, c, t, g, unknown or other
  misc_feature (337)..(337): n is a, c, g, or t
  modified_base (611)..(611): a, c, t, g, unknown or other
  misc_feature (611)..(611): n is a, c, g, or t
tcagtcgtcgctcgcacgaccggtgctcgatttagacgcgatcgaagggtttgggggaggaactgctcagttaggacccagacggagccatggaagcccccagcgcagctttctcttcctcctgccttctctggcctcccagaccaccactggagtgattgtagatgacgcagtcctccacgccctccgtgtctgtgtccgtccggagggggcnccgccctacccgtctccgngccacacgccagtctagtcatcgctgtacgttggtacnccgtaggtaccagtacaagtaactcgtacggccgaggcctccgagtcctactacgttactttccgngacctacgtacccgacgacggtacctacggtcgaccgtacccgagaccggttggttagcggggttcggccggttaggtacgtttgggaactacgtttcgttcctacgtacaccgtagtcaacgtccgtaccagtacgagtacgtatgttagtgtactttaagtttcacgtacgacgtaacgacttaaagtttagtaaccgtttacgtccggtacgtccgtacgggttacctaccggttaccgggaaccgtaaaccgggtataaaccggggtaanaaacggtccgtaaacgtaggttcgaccgatcgtaccctacttcgttacgtgttacctttacccg

SEQ ID NO: 212763 - DNA, 927 bp, Homo sapiens
  misc_feature: GYAE6OF01AIQ6E.21.27.C05.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagacgcgatcgaagggtttgggggcagagcctgctgacttctggctgaccagggcagtcacggagctccagacaatgtctgtctccttcctcatcttcctgcccgtgcgtcggcctccagtggggtctcctgtcacagactacaaactacagctagtcgtcggtccaggtactgggtacgacggccctcgctacgtaccctttcactacnccgtagtacgacgtacgttaccggtaaccggggtaaagtcgttaccgcgtacgggactaaacgtaacggttgggttaggtaacgtttagggtaaggttacgggtaccgtaccggttaccccgggttacggaacgggtaacgggttcccgtttaggtaagggttcggggttaccgtttacgggggaaaacgggttacccctttaaacggttttaaccggttaaccggtttaccccggtaaggggtttacgggttaaaggttaacgggaaaacggtttaacccgttaggttacggaacggttaacggttacgttttaccgggttaggttacgggtttacccggggtacgggttttaccggttacccgtacccgtaaccgtttacctaaccccggtaacccccggaagttaacccaaccccggttaacgaaaccgtacgtaacccggtaccgttaccctacccccgtactaaaccctttagttaccgttcgtacccgtccctaacccggtaacccgacgtaacccgtacggttaaccgtttagttttaccgtttacggtaacgaccgggtaacgtaacgggtacctcgttaacggttagttaacccggtccgtttaaaccgtttccccttacgtacccgttaccggtaccgggtacgggttaacccgggtaacgggttttacccggg

SEQ ID NO: 212764 - DNA, 771 bp, Homo sapiens
  misc_feature: GYAE6OF01A44JT.21.27.C05.1.454.CMB.1.raw
  modified_base (151)..(151): a, c, t, g, unknown or other
  misc_feature (151)..(151): n is a, c, g, or t
  modified_base (670)..(670): a, c, t, g, unknown or other
  misc_feature (670)..(670): n is a, c, g, or t
  modified_base (755)..(755): a, c, t, g, unknown or other
  misc_feature (755)..(755): n is a, c, g, or t
tcagtcgtcgctcgcacgaccggtgctcgatttagacgcgatcgaagggtttgggggaggaactgctcagttacggacccagacggagccatggaagccccagcgcagcttctcttcctcctgcttctctggctcccagaccaccatcggngtgattgtgatgacgcgtagtctcacgcctacccgtgtcttggtcgttccgtaccggaggggggcaccggtcccacccttcgtccgtgaccgaccggacgtaccgtaggtaccgtacgtttaccgtacgttccggtacgtacgttacgttacggtttaccggcccgttacggggtaaccacggtaccgtaaaggtaaaccgttccggtaaccggccccgtaacgggtcccccgtaccccgtacgtccgttaccgttacccgttaacggttttcccgactaccggtacccacccggttacccggaccggacccgtcggttccgggtacctaccggaacgttcgggtaacggttcgaaggggttcggtggtttaagtacgggttacgacgttaggttctttacctacttccgacgtacgaccgcgtaacccgtaccgtataggacgtagtacgtgtagtcgttacgttatttcgtcacgtacgacgttataagttacttaagttcgtacgtacgtccggtntaccgggtcgtacgaccggtaacggaaccgtaagttaccggaacacggttaaggagttggtaccgcgaccgtacgccttaggttnttaccgtgttaacccg

SEQ ID NO: 212765 - DNA, 822 bp, Homo sapiens
  misc_feature: GYAE6OF01D67UZ.21.27.C05.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagacgcgatcgaagggtttgggggaggaactgctcagttaggacccagacggagccatggaacgccccagcgcagcttctcttcctcctgcttctctggctccagacaccacgtggagtgattgtgagtgacgcacgtctccacgccaccgtgtctgtcgtcgtcggagggggcnccgcctacccgttctccgtcgccaacgtacgccgtaacgttccgacgttccttacgtccgtacgtcggttaacggttacggttaccgtccggtacgtaaccgacgtaacgtaaacggtaacttccggaccggtaccgacggttccccgtaccggtacggtccctttaccgttaccgttaacggtttcccgtcgtaccctaccgttacccggaacccggtacggtacccgttaccggttaccggtaccgttaacccgaaacgggtaccggttacggttacgggtacggggtttacggggtccgggtttaagggtttacggtttaacgggtaactttaacgggttttccgtttccaccgttaaccgtactacgtaccgtaccgacccgttaccgtaaggtacgtaacggtaaggtacgttacgtttgttacgttacgttagttttaacgtcgtaacgccgtaagttaacttaacgttaactttcgttaaccggtcgtaccgtcggttaccgttccggtacccggtaccgacgggtaaccggacggttaaacgaacgtacgttaaccgtaacgtcggtcgacgtacaccgtactacgatttcgtcgtttacccgtac

SEQ ID NO: 212766 - DNA, 876 bp, Homo sapiens
  misc_feature: GYAE6OF01D472E.21.27.C05.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtcgtcctccggagggggacnccgcccaccctctcctgcacagccagtcacgtctactcgctgacgttggttacgccgtaggtaccagacaagtaacttcgtaggacccacgggtcccctacccggacggtcccttaccttaccgtttaaccggtttaccggacgtacctaccgtacccggaccggtaccgggtaccctacgggttcggttacccgtacccgaaggtaccgggttacggttaccgggtaacgggggttcggggttacggggttaagggtttacggggttttaacggaaccggttaaggttttacccgtttttccgtaacccgttacccgtaaccgtacgttaccggtacccggtacccccgtacccgtaaagggtacgggtaacgtaaaggtaagttacggtttaggttaccttaacggtttttagttttaccgtcgttaccgtaacgtaacgtaaactttaaagtttaacgttaaccgtttacggtaccggttcccgttaccgggtaccgggtttaccggtaaccgggtaccggggaaacccgggttaaacccgggttaaacgggaacggggttaaacctaaaaccggtaaacccgggtaaacggtttacgttcggggtaccggtcgtaaacccgtaaccgtattaaccccgggtttctttaccgttcccgttaaaccccg

SEQ ID NO: 212767 - DNA, 796 bp, Homo sapiens
  misc_feature: GYAE6OF01CWZTH.21.27.C05.1.454.CMB.1.raw
  modified_base (208)..(208): a, c, t, g, unknown or other
  misc_feature (208)..(208): n is a, c, g, or t
  modified_base (230)..(230): a, c, t, g, unknown or other
  misc_feature (230)..(230): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattggtgatgacgcagtctccagccctacctgtctgtcgtctccggaggggggacnccgcccacccttctcctgccanacgtccgagtcacgtctactcgtctaggtacgtggttacgccgttacggtaaccagtacgaagtaaacgtcgtacggccgacggcctccccgaaggtccttccttacttacgtttaccgcgaccctacgttacccgaccggtcgggaccgtacggttcggtccgtacccgaaggtaccgtacgggtttacgaggggttcgggtaccggggttaggtttacggtttacggggaacttacgggtttaactttttcccgccgttaccacctacgttccgacgtaccccgtaccgtaacgtaacggtaagttacgtaaggtacgtttacgggttcgttacgtttacgtttttaactttccggtacgttacctaacggtaactttaaacttaacgtttaacgtttaccggtaacggttcccgttacggttaccggttacccggttaccgggttccccggaaccgggtaacggggaaccggtaaacgggttaacggtaaaacgtaaccggtaaagtacgggttacgtacggtacctacgtaactaccgttagttccgttgttaccttacccg

SEQ ID NO: 212768 - DNA, 774 bp, Homo sapiens
  misc_feature: GYAE6OF01DAHG0.21.27.C05.1.454.CMB.1.raw
  modified_base (126)..(126): a, c, t, g, unknown or other
  misc_feature (126)..(126): n is a, c, g, or t
  modified_base (135)..(135): a, c, t, g, unknown or other
  misc_feature (135)..(135): n is a, c, g, or t
  modified_base (155)..(155): a, c, t, g, unknown or other
  misc_feature (155)..(155): n is a, c, g, or t
  modified_base (373)..(373): a, c, t, g, unknown or other
  misc_feature (373)..(373): n is a, c, g, or t
  modified_base (568)..(568): a, c, t, g, unknown or other
  misc_feature (568)..(568): n is a, c, g, or t
  modified_base (662)..(662): a, c, t, g, unknown or other
  misc_feature (662)..(662): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctnatcttccgngcccgtgctcggcctaccgngtggggtctcctgtcacagactacgaaactcaagctacgtcgtcggtacccgagggtaccgttgggacgaccgggtccctccggaccgtacttaaccccctttcaccttacccgactggtacggactacgtccggtaccgggaaaattcgacgtcgtacgacaacgtattgggttacgtagtggtagtacgcgtacggtcccgagtagcgtcgtacgnggtcggtcgtaggtaacgtacttaagtcgtaaccgttccgtaggtaggtaacgtagaacgtagtacgtagtaccgtagttacgtcgtggtcgtacggtcggtcctaccgctacctaccgtcccaaccgacgtaccacgtaacaacgtacgtcctacggtaccccttaccggtactaacccgttatcggttacccncgtaccctacccggtacccgacgtaaccgggtaccgttacggttttaactttttaccgggtttgaaccgggttacgtaaggaccggggtttacnccggttaaccgtttcgggtaccggtttcgttaaaccccccttagtttacccgggttacctccccgggtttagggtaccccgggggttaagtacccggggtttttaacccggg

SEQ ID NO: 212769 - DNA, 896 bp, Homo sapiens
  misc_feature: GYAE6OF01EHLIX.21.27.C05.1.454.CMB.1.raw
  modified_base (164)..(164): a, c, t, g, unknown or other
  misc_feature (164)..(164): n is a, c, g, or t
tcagtcgtcgctcgcacgaccggtgctcgatttagacgcgatcgaagggtttgggggaggaactgctctagttaggacccagacggagccatggaagccccagcgcagcttctctttcctcctgtcttctctggctcccagacaccacttggactcgatttcgngagtacgacgtcaagtctaccacgccctaccgtgttcgtgtccgtcgtccgggaggggggctccgacccctacccttccgtccgtagaccctaacgacgtcctagtcctacgttctagtcgtacgtcgtacgttcggttacgtccgtacggtaccacgacgtaagtaactcgcgaccgacgtcctaccgacgtcctaccgtacttacgtttaccgtgcctaccgtcccgaacggtacggtcccttacggttcggtaccgtacccgtaaggtaccggttaggttaccggtaggggtcggggttaccggggttacggtttagggtttacggggtaaccttaagggttttccgttttacccgtacctaccgtaaaccttacgttcccggaaccggttccccggttaacccgtaaggtaaggtacggttaaggaaacgttgttacgggtttacttacgttttttaacggttttacttaccgtacgtaccggtaattaacggtttaaactaccttttaaaggtcccggttacggtaccggttaccggtttacccgggtaccggttacccgggttaaccccggggaacccggttaaacccggggtaacgggttaaaccggtaaaaccgggtaaaccgtaaaaccccgggttaggtaaccgggtttcggaacccggttacgtaccgggttaaccccctatttaacggtttccggttttaacccgttccgtttaaccccg

SEQ ID NO: 212770 - DNA, 693 bp, Homo sapiens
  misc_feature: GYAE6OF01A7CE9.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctccagcttctctggctcccagacaccactggagtgattgtgatgacgcagtctccagccaccctgtctgtgtctccgagggggganccgccaccctctcctgcacagccagtcagtctatcgctgacttggttacgcctacggtaccagacaagaactcgtcggaccacggtcctaccccgacggtccttccgtacttaccgtttacccggtcgacctactcccgaacccgtacggggccctacggtcggtccgttacccgacgtacggtacggttcgaggttcgggaggtggtagttagggactaggtttacgtttctcgtacacctagtcgacgtccgtaccctagaagtacggtaagaagtattggttagtacgtttaagttttcttcgtacgaccaagtacctaattaacttaacgttaccgtcggtacctacggtacgttaccggtacggttaccggaccggtaaaccgggtaacgtaaacgggtaacggtaaacctaacggtaaacccgttacgttacgggtacggtaccgtacgtaccctaacgtattccgtttacgttccgttaaccc

SEQ ID NO: 212771 - DNA, 852 bp, Homo sapiens
  misc_feature: GYAE6OF01B760B.21.27.C05.1.454.CMB.1.raw
  modified_base (761)..(761): a, c, t, g, unknown or other
  misc_feature (761)..(761): n is a, c, g, or t
  modified_base (792)..(792): a, c, t, g, unknown or other
  misc_feature (792)..(792): n is a, c, g, or t
  modified_base (838)..(838): a, c, t, g, unknown or other
  misc_feature (838)..(838): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtcctccttcctcacttccttcctcggccccgttgccgtcgggccctccgaggttcggggtctcctgtcacagatacaaactactacgctagtcgttaggaccgaggacgttggtacggccggtaccctcggacacgtaccttaatttccgaacttccgacgtacggttacgaaccgttagttacccggtaacggggtaaaacttcggtaccggtcgacggacctaaacgtaaggttaggggttaacggtaaggttcggtaacgtttacgggacccgtttaaccgggtaccccggtacgggtaacggtacggttaccgtttagggtagtacgggtacggttagggtaaaaccggttactttaaacggttaccgttaaccggtaccgttaagggttacgggttaacgtaaccggtaagtaacgtaacgttaacgtaacgtaagttccggttagtacggggttacggaggtttaccggtcgttaccttaccgaacccgtacgtaccccgtaacgacccggtaactaaccggtaacctaaacgggaccttacggtaacgtttaccccgtaccctaaccttaccggtaactcgtaccgtcgtacccgtaccgtaacccggaccgtacgtaaccggttatttaaccggtttntttaccggaggtacgtaagaaccgggttacncgtaacttcggtacgttctaccgtacttctacgaccgttacccggnggtcggttaaacgg

SEQ ID NO: 212772 - DNA, 656 bp, Homo sapiens
  misc_feature: GYAE6OF01D5YB0.21.27.C05.1.454.CMB.1.raw
  modified_base (225)..(225): a, c, t, g, unknown or other
  misc_feature (225)..(225): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
  modified_base (400)..(400): a, c, t, g, unknown or other
  misc_feature (400)..(400): n is a, c, g, or t
  modified_base (469)..(469): a, c, t, g, unknown or other
  misc_feature (469)..(469): n is a, c, g, or t
  modified_base (513)..(513): a, c, t, g, unknown or other
  misc_feature (513)..(513): n is a, c, g, or t
  modified_base (554)..(554): a, c, t, g, unknown or other
  misc_feature (554)..(554): n is a, c, g, or t
tcagtcgtcgctcgcacgaccggtgctcgatttagacgcgatcgaagggtttgggggaggaactgctcagttaggacccagacggagccagtggaacgccccagcgcagtccttctcttcctcctgtccttctctggcctcccagacaccagtggagtgattggtacagtgacgctagtctccgaagccctacctgtaccgtgtacgtcgtaccggagggggacnccgtccacccgtctccgcacacgacgccagtcagtcatcgctggacttagtacaccgtacggacagaccaataaacgtctacggaccaggtccccgtccgtaggtccttaccggtacttaacgtttccggacncctaaccnccgaaccgacgggactacgttcgtacgaccgaanaccggtggtacgacgggtgggttacgtgggtaacgttaccgggatacggtttaacctttctaccgtaancccgtaagtccgacgaccgtcctaagcgtagtataggattacgnttagttatttagtctacgacacgtataacgtataaaccgtnacgtcgtagtcggtaacgttacggtaccggacgtaaccgaacgtacgtaagaaccgtaacgaactgtacgcgatacgtacctatacgtacttcgtcttaccg

SEQ ID NO: 212773 - DNA, 818 bp, Homo sapiens
  misc_feature: GYAE6OF01AHCOJ.21.27.C05.1.454.CMB.1.raw
  modified_base (125)..(125): a, c, t, g, unknown or other
  misc_feature (125)..(125): n is a, c, g, or t
  modified_base (510)..(510): a, c, t, g, unknown or other
  misc_feature (510)..(510): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttctnatcttcctgcccgtgctcgggcctcccagttggggtctcctgtacacgagactaccaaactacagtctagtccgtcggtccaagggtctcgggacgacggcccctcggctaaccgtacccttcgacctaccaccgtgtacgacctacgtttccgggtaaacgggtaaatcggtaccggtcgttacgaccgtaaacgtagttacgggtaggtaagttggtaacgttacggtaccgtaccggttaccccggtacggtacggtacggtccgtttaggtacggtcggtacggttagggaacggttacctttaacgttaccgttaccgggtaccttaggtacggtaagtacgtaaacgttacgtacgtaggtacctaagtacgtttacgnggtacgtacggtcgtcgtaccgtaccgaacctaccgttaacccgaccgtacgtaaccggtaacccgtaaaccgtaaaccgtacgttaccgaacccgttacccttaacccgtaccgttaaccttacgttccgtacttaccgtaacccgttaaccgtaccccggtaacgtaaccggttccgttacttttacggttttacgttacggtaacgtacggtaacggagttaccctacgtaacgttggtacccggttataccccttacgtcccgtcgttacccggtaccggtacggtcccggttaaacgttccgg

SEQ ID NO: 212774 - DNA, 842 bp, Homo sapiens
  misc_feature: GYAE6OF01AXMIJ.21.27.C05.1.454.CMB.1.raw
  modified_base (99)..(99): a, c, t, g, unknown or other
  misc_feature (99)..(99): n is a, c, g, or t
  modified_base (189)..(189): a, c, t, g, unknown or other
  misc_feature (189)..(189): n is a, c, g, or t
tcagtcgtcgctcgcacgaccggtgctcgatttagacgcgatcgaagggtttgggggcagagcctgctgacttctggctgaccagggcagtcaccgganctccagactaatgtctgtctccttcctcatcttcctgcccgtgctgggccctcaggtgggtctcctgtcacgagtactaacaaactacgngcgtagtaccgtcggtaccgaggtacgtcgggtggacccggtccctcgaccgtacccgttacccttaccaccttcccgaaccgttggtaccgacctacggttaccccgggggtaaaacgggggtaaattcgggttacccgacggttacggaaccctaaaaggttagggtttacggggttaaggttaacgggttttaggtaacggttacgggtccgttacccggggttaccccggtagggacggtaaccggttcgttacggagggtttacggtacggttaagggtaaccgtacttaagtttaacccgtaccccgttacgtagggttagtacgtaagtaacgttactagtacgtaagtagttacgttcgtaggtacgtcggtaccgttcggtaaccgtactaaccgtacctacccgaaccccgacggtaaccctacccgtaaacggtataccgtacccgtaccggttccccttaccccgaccttaaccgtacggttccgtaccttaccgacctaacccccgtaccggaccgtacgttaccggttactttttacggttttacgttacgacggtaacggtaagtacggtacttaccgacgtttcgtaacggtccttaccctcttcgtacggtcgacgggtcggaacggtttcggtac

SEQ ID NO: 212775 - DNA, 834 bp, Homo sapiens
  misc_feature: GYAE6OF01EWMXP.21.27.C05.1.454.CMB.1.raw
  modified_base (163)..(163): a, c, t, g, unknown or other
  misc_feature (163)..(163): n is a, c, g, or t
tcagtcgtcgctcgcacgaccggtgctcgatttagacgcgatcgaagggtttggggcagagcctgctgactctggctgaccagggcagtcaccggagctccagacaatgtcttgtcctccttcctcatcttcctgcccgtgcgtggcctcccgattcggggtntcctgtcacagactacaaacttcgagcagttcctggtaccaggtacgtggtcgacgtcctcgctacgtaccctttcactcaaccgtgtacgaactacgttacggtaccggggtaaaattcggtaccgtacgtacggacctaaaccgtaagttcggtttacggtaattacggtaacgtttacggaccgttaacccggtaccccggtacggtaacggtacgggtacccgttaggtacgggttcggaaccggttaggggtaacgtaacccgtttaagttaaccgttaccggttacccgtaaacggttggtaaacgtacggtaaacggtacgttagtacgtaacgtacgttaacgtttactaggtacggtacgtaccggttccgttaccgtaaccgtacgacgtttacccgaacccgtacgaaccgttcccggtaaacttaagaccgtactaaccggtcttacccgtacctacgttaatcgttaccgtacgtaccaacccgttaccgacccggtaacgtaccggttactttaacggtttttaacgtttacgtaacggtaccggttaaaacgggtacgttaaccgtaccgttaacggttacgttaacgggttctacccgttaacccgttccgttaccgaccgtttacgggccggttacggtaccgggtttaacccg

SEQ ID NO: 212776 - DNA, 739 bp, Homo sapiens
  misc_feature: GYAE6OF01B6R8T.21.27.C05.1.454.CMB.1.raw
  modified_base (172)..(172): a, c, t, g, unknown or other
  misc_feature (172)..(172): n is a, c, g, or t
  modified_base (184)..(184): a, c, t, g, unknown or other
  misc_feature (184)..(184): n is a, c, g, or t
  modified_base (567)..(567): a, c, t, g, unknown or other
  misc_feature (567)..(567): n is a, c, g, or t
tcagtcgtcgctcgcacgaccggtgctcgatttagacgcgatcgaagggtttgggggaggaactgctcagttaggacccagacggagccatggaagccccagcgcagcttctcttctcctgcttctctggcctaccgagacaccactggagtgattgtgatgacgcgagtcncagccctacctntcgtgtgtcctcggagggggcccgaccctaccctctccgagacctacacgccgaagtcagtcctatccgactggtaaccgttggttacctaccgtacggtaaccagacgaaacgtaacgttcgccggaccgacggtccctccgaaggtcctaccgttacttaccgttaccgtcacctaccgtacccgaacggtacggtacccgcggttacgggtacctacccgaaggtaccggttaggtaactcgggggttaggtcggtacggttacggttacgggtacttaggtttaaccgtttctaaccgttaccaaccgtacgtaccgtaccggtacccgtaccgtagtaacggagtagtaacgtattggttcgttaacgttagttttcncgttacgagtaccgtaataactttaagtacgttacgttcggtacgttaccggtacgttaccggtaccggtaccggtaaccggaaccggtacgggtaaacgtaacggaaacgtaaaccggaacgtacggtcggtacgcttacggacccttactacgtcttgttcccgttaacc

SEQ ID NO: 212777 - DNA, 886 bp, Homo sapiens
  misc_feature: GYAE6OF01CCHZ9.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgcgtcggcctccgagtggggtctcctgtcacgacgactacaaactcagcctagtcctggtccgaggtacgtgggtcgaccggccctcgacctacgttaccctttcaccttccgaccgttgtacgacctacggtaccggtaaccggggtaaattcggtccggtcgtacggacctaaacgtaagtttggttaagtacgttaggtacgttacgccgtaccggttacccggtacgtacggtacggttccgtaggacggtcggtacgtaagggtacgtaacgttagttaacgtaccgtaccgtaggttacgtagtagaacgtacgtacgtcgaacgtagtactttcggacggtggtaccggtccgggttccgtaacgttacccgtaacccgtaacgtaccccgaacccgttaacggaacccgtttaaaccggaaccgtaaacggtaaccgttccggtaacccggttaccccgtttaaccccctaaccgtttaaaccccgtttaacgttccggttaccgtttaaccctaccccggtaacccgttaaccccgggtaacccgtacggtttaccggtttacctttttaacggtttttaaccgtttacggacggtaacggttaaacgggtccgttaaaccgttaccgtaacgggttacccggttacggttaacccgttaacccctttacccggttacccggtttacggtaacccggttccggggtaacccgggttaacggttacccgggtttaccg

SEQ ID NO: 212778 - DNA, 985 bp, Homo sapiens
  misc_feature: GYAE6OF01C6XUW.21.27.C05.1.454.CMB.1.raw
tcagtcgtcgctcgcacgaccggtgctcgatttagacgcgatcgaagggtttggggaggaactgctcagttaggacccagacggagccatggaacgccccagcgctagcttctcttcctcctgtcttctcgtcggccctccgaacgacaccacgtgggtagtgtagttgtagatcgacgctacgtcctccgacgccctacctgtctgttcgtccgtacggggacggggactcccgaccctacccttccgtccgtacggaccaacgaccggtaccgtacgttaccgtacgttaccgttacgtaccggttaccgttacgggttaccggtttacgggttacccggtaacccggttacccgggttaacgaaccgtaaacggtaaacgttaaccggtcccggtaccgggtaccgtaaccccggtcccgttaacccccggtacgggtttacccctttaccgtttaaccgtttaccgtttaacccggtacctaacccgttaacccgaaccccggtaaccgggtacccgggttaccccgttaagggttccccggtaaccggtacccggtaacggttaacgggtttaccggttaaccggtaggggttccgggtaggggtttaacgtttaacgggtagtaacgtttacggtttacctttcgtacctacctacgtacgtaccgacgtaccgtaccgtaagacgtacgtaacggtagttaacggtttcgttacgttaacgggttttacgtttacctacggtaccgtaacggttaactaaagtttaccttaacggttaaccgttcggttaccgtcggttaccggtaacccgggttcgggttaacccggtacccggtaaacggggaaccgggttaaaccggaaagggttaaaacccgttaaaccggtaaacggtaaacggttcggttaacccggggtcgttaacggtaaccctaccgaaaccccgttttggtccctttaacccggcccgttttaccccg

SEQ ID NO: 212779 - DNA, 781 bp, Homo sapiens
  misc_feature: GYAE6OF01DG18J.21.27.C05.1.454.CMB.1.raw
  modified_base (235)..(235): a, c, t, g, unknown or other
  misc_feature (235)..(235): n is a, c, g, or t
  modified_base (269)..(269): a, c, t, g, unknown or other
  misc_feature (269)..(269): n is a, c, g, or t
  modified_base (543)..(543): a, c, t, g, unknown or other
  misc_feature (543)..(543): n is a, c, g, or t
tcagtcgtcgctcgcacgaccggtgctcgatttagacgcgatcgaagggtttggggaggaactgctcagttaggacccagacggagccagtggaacgccccagcgcagcttctctttcctcctgcctttcgtctggcctccgagaccacccatggtagtgtattgtagacgtcgaccgctagttcctaccgaccgtccctaccgttgtcgttgttcgaccggtccgggaggggcncccgccctaccgttctccgtcgacacgcgacctntacgtcgtacttcgcgtcgtagtacggttagtccgcgttacggtaccagactaagactcgccggacctcgtccgtaccgacgttcctccttaagttccgttaccgcgacctacgaccccggaggtcccgtacttaccggtccgtacgaccgtaaccgtagggttccgtaggtcggacgggttcggttagtaggttccgggaaatttcggtttactttcccaatccgtatccggtaccgaccgtcccgtaacgtacgtacggtagttagtacgtntttacgtcgttacgtttacgtttcgtacgtacgttacgtaacgttaacgttaactttaggtaaccttcgggtaccgttcgggtaaccgtcggttacccggtaccggttacccgacggggtaaacccgtacgggtaacggtaaaccgtaacggtaaccggttaaacgggtacttacgggtacccggtcgtaacgtacccggttccgtaacgtttccgttaacccgttcttaaaccccgg

SEQ ID NO: 212780 - DNA, 740 bp, Homo sapiens
  misc_feature: GYAE6OF01DJ18F.21.27.C05.1.454.CMB.1.raw
  modified_base (163)..(163): a, c, t, g, unknown or other
  misc_feature (163)..(163): n is a, c, g, or t
  modified_base (188)..(188): a, c, t, g, unknown or other
  misc_feature (188)..(188): n is a, c, g, or t
  modified_base (239)..(239): a, c, t, g, unknown or other
  misc_feature (239)..(239): n is a, c, g, or t
  modified_base (278)..(278): a, c, t, g, unknown or other
  misc_feature (278)..(278): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcattcttcctgcccgtgcctgggccctccagtggggtntcctgtcacgagatacaaactacanctagtccgtcggtaccaggactggacgacggccctcgacacgtaccccttnacctcacctgtcgacagtcggtaccggggaaatcggtcngtacggacaactaagtggttagaagtggatagctacgccgtagaggacgtctggagtgtcgtaggaagtacctagttacgtaccgtccgtagtggtaactgaacgtactagtcgactgtagttcgtaggtgacggtaccggttcgtaccgtaccacccgtactaccccgaaccccgtacgaaacccgtaaccgtaccgaaaacgtaacgtaccggaacccgttacccttaacccctacccgaaccctttaaggttccgttaccgtacccgttaccgtaacccgtacccggtaaccgtaaccgtaccggttaactttacggtttttacttttacggacgttaaccggaaggtaccgttaagaccccgttaaacgtaccggtttaccgggtactaacccgttacccgttacccgttacgtaaccccggtccgggttaaccgggccgttaacggggtttaacccg

SEQ ID NO: 212781 - DNA, 811 bp, Homo sapiens
  misc_feature: GYAE6OF01BY0J7.21.27.C05.1.454.CMB.1.raw
  modified_base (156)..(156): a, c, t, g, unknown or other
  misc_feature (156)..(156): n is a, c, g, or t
  modified_base (205)..(205): a, c, t, g, unknown or other
  misc_feature (205)..(205): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgctactctggctcccaggctcagaaaccaccgganaaattgtgttgacgcagtctccaggcacctgtctttgctcgagggaaancgccaccctctcctgcacgctccagaccaagaactactaccagacgtacctaactacagttacgaccgtacgggttaacccaggtaccgtaacggaaacggcccgttacgggacccgtacggggtaccccttaccccggtaacgggtttcccctacgtaacgtttccgtaaacgttccggtaccggttacccgggtaaccccgaacggtaccggggacccctaacggttacggaccgtaaccgtaccccggaaagtaaccggttacggttaccgtaggtccgggaacgtcgggttcgggtacggtacggggacctaacggttaccttacctacgttaccacgttacttacgtaaacgttacggtaccgtaacggtacggtacggtaaccggtaccgttaagggtaacgtttacgttaccgacggttacgttaacgttaagtttacgtacgtaccgaacgtcgtaacgtacgttacggtaaccttccgtacgttacgtccggttaccgttaccggaaccgggtaaaggtaaccgtaagttaaacggtaaacgtacggaaaaccgttagtacggtaccgtacgtaccgaacgtaccgtcgtttaccgg

SEQ ID NO: 212782 - DNA, 746 bp, Homo sapiens
  misc_feature: GYAE6OF01CAX8N.21.27.C05.1.454.CMB.1.raw
  modified_base (120)..(120): a, c, t, g, unknown or other
  misc_feature (120)..(120): n is a, c, g, or t
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (683)..(683): a, c, t, g, unknown or other
  misc_feature (683)..(683): n is a, c, g, or t
  modified_base (736)..(736): a, c, t, g, unknown or other
  misc_feature (736)..(736): n is a, c, g, or t
tcagtcgtcgctcgcacgaccggtgctcgatttagacgcgatcgaagggtttggggaggaactgcccagttagacccagacggagccatggaagccccagcgcagcttctcttcctcctntcttctctggccttcccagaccaccacgtggagtgattggtgatcgacgctacgtcctccgacgcccacccttgttctgtcgtcgtccgggagggggcnccgccctaccctctccgtnaccacgacgcctagtctacgtctactcgactcgtacgttggtacgtccgtacggtaccacgccaagtaacttcgtcggcgtaccggcctaccgacggtccttcccgtacttacgttttaccggctcctacgtaccccaccgggacggtacccctcgggttacgtacccgtaccgtaacggtccgtagggtttaccgaggggttcgggtacgggttagggtttacggtttcgggtaaatcggtttttaacggttttcccacttacccacgttaacctccgtacccgggacccgttacccgtacgtaagggaccggttaaggtaacccgtagtttggttccgtaactttacgtttttccttagccggtatactaaactaagtaactttcgttaccgtggtacccgtgtaccgttcgtacggtacccggagaccggttacgaacgganaaacgtaccgtaagtacgtggtcgtaccacggtccaggttacttgttacgttnttccgtaccg

SEQ ID NO: 212783 - DNA, 733 bp, Homo sapiens
  misc_feature: GYAE6OF01CNT8L.21.27.C05.1.454.CMB.1.raw
  modified_base (209)..(209): a, c, t, g, unknown or other
  misc_feature (209)..(209): n is a, c, g, or t
  modified_base (436)..(436): a, c, t, g, unknown or other
  misc_feature (436)..(436): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggccctcccagtggggtcgtcctgtcacagatacaaactacagctagtcgtggtccaggcgtggngacgccctgcacgtacccttcactcacctgtcacacgtccgtacggggtaaatcgtcgcgtggacaactagtcggttaggtagttaggtagttacggaccgtacggtaccccggtacggaacggtacggtccgttaggtacggttcggtcgttacgggaacgtaccgttaacttacgtaccggtacccgtaggtacggtacgtacgaagtactagtcgacgtacgtnttacgtgtacggacggtcggttcgtctacgtacctccaccgtacccgaagaccgtaaccgtacaacggtaactccgtaccggtacccttacccgtaccttaaccgttacgttacgttccgtaccgtcctaaccccggtacccgtaccggaccgtaccgttacgtttacgtttttacggtttacgtacggtacggtaacggtacggtactaaccgtacgttacgttacggtccgttaaccgtccgtttacccgttacgtacccggttccgggacggtaaccggttacgggttaccccg

SEQ ID NO: 212784 - DNA, 828 bp, Homo sapiens
  misc_feature: GYAE6OF01C0UQY.21.27.C05.1.454.CMB.1.raw
  modified_base (154)..(154): a, c, t, g, unknown or other
  misc_feature (154)..(154): n is a, c, g, or t
  modified_base (226)..(226): a, c, t, g, unknown or other
  misc_feature (226)..(226): n is a, c, g, or t
  modified_base (539)..(539): a, c, t, g, unknown or other
  misc_feature (539)..(539): n is a, c, g, or t
tcagtcgtcgctcgcacgaccggtgctcgatttagacgcgatcgaagggtttgggggagaactgctcagttacggaccagacggagccatggaacgcccagcgcagcttctcttcctcctgtcttctctcggctcccaagaccaccacgtaggngttgattggtagatgacgcgacgttctacgagccctaccgtgtacgtcggtcgtccgtccgggaaggggacnccgacctacccttctccagaccacgacgtaccgtacgtcgacgttcctacgtcgacgtacggtacgttacggttacgtaccgttaacggttaaccagtaaccgtaaaggtaaaccgttccggaccggtaccggtaaacgggtccctaacccggaacggtttaccccttacccgttaccggtttaaaccgttttaaccggcgtaacctaccgttaccggacggtaacggacctaacggtcggtaacgtaccgtaagacgtacggttcaagggtcgggtacgttaggtaacggttagaacgtttaggtctttacnccgtaacgtactacgccgtaacgtccgacctaagacgtacggaactaagtacgttacgttcggaaccttttaggtttaccttacgggaccgtaacgtaacgtaacttaaaacgttaacggtttaacttcggtaccgggttaccctcgggttaccgtaaccggttaccgggttacgggaaaccctaaaggggtaccgtaaacgggtaaagtaaacggtaaaccgtaaaggtcgttaacggacccgtagtaaccgtacgaaaactttgtaaccggttatttacccgtaacg

SEQ ID NO: 212785 - DNA, 957 bp, Homo sapiens
  misc_feature: GYAE6OF01D4051.21.27.C05.1.454.CMB.1.raw
  modified_base (226)..(226): a, c, t, g, unknown or other
  misc_feature (226)..(226): n is a, c, g, or t
tcagtcgtcgctcgcacgaccggtgctcgatttagacgcgatcgaagggtttgggggagaactgctcagttaggacccagacggagccatggaacgccccagcgcagcttctcttcctcctgtcttctctgcctccagacacccagtggagtgtattggtagacgtgacgctacgtcctccgaacgccctacccgttgttctgtcgtccgtaccgggagggggacncccgacccctacccttctcccgtagaccacgtaccgaccgagttccgtacgtacctaagtccgtcgttacgaacggtttacgggttaccgtacccgttacggtaaccgaacggaacgtaaacgtaaacgttccggtacggaccggacggtacccgtccccgtacggtcccttacccgtactttaacggttttcccgacgtacctaaccgtaccccggaaccggtacgggtaccctacgggttaccggtaaccggtacccgaaggttaaccgtacgggttacgtaccggggtacggggtacgggtttaacgggtttacggttaaaccggggtaggtttaacgtttacccgtttactacccttaacgaaaccgtaaccgttccgacccgtacccgtacccggtaaacggtacgttaggggtaaacccttaaggtacgtttggtttaaaccgtacgtttttaacgtttttacgttaccgtaccggtaaactaacgtttaaactttaaaacgtttaacggtttaacgttaccggtccggtttaaccgggttacccggtcccggtttaaacgggttacccccgggttaccggtaaaccccggggtaaacggggtaaccgtaaaacgggttaaaacggttaaacccggtaaacccttaaagggtccgttaagggtcccgtaccgtaacccggtacccttaacccgttattttcccggttattaacccccgttaccgg

SEQ ID NO: 212786 - DNA, 724 bp, Homo sapiens
  misc_feature: GYAE6OF01DY6FL.21.27.C05.1.454.CMB.1.raw
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccagggggggancgcccacccttctccgtgcacagccagtccagtctatcgctgactggttagcctggtaccagtccaagaaatctggccaaggctccgaggctcctcacgtttaccgtgcatccacctgggccacgtggtcgtcccagtaccaggtttccagggttggaccggtggacttttcggggactagggtattttttccnccgtacacccgtaagttccaacgtccggacccccttaacgtaacggaacggttacggaaacgtaagttacgtttacggtacgtaaggttttttaaatttcccgttaggcccctaaggttaccttaaaagttaacttaaaagtttacccgttacgggtacccttgggtaccgtttacccgggtaaccgtttcccggggaaccggtaaacccgggggtaaccctaaaggggttaaccggaaaacgttaaccggttaaaaacggaaaccgttagggttaccggcgttaccggacccaacccgttaattccgttaccggttcgtttaaccc

SEQ ID NO: 212787 - DNA, 764 bp, Homo sapiens
  misc_feature: GYAE6OF01EG0B7.21.27.C05.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagtccaccctgtctgtgtctccggagggggacnccgccctaaccctctccgtgccacgacgcccgagtccgacgttcctacgtccgtcgtcgtacgttggttaacgccgtacggtaccaagtaccgaaagtaactccgtcggacccgacgggtccctaccccggtaaggtccttccgttacgttaacgttttacccgtagacctacctacccgaacccggtacgggtacccctaggttccgggttaccgtaaccccaggtaaccgttacggttacgtaacggggttgggtaccgggttaggtacggttttacggggaacttacggtttaccgttttctacctaccgaacctagtaccgacgtacccgtaaccctaagaaggttaagacgtaagtatcggttacgtagtttaacgttttctacgcgaaccttagtaacttaagtttaatacgttacgacggtcctacggttacggtaccgtacgggtaccggaaccggaaaccgggtaacgtaaagggtaacgtaaacgtaaacggtaaacgtacggttggacccgttacgcggtaccctacgtacgtttctcgttcctaccg

SEQ ID NO: 212788 - DNA, 708 bp, Homo sapiens
  misc_feature: GYAE6OF01B84AK.21.27.C05.1.454.CMB.1.raw
  modified_base (204)..(204): a, c, t, g, unknown or other
  misc_feature (204)..(204): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggggacnccgccacctctctgcacgacgccagtcagtctatcgctgtacgttggttacgccgtacggtaccagacaagtaactcgtacggaccacggtcctccgacggtccttacctacgttacgtttaccgcgacctactacccgacggtacgggccctacggttcggtaccgtacccgaaggtaccgtacggttcgagggttcgggacgggttagggttaacggtttacgggaacttaggtttacgtttttcctaccgtaccaaccgtagtaccgaccggtacccgtacccgtaacgaagtagtacggtaaagtgttgttacgtacgtttacgttttacttcgtcgacctaacgtactaaacttaacgttaacgttacgtacggttccgtcggtccggttacggtaccggtaccggaccggtaacgggtaaccgtaagggtaacgtaaacgtaacgtaaacggtacgtcggtacggtacgtacgtaccacttacttcgttcgttctacg

SEQ ID NO: 212789 - DNA, 847 bp, Homo sapiens
  misc_feature: GYAE6OF01A1G7C.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttctcatcttcctgcccgtgcgtcgggcctcccgagtggggtgtcctgtcacagatacaaactacagctagtcgtggtaccgaggactgggtcgacggccccgtcgcacgtaccctttcgacctcacctgtcgactagtccgtaaccggggaaactcggtaccgcgttcggaccaaacgtaagttcggttaggaagtttgggtaacgttagggacgtaccggttccccggtacggaggaacggttccgtttagggaacgggttcgggtacgtttacgggggaaacggtaacccgtttaagtttaaccgtaacccggttcccgaagggttaaccggtattacggaaaagtacttacgtagacgtagtacgtttacgtagggtacggtacggtaccggttcccgttcccgtacgtaacccgtaaccttccccgaacccccgtaacgaacccgttaacgttaaccgaaaaccggtttaacgtacccgtaacccgggttccgttaacccccgtacccgttaaccttaacgttcgttacccgtccgttaaccgacccgtaacccgccggtaaacccgtccggtaacgttttacgttttacgtttacggtacgtaagtaacggttacggtacgttaaccgtacgttacggttccggtaaccgttaacccgttaacccgttaccgttccctacgtttaccgggacccgggtacccgtagggggtttaaaccccg

SEQ ID NO: 212790 - DNA, 781 bp, Homo sapiens
  misc_feature: GYAE6OF01ETVX1.21.27.C05.1.454.CMB.1.raw
  modified_base (204)..(204): a, c, t, g, unknown or other
  misc_feature (204)..(204): n is a, c, g, or t
  modified_base (766)..(766): a, c, t, g, unknown or other
  misc_feature (766)..(766): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcctaccctgtctgtcgtcgtcgagggggcnccgccaccctctcctcgcacacgccagtcacgttctacgtcgcgtcgtacgttacggttcggtacccgttacggtaaccacggaccgaagtaaacgtcctacggaccccacggccccgtccccgaggtccctccgttaccgtaccgttttacccggcgcctaacctccccgtaccggacgggtccctaccgttcgggtaccgtacccgaaggacgttagggttaccgagggggtgggtccgggttaggggtacgtttacggggaaacgtacggggtttttactttacccggttccgtaaccgtaaacccttaacgtccccggtaacgcccccgttaacccgtaaacggccggttaaaggggtaacgtaagtaagttccggtttgtaacggttttaagttttcgtccggtacgtacctaaggttaaccaaagtttaactaaccgttacggttcgaccggttctacccgggtttcaccgggtttacgaaccccgggaagggttaaccggaaggtaacgtaaacggtaaacccgtagtcggtacggtcgcgtaaccgactacctnttacgtcttcgtacc

SEQ ID NO: 212791 - DNA, 883 bp, Homo sapiens
  misc_feature: GYAE6OF01ETEOX.21.27.C05.1.454.CMB.1.raw
  modified_base (291)..(291): a, c, t, g, unknown or other
  misc_feature (291)..(291): n is a, c, g, or t
  modified_base (376)..(376): a, c, t, g, unknown or other
  misc_feature (376)..(376): n is a, c, g, or t
  modified_base (604)..(604): a, c, t, g, unknown or other
  misc_feature (604)..(604): n is a, c, g, or t
tcagtcgtcgctcgcacgaccggtgctcgatttagacgcgatcgaaggggtttgggggaggaactgctcagttaggacccagacggagccatggaacgccccagcgcagcttctcttcctctgtcttctctggcctccgagaccaccacgtggagttgtagttgtgagtacgacgcgtagtcctaccgacgtccctaccgttgtcttggtcgtccggtacgggaggggcctcccgtccctacccttcgtaccgtcggaacctacgacgtccgtaacgtacgtacgtctacncgttcgtacggtacgtttacggtaccgtccggttaacgtaccgaagacgtaaacgtacgttcggaacggaccggtaccggtaccnccggtaacggttacccctcgtttaaccgtttaacgttccgtacgtacccgtacccgtaccggaacgggtacgtccccggtttaaacggtccggttaccgaaacccggtaggtttaaccggtacgggttacgggttacccgggggttaggggtttaaaccggttcgggggttttaacgggtttaaaccgaacggggtttttttaaccgttttcccggtttttaaacccncccggttaaaccgtaaccggtttaccgacccggtaccgttacccggtacccgtaaggtacggtaacgttaaggtacgttagttcggttacgtttacgttacgttttacgaccgttacgtaacgtacttaacgttaacgttaattccggttaacgtccgtacgttaccgttaccggacgttacggtacggtaaccgtaacggtacgtaaaccgtaagaaccgttaacgtaaggtcgttacggtagcctacgtacgtcgttacgtcttcaacggtttaccc

SEQ ID NO: 212792 - DNA, 778 bp, Homo sapiens
  misc_feature: GYAE6OF01DIBS8.21.27.C05.1.454.CMB.1.raw
  modified_base (453)..(453): a, c, t, g, unknown or other
  misc_feature (453)..(453): n is a, c, g, or t
  modified_base (510)..(510): a, c, t, g, unknown or other
  misc_feature (510)..(510): n is a, c, g, or t
  modified_base (584)..(584): a, c, t, g, unknown or other
  misc_feature (584)..(584): n is a, c, g, or t
tcagtcgtcgctcgcacgaccggtgctcgatttagacgcgatcgaagggtttgggggcagagcctgctgacttctggctgaccgagggcagtcaccggagctccagacaatgtctgtctcctctcatctcctgccgtgcgtggcctcctagtggggtgtcctgtcacagactacaaactacgagcagttcgtcggtacgaggtacgtggtcgacggccctcgcacgtcccttacacctcaccgtgtacgactacgtaccggtacggggaaatcggtcgacgtcggaactaacgtaagttggtaaggtaagttaggacgttacggccgtaccggttccccggtagaggtacggtccgttggacggtcggtacgtagggaacggttacttagtaccgtaccggtcgaggttacgtaagtacgtaagtacgtaacgtcgacgtaagttcgttacgngggttacgaccggtcgttaccgttacgtaccaaccgttacgtacccgtaaccccggntaaacccgtaccgttaaacaaacgttacttacccggtccgttaccccttaccccgtaacctacgttacgttacncccttaacggttacccaaacccccgttccgggtaaaccggtaaccgttaggggtttaacctttttacggttttttaaacgtttcgggacgttaaacggtaaacggaccggttactacggtaaacgttaccgttacggtaccgttacccttcgtaccgttacgttcgacccgggtagggccgttaaggttacccg

SEQ ID NO: 212793 - DNA, 775 bp, Homo sapiens
  misc_feature: GYAE6OF01EFCCF.21.27.C05.1.454.CMB.1.raw
  modified_base (158)..(158): a, c, t, g, unknown or other
  misc_feature (158)..(158): n is a, c, g, or t
  modified_base (550)..(550): a, c, t, g, unknown or other
  misc_feature (550)..(550): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttctcatcttcctgccgtgctggcctccagtcggggtntcctgtcacagactacaaactacagcgtagtctcggtacgaggtacgtgggtacgacggcccgtcgccaacgttacccctttcaccttccaccgtgtacgactacgtaccgggtaaaccgggtaaattcgtacgcgtacggaccaaacttaaggttggggttagtaaacgttgggtaacgttggacccgttaccgggtaccccggtacggtagggtaccggtcgttgggtacgtggacgtttacgggaacgtacttaagttcgtaaccgtcgaggttagtaacgtagtaacgtacttgagacgtaacgttgtcgttaggacggtacggtaccggttcgttacctaccaaccgtaactaccccgaccccgaagtaccacggtaacaacgttanacccgttccgtacccttaccgtaacccgtactttacgttcgttacccttacgtacccgtacccgtaaccggaaccgtacccgtagtttaccgttttagtttttacgttagtacggaacggtaaggtaaccgggttacttacgtaacgtttacggtccggttaacgtccctttacccgttacgttcgtaccggttcccggtaggggttacctaagggtttacccgg

SEQ ID NO: 212794 - DNA, 893 bp, Homo sapiens
  misc_feature: GYAE6OF01EQL3M.21.27.C05.1.454.CMB.1.raw
tcagtcgtcgctcgcacgaccggtgctcgatttagacgcgatcgaagggtttgggggagaactgctcagttaggaccagacggagccatgggaagccccagcgcagcttctcttcctcctgtcttctctcggcctccacgacaccacgtggagtgtattgtgatggacgctagtcctccgacgtccctacccgttggtcgttaggtcgtaccgtcggggaacgggggacgcccgtaccctaccccgttccgttaccgtacgtaccaacctaccggtaccctaaggttcctacggttaccttaacggtccggtaccgtttaccggggtaacgttttccggggtttaaccgtcccgggtttaacggaaaccgtaacggaaccgtaaaaccggtaacggttcccggtacgggaacccgtaccggtccttaccccgggtacgttaccccgtttccctaacggtttaccgttaccgcgtacccggtaacctaacccgggaccggtacggtcctaacggttccggtaaccgtaccgtaaggtaaccgttcgggtaacggtgggtacggggtacggttagggttacgttagggaacctttcgggttttaaccttccgtaaccgaccgttaacgtcgtaccgtaccgtaccccgtaaccgtaagtaggttaacgttaagtacggttaacgttcgggtttaaccttacgtttttaacgtcggtttccgacgttaacctaagttaaccttaagttaacttagttaccggtcggtaccgttaccgtacggttaccggtaccggtaccggtaacgggaaccggtaaggttacggaacgttaaccgtaaacgaaggttcgtagtccgaaccgtcgtaacctcggttaatttccgacgttctaccgg

SEQ ID NO: 212795 - DNA, 758 bp, Homo sapiens
  misc_feature: GYAE6OF01E2N1L.21.27.C05.1.454.CMB.1.raw
  modified_base (134)..(134): a, c, t, g, unknown or other
  misc_feature (134)..(134): n is a, c, g, or t
  modified_base (220)..(220): a, c, t, g, unknown or other
  misc_feature (220)..(220): n is a, c, g, or t
  modified_base (322)..(322): a, c, t, g, unknown or other
  misc_feature (322)..(322): n is a, c, g, or t
  modified_base (414)..(414): a, c, t, g, unknown or other
  misc_feature (414)..(414): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttccngccgtgctggcctccagtgggtctctgtcacagactacaaactacagctagtcgtcggtaccgagggtcttgggcgaccggtcccncgtcctaaccgttacccttcacctcaccgtgtacgactaccgtaccggtacggaatcgtcgcgtagacagtagttggtagtagtcgagtcgactccgtccgnggactcggccttaggacggtggtacgtacggtaactaccgttacgttaagtcccgtcctagggttcggtaattcggaaacgtacgttacggngtacgtaagttccgtttggtaggggtgtaacccggtcgggtactttacccgaccgtaaccgtaccctaaccccggttaacccgaaacggtcccttaaccgaaacccgggtaatacgtacccggttcctacccgttacctacccgtaacgtaagtccctaccggtccgtaacccgacccttaaccggacgtacccgtaggttcgtttaagttttcggttagacggtacccgtaggtacccgttaatccgtacccggttagttaccccttagggtaacccctttccggttaaactcccgggtacccgttaagggtacccggggttaccgttcggggtttaaacccg

SEQ ID NO: 212796 - DNA, 954 bp, Homo sapiens
  misc_feature: GYAE6OF01AI1RS.21.27.C05.1.454.CMB.1.raw
  modified_base (156)..(156): a, c, t, g, unknown or other
  misc_feature (156)..(156): n is a, c, g, or t
  modified_base (202)..(202): a, c, t, g, unknown or other
  misc_feature (202)..(202): n is a, c, g, or t
  modified_base (333)..(333): a, c, t, g, unknown or other
  misc_feature (333)..(333): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgngatgacgcagtctccagccacctgtctgtgtcgtccgagggggacnccgcccacccgttctcctcgaccacacggcctagtacacgtcctagtcgctagacgttggttacgccgtggtaaccgagacgagaaactcgacggacacggcctccgacggtcctacctctactttaccgncactccaccgtacggccacgttcggtccgtacccaggactacggttcgaggttcgggaccggtttaggtacggtttacgggaacgttaacgggtttacgttttttacccgtacccggttactaacccgtacgttaccgtaaccgggtacccgttaacccccgtaagtaaacgggtacggttaaacggtaaaacggtttgtttacgggttttacgtaccggttttaaacgtttttttaccgtttaccgtaccgtacccgtaaacggtttaacgttaaaacttttaaaccggtttaaaaccgtttaaccgggtttacccgggttaacccgtttacccgggttaacccgggtttacccggggttaaaccccgggttttaccccggggaaaccccggggttaaaacccgggggttaaccccggttaaaaaacggggggtttaaaacccgggttaaaaaccccggtttttaaaaccggggaaaaaaaccccgggtttaaccggggtttaacccgggttaacccggggtttaaacccggtttacccggttaaacccccgttaaacccggtttaacccggttttaaacccgttttcccgggtttttaaccggtttttaaaccccccgg

SEQ ID NO: 212797 - DNA, 814 bp, Homo sapiens
  misc_feature: GYAE6OF01DHB1L.21.27.C05.1.454.CMB.1.raw
  modified_base (240)..(240): a, c, t, g, unknown or other
  misc_feature (240)..(240): n is a, c, g, or t
tcagtcgtcgctcgcacgaccggtgctcgatttagacgcgatcgaaggggtttgggggaggaactgctcagttaggacccagacggagccatggaagccccagccgcagcttctcttccctcctgcttctctggcctcccagaccaccacgtgggagtgtagttgtagtatggacgctacgttcctaccgacgtccctacccgttgtcgttggttcgtccgtccggggaaggggggaccncccgccctacccgtccgtaccgtcggaccaaccgacgcccgtacggtacctacgttaccgtagtccgtacgtacgtacggttacgggttaccgccggttacgggtaacccagtaaccgaagttaaccgtccggtacgggacccctaacgggtccctacccggtccggtaccctttacccttacgttaccgttttaccggacgaccttaccgccccggtaacggccggtacctagggttccgtaccgaacccaaggtccgttacgggtacgacgggttcggggaacggttaggttaaggtttcgggaacctttaggtttacctttcccgaccgtacgtaaccgacgtccgtaaccgccccttaacccgtaagacggtaacggtaagaagttgttacgttcggttaacgtttagttttccgttaccggcaacgtacgtaattaactttaacgttcttaacggtccgtccggtagccgtttaccggtcggtacccggaggtaaccgaacggttaggaactaaccggtaagaacgtgcggtactacgtacaccgtacctagttacttcgttcgtaccg

SEQ ID NO: 212798 - DNA, 728 bp, Homo sapiens
  misc_feature: GYAE6OF01DOG3P.21.27.C05.1.454.CMB.1.raw
  modified_base (210)..(210): a, c, t, g, unknown or other
  misc_feature (210)..(210): n is a, c, g, or t
  modified_base (431)..(431): a, c, t, g, unknown or other
  misc_feature (431)..(431): n is a, c, g, or t
  modified_base (658)..(658): a, c, t, g, unknown or other
  misc_feature (658)..(658): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgctagtctaccagccacccgtgtctgtcgtcctccggagggggacnccgacccacccgttcctacgtgacctacgacgccagtccgtacgttctacgtcgcgtagtcgtaggttacgtccgtacggtaaccagacgtaaacgtaaacgttccgtacggaccgtacggtcccgtcccgaggtccctccgtacttaacgtttccgtcgacctaccgtacccgacggacggtaccctaggttcgtaccgaccgtagacgtcggttacggnggtaggtcgggtaggttacgttacggggtacttaggtttacctttcgacgtacctaaccgtagtccacgtccctaccgttaacggacggttagtacgtaacgtagttacgtcgttagtttacgtttacgttcgacgtacctaagtagtaacttagtaaccttgtaccggtctccggtaacgtccgtaaccggttcggaacccggtaaccggtaggaaaccgggttanaaacggtaaacctaaggtacgtcggtaccgtctaacggaccttaacggttctccttagttccttaacccg

SEQ ID NO: 212799 - DNA, 740 bp, Homo sapiens
  misc_feature: GYAE6OF01BZBDL.21.27.C05.1.454.CMB.1.raw
  modified_base (128)..(128): a, c, t, g, unknown or other
  misc_feature (128)..(128): n is a, c, g, or t
  modified_base (211)..(211): a, c, t, g, unknown or other
  misc_feature (211)..(211): n is a, c, g, or t
tcagtcgtcgctcgcacgaccggtgctcgatttagacgcgatcgaagggtttgggggaggaactgctcagttaggacccagacggagccatggaaagccccagcgcagcttctcttcctcctgcttcnctggcctcccagacaccagtggagtgattgtagatgacgtcagtctccagccaccgtgtctgtcgtctaccgaggggggtacnccgacccgaacccgttctccgtcgccgaacacggaccaaggtcacggtcctaagtccgacgttgtacgtagggtttacgccgttacggtaaccagaccgtaaaggtaaacgtcgtcgggtaccaacgggtcctacccgaacggtcctaccgtaccttaacggttaccgcgtaccacgttccgaacgtacgggaccacggtcggtaccgaccgaaggaccgtaggtacctagggtacgggtacggttaggtacgtttacggggaactaggttactttcgacgtacgaaccctagtaccgacgtaccgaccttaacgaaggtaacgttaggtaagtacgttacgttagtaccgttagttttacgttacgtcgaacctaacgtaactaaattaaacgttaacgtttacgaggtaccgtaacgcggttaacgtacggttaccgaaccggtaacgggtaactaaacggggtaagtaaacgaaccgtaaacgaaccggtggttacgacgttacactactagtctaacgtcttacg

SEQ ID NO: 212800 - DNA, 1073 bp, Homo sapiens
  misc_feature: GYAE6OF01B53N5.21.27.C05.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggatgattgtgatgacgcagtctccacgccctaccctgtctgtcgtcgtccgagggggacnccgcccacccgtctccgtgccaacgacgcctagtcacgttctacgtcgcgtgtacgttggtacgtccgtacggtaccagacgaacgaacgttccgtacggacccgacggtccctccccgaggtccccttccgtacttaaccgttttaccggcgtaccgttaacctcccgaacccgtacgggtaccctaaccgggtttcggtaccgtaacccaacggtaacgtaccggtttacggaacggggttcggggtaccgggttagggtttaacgggtttaccgggtaacgtttaacgggttttaccgtttttacccgtaaccgttaccccgtaaaccgttacgttacccggtaacggtcccccggttaaaccccgttaaacggaacgggttaaacggtttaaccgggtaaaaacgggttttacgtttaccgggtttaacgtttaaccgttttttaaacgggtttttttaaaccctttcccggtaaacccggtaacccgtttaaacgggttaaaaccgtttaaaaacttttaacgggtttttaaaaaccccttttccgggggttaacccgggttttaccccgggtttaaaccccgggggttacccgggtttttaacccccgggttaacccgggggtttacccccgggaaacccccggggttaaaaccgggggtaaaaaccgggttaaaccggggtttaaaaaacccggtaaaacccggtttaaaaacccggggttaaaaaccccggttaaacggggttttccggggtaaccccgggtaacccgtttaaccccggtaaaaccccggttaaccccggtttttaaaacttttccccgggggtttaaacccgtttaccccgttttaaaccccccgggg

SEQ ID NO: 212801 - DNA, 1045 bp, Homo sapiens
  misc_feature: GYAE6OF01D06UZ.21.27.C05.1.454.CMB.1.raw
  modified_base (99)..(99): a, c, t, g, unknown or other
  misc_feature (99)..(99): n is a, c, g, or t
  modified_base (159)..(159): a, c, t, g, unknown or other
  misc_feature (159)..(159): n is a, c, g, or t
tcagtcgtcgctcgcacgaccggtgctcgatttagacgcgatcgaagggtttgggggcagagcctgctgacttctggctgaccagggcagtcaccgganctccagacaatgtctgtctccttcctcatcttcctgccgtgctcggcctccagtggggtntcctgtcacagatacaaactacagcagtctggtccagacgtggtcgacggcctcgcacgtcccttcactccactgcactacgtccgtaccgggtaaatcgtcgcgtcggaccaaacgtagttcgggttaggtaagttaggtaagttacggaccgtaccggttacccccggtacggtacgggacggttaccgttagggtacgggttacgggtaccgggtttacgggtaaacggtaacccgtttaaacgttttaacggttaaccccggttaccccggttaagggttacggggtttaacgttaacgggtaaacggttaaacgttaacgtacgggtaacggttaacggtttaaccgtttacgggttacgggttaccgggttaacgggtttccccgggtttccgtttacccgtacccgtaaccccgttaacctaaaccccccggttaaacccccgaaccggtaaaccccggttaacccggtaaacccggtaaaacgggtaacccgtttaacccggttaccccgggtttaccccgtttaacccccccgtaaacccggttttaaccccctttaaaacggtttccccgggtttacccgttaacccggtttaccccgtaaaccccgttaacccccgggtaaaccccgggttaacccggtaacccggggttttaacccgtttttaaggtttttttaacgtttttaccgggtaacccggtttaaacgggggtaaaccgggttaaccgggtaatttaaccccggttaaccggttacggtttacccggggttaaccgttaaccccttttaaccccggttacccggttttacccggttaccccggttaccgggggtttaaccgggttacccgggggttaaaccgggttttaaccccgggg

SEQ ID NO: 212802 - DNA, 958 bp, Homo sapiens
  misc_feature: GYAE6OF01BVYUN.21.27.C05.1.454.CMB.1.raw
  modified_base (123)..(123): a, c, t, g, unknown or other
  misc_feature (123)..(123): n is a, c, g, or t
  modified_base (132)..(132): a, c, t, g, unknown or other
  misc_feature (132)..(132): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctcctcncatcttccngccgtgcgtcggcctccgagtggggtctcctgtacacgagactacaaactacagctagtcgtcgggtaccgagggtacgtgggtacgaccggtccctcgactaccgtacccctttacacctcgaccgtgtacgacctacgtaccgggtaacggggtaaacgtcggtacgtcgtacggaactaaagtaaggttgggttaggtaaggttacgggtaacgtttacgggaccggtaccggtaccccgggtacggtaaggtaccggtaccgtttagggtagggttacgggtcggtttaaacggggtaaaccggttaaccgttaacgttttaaccggtaacccgttacccggtaaggtttaaccgggttaagtaaacggtaaacgttaacccgtaagttacggtaaccgtaaggttacgtttacggttacggtcgggttaaccgggttaccgggtttcccgttaccgtaaccgtaaccccgtaaccgtaccccggtaaaccccgtaacggaaaccccgttaaccggtaaaccgtaaaacgtaccggttaccgtacccggttaccccttaaccccgtaccctaaacgttaacgtcgtttacctaccgttaaccccgacccggtaacccggtaacccgaccggttaaacgttacccgttttaaggttttacgtttaccggtaacgggtacggtaaacgggtacggttaccctaacgggttaaccttaccggggttaccgtttaaaccggtaccccgtttacccgtttacggtaacccgtttaccgggtaccccgggtttacgggggtaaccggtttacgggtttaaaccccggg

SEQ ID NO: 212803 - DNA, 898 bp, Homo sapiens
  misc_feature: GYAE6OF01C5XCZ.21.27.C05.1.454.CMB.1.raw
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtcgtcctccggaggggganccgccaccctctccngaccacngccagtcacgtctancgcngtactggtacnccgtacgtaccgagacaagtaactcgtcggacctacggtccctcccgacggtcccttaccctacgtaccgtttaccgcgaccgtacctacccgaaccggtacgggtccctaacggttcgggttacccgtacccgtaggtaaccggttacggtttacggtaacggggttccgggggagggtttacggggttaacgggttttacgggggaaccgtttacggggttttaacccgggttttttttcccacccggtttaaccgtaaacccgttaccgttacccgggtaaacccggttacccccggtaccccgttaaaccggttaagggaaccggggttaaccggtaaaggttacggttttaccggggttaccggtttacgttttaaacgggttttttaccgttttcccggaaccggtttaaccctaacgtttaaacgttaaacgttttaaccgtttaaacgtttaaccgggttcccggttccgttaccggtacccgggtttacccggtaaccccggggtttacccgggaacccgggtaaacccggggtaaacccgtaaaggggttacgttaaaaccgtaacggtaaacggtaccgttacggggacgttcgaccgtacccgacttaccggttctcccgtttctaccg

SEQ ID NO: 212804 - DNA, 976 bp, Homo sapiens
  misc_feature: GYAE6OF01E44JB.21.27.C05.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctcggcctcccagacaccactggagtcgattgtgactaggaccgctagttcctaccacgcccaccctgtcctcgtcgtccgtccggaggggggacnccgcccctaccctcctccgtgccaccgacgaccctcgtacgacgtcctagtccgcgttacgtacgttacgggttaccgccgttacggtaaccacgtaccgaacgtaacgttcggtaccggtaccgaccggtcccgtaccccgtaccgggtcccttcccgttaccgttaaccgtttttaacccgccgtaccgttaccgtaccccgtaacccggtaccgggtaccctaaccggttacgggttaccccgtaccccggtaaacgggtaccggtttaacgggttaccggtacgggggttccgggggttacggggtttacgggtttacgggtttttaaccggggaactttaacgggttttaacccgtttttcctaacccgttaccgtaacccctaaggttaccccggacccggtacccccgtaacccgtaaccgtaacgggttaaaccgttacgggttaaacggtttacgtttcgggttaacgttacgggttttaacgtttttaccgttaccggttaccgtaacccggtacgttaaaccgttaaaacgttaacgtttaacggttacccggtaaccggttaccggttaccggttacccggttacccggttaccgggtacccggtaacccggggttaaaccgggttaaccggttaaaccgggtaaaccgtaaaccggttacccgggtaaaacggttcggttcgggtaccgtaccgtccgtaaccgtacccgtacgtttcccgttaccgttcgttaaccccg

SEQ ID NO: 212805 - DNA, 762 bp, Homo sapiens
  misc_feature: GYAE6OF01DQDD6.21.27.C05.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgcgatcgaagggtttgggggaggaactgctcagttaggacccagacggagccatggaacgccccagcgcagcttctcttcctcctgcttctctggcctccagaccaccacgtggagtgattgtgatgacgctagtcctccagccctacctgtctgtcgtcctccggaggggacnccgcccaccttcgtcctgaccacgacgccagtcagtctatcgtacgtgtacgttgttacgccgttacggaccagaacgaagtaacgtcgacggcccgtacggtcccgtacccgtacggtcccttaccgttacgttacgttttaccgctacccgacctaccgacggtacggtcctacggtacggtccaccgtaagtaccgttcggtaccggaggttcgggtacggtaggtttacggtaggtaaccgttagttttaccgttttaccactaaccgtaacctacgttccgtaacctcccggtaactaacggtaggtaccgtaagtaggttacgttgttaaccggtactttacggttttactacggtaccgtacgttaacttaacgtaaacgttttacgttaaacgttccgggttacctacgggttaccgtacgggttaaccgtacgggtaccggaacggtaaccgggtaagtaaacggggtaacaaacgttaaccggaagtttaccgtggtccgtactacgtacccgtaaggttcttccgttgtacccttaccgg

SEQ ID NO: 212806 - DNA, 738 bp, Homo sapiens
  misc_feature: GYAE6OF01ES6QH.21.27.C05.1.454.CMB.1.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
  modified_base (336)..(336): a, c, t, g, unknown or other
  misc_feature (336)..(336): n is a, c, g, or t
  modified_base (434)..(434): a, c, t, g, unknown or other
  misc_feature (434)..(434): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagaccaccactgggagtgattgtgactggacgcagtctccagcccacctgtctgtcgtcnccggagggggnccgccncctctctgcacncgccagtcacgtctactcgtcgtagacgtggttacnccgtacggtaccagacaagtaatccgtaggaccaggccctaccgacgtcctccgtacttacgtttcgcgtaccnctacccgacggacggcctacgtcggtaccgtacccagtacgtacggtcgacgggttcgggtacggttggttacgttaggacgttagtttcgttttccnctacacgtagccgtacgtaccctacccgtaagaggtacgtaagtaagtcgttggttacggttattaacgtttttacttcgtcggtaaccgtagttaaccttaattaacgtttaacgttccgttaccgggtccgttacggttacccgggtttacggtacccgggtttaccgggaaccggttaaacccggggtaacggttaaaacgggttaaaccgaaccgggttaaaccgaacgggttaacggttcgggtaccgttaacgtaccggtaccgtaccgttattccccggtttctaccggtttacccc

SEQ ID NO: 212807 - DNA, 833 bp, Homo sapiens
  misc_feature: GYAE6OF01B6W43.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttctgcccgtgctcgggcctccagtggggtctcctgtcacagactacaaactacgagctagtctggtccaggactggtgacgcctgacacgtaccctttcacgtccaccgttgtacgactacgtaccggtaaccggggtaaaattcgtacgcgtacggaccaacgtagttggttaggtaacgttaggtaacgttacggaccgtaccggttaccccggtacggtacggtacggtaccgtttaggtacggtacgggtacggttacgggaaacgttacccttaagtttaccgtacccgttacccggtaaggttacggtaacgttaacggtaaacgttaacgttacggtacgtacgttaaacggttacgtttcggttagggtacggtacgggttaccgggtttcccgttaccgtacccgtaacccgtaacctaaccccctaacccggtaacgtaaaccctaccggtaaccgtaaacggtaccctaccggtaaccggtttcccctacccccgttaacgtaaccgttaacgttcggtacccttaccggtaaccgtacccgttacccggaacggtaccgtacggttacttttagttttacgtttacgtaacggaccgtaaggaccgtactacgtacgttacggttacgtacctaccgttccgttaccgttaccgacggtacccgggttaccgggacgttagggttaccccg

SEQ ID NO: 212808 - DNA, 717 bp, Homo sapiens
  misc_feature: GYAE6OF01ARD71.21.27.C05.1.454.CMB.1.raw
  modified_base (207)..(207): a, c, t, g, unknown or other
  misc_feature (207)..(207): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtcgattgtgatgacgtcagtcctcagccaccatgtctgtcgtctaccggagggggancccgaccctaccctctcgtgccacacgtccagtcagttcctancggntagtacgtggtacggccgtcggtaccagacaagaactcgtacggccgaacggccctacccgacgtcctcctctaacgttcgacgtcacctacccgaccggcggtaccctacggtcggtacctaccgaacgtacggtaacgttcgaaggtcgggtcggtgggttacgtttagggacctaggttacttttcgtaccctacgaacctcgttacgaccgacccgttacccaagtacgggtagtaagggtaacgtcgtttcggttaacgtacgtttaacgttttcgtttaccgaccgtacgacggttagaaacttttccgttaaacttccggtaccgggttcgtaccggttcggtacggttacggtccggtaaacggacccgggtaaactacgggtaaacgaacgtaaacgaaaccgttaggtccggtacggtactaccgggtacctagtactttccttacgtacccg

SEQ ID NO: 212809 - DNA, 501 bp, Homo sapiens
  misc_feature: GYAE6OF02IXGT7.21.27.C05.1.454.CMB.1.raw
  modified_base (202)..(202): a, c, t, g, unknown or other
  misc_feature (202)..(202): n is a, c, g, or t
  modified_base (366)..(366): a, c, t, g, unknown or other
  misc_feature (366)..(366): n is a, c, g, or t
  modified_base (384)..(384): a, c, t, g, unknown or other
  misc_feature (384)..(384): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagtagttttcnctcaccatcagcgcctanagagtgaagatgttgctagtttattctgccagcaattataattactggcctgcgttcgacgttcggcaacgggaccaggtggaaactcgaaacgatgtgctgcaccatctgtcttac

SEQ ID NO: 212810 - DNA, 503 bp, Homo sapiens
  misc_feature: GYAE6OF02IT5BT.21.27.C05.1.454.CMB.1.raw
  modified_base (201)..(201): a, c, t, g, unknown or other
  misc_feature (201)..(201): n is a, c, g, or t
  modified_base (370)..(370): a, c, t, g, unknown or other
  misc_feature (370)..(370): n is a, c, g, or t
  modified_base (485)..(485): a, c, t, g, unknown or other
  misc_feature (485)..(485): n is a, c, g, or t
tcagtcgtcgctcgcacgaccggtgctcgatttagacgcgatcgaagggtttggggaggaactgctcagttaggacccagacggagccatggaagccccagcgcagcttctcttccctcctgcttctctggctccagacaccactggagtgattgtgatgacgcagtctccagccaccctgtctgtgtctccgagggggancgccaccctctcctgcacagccagtcagtctatcgctgactggttagcctggtaccagcaagaaatctggccaggcctcccaggcctcctctatttaccgtgcactccaccgagggccactggtcgtcccagacaggttcagtggcggtgatttgggacagtagtttcntcacatcagccgccctacagagtgaagatgttgctagtttattctgccagctaatataattactggtcctgcgtcgacgttcggacaacgggaccaggtgaaatcaaacgactgngctgcaccgatctgtctc

SEQ ID NO: 212811 - DNA, 748 bp, Homo sapiens
  misc_feature: GYAE6OF02IXD4O.21.27.C05.1.454.CMB.1.raw
  modified_base (360)..(360): a, c, t, g, unknown or other
  misc_feature (360)..(360): n is a, c, g, or t
tcagtcgtcgctcgcacgaccggtgctcgatttagacgcgatcgaaggtttgggggtagggaactcgctcagttacggacccagacgggagccatgggaagtcccccaagttccgcacgccttcctcttccctccttggcttacctcctggccttcccacgaccacccacgtggagttgacttaggtgatgacgccaggtctccagccaccgtgtctgtgtcgtccgaggggagcgccaaccctctccgtgcacagaccagtccacgtctaagttcgcgtagacctggttactccgtcggtaccagcgaagaaactctgggccaggcctacccgaggccgtcccgtacgactttaccggngcgattccgaacagggccctacgttggtcgtccccagacctaggttcagttcggacggtggtaagtttcgggacctagtacgttttacgtccgtacgtaccctaattccaacgtcccgtaccctaacgacggacgtagaacgtattcggttacggaccttaacgttttactttcgtcgtaccgtaggaccgtaaattaacttaaacgtttaaccgtcggtacccgttacggtacccgttccgttaaaccggttttccggaacccgttaaccggggaacccgtaagggttaacggtaaaacgttacccggtaaaacggtaaccgtacggttacgggtaccgttacggtaccgtaaccgtaagtttcccgtttaggtttccgtttaaccg

SEQ ID NO: 212812 - DNA, 516 bp, Homo sapiens
  misc_feature: GYAE6OF02IUWKQ.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (370)..(370): a, c, t, g, unknown or other
  misc_feature (370)..(370): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatccaccagggcccactggtcgtcccagacaggttcaggtggcggtggatttgggactagtagttttcnctcaccatcagcgccctacagagtgaagatgttgctagtttatttctgccagcaaattataattactggcctgcgtcgtacgttcggccgacgggaccaggtcggaactcgaaacgactgtaggctcgacacctatcgtgtcttac

SEQ ID NO: 212813 - DNA, 515 bp, Homo sapiens
  misc_feature: GYAE6OF02INKB8.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatcccaccagggcccacgtggtgtcccagacaggttcaggtggcggtggatttgggacagtagttttcnctcaccatcagccgccctanagagtgaagatgttgctagttttattctgcctagctaaatataattactggcctgcgtcgtacgttcggaccgagggaccaggtgaaactcgaaaacgactggtagactgaccaccatctgtctc

SEQ ID NO: 212814 - DNA, 494 bp, Homo sapiens
  misc_feature: GYAE6OF02IPOMY.21.27.C05.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (365)..(365): a, c, t, g, unknown or other
  misc_feature (365)..(365): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccagggggancgccaccctctcctgcacagccagtcagtctatcgctgactggttagcctggtaccagcagaaatctggccaggctcccaggctcctcatttaccgngcatccaccagggccactggtgtcccagacaggttcagtggcggtggatttgggacagtagttttcnctcaccatcagccgccctacagagtgaagatgttgctagtttattctgccagcaatataattactgcctgcgtcgacgttcggccacgggaccaggtgaatcgaaacgactgtgctgcacatctgtctc

SEQ ID NO: 212815 - DNA, 498 bp, Homo sapiens
  misc_feature: GYAE6OF02F8KP9.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatccaccagggccactggtgtcccagacaggttcagtggcggtggatttgggacagtagttttcnctcaccatcagcgccctacngagtgaagatgttgctagttttattctgccagcaatataattactggcctgcgtcgacgttcggcaacgggaccaggtggaatcaaacgactgtggctgcaccatctgtctc

SEQ ID NO: 212816 - DNA, 522 bp, Homo sapiens
  misc_feature: GYAE6OF02H2S62.21.27.C05.1.454.CMB.1.raw
  modified_base (201)..(201): a, c, t, g, unknown or other
  misc_feature (201)..(201): n is a, c, g, or t
  modified_base (372)..(372): a, c, t, g, unknown or other
  misc_feature (372)..(372): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggcctcctcatttaccgtgcatccaccagggccactggtctcccagacaggttcaggtgggcggtggagtttggggactaggtagttttcnctcaccatcagccgccctacagagtagaagatgttgcttagtttatttctgtccagcaatataattactgcctgcgtcgacgttcgacgaacgggaccaggtacgaatacgaaacgtacgtagtacggactcgacaccatctcgttctac

SEQ ID NO: 212817 - DNA, 503 bp, Homo sapiens
  misc_feature: GYAE6OF02GO8OS.21.27.C05.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (320)..(320): a, c, t, g, unknown or other
  misc_feature (320)..(320): n is a, c, g, or t
  modified_base (365)..(365): a, c, t, g, unknown or other
  misc_feature (365)..(365): n is a, c, g, or t
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatccaccagggccactggtntcccagacaggttcagtggcggtggatttgggacagtagttttcnctcaccatccaccagactggagcctagaagtatttgctagtgttattactgtcagcagtatggtagctcacctccatgtactactttgccgtagggaccagggtgaatacaaacgtactgtaggctgacactatctcg

SEQ ID NO: 212818 - DNA, 500 bp, Homo sapiens
  misc_feature: GYAE6OF02J04DE.21.27.C05.1.454.CMB.1.raw
  modified_base (205)..(205): a, c, t, g, unknown or other
  misc_feature (205)..(205): n is a, c, g, or t
  modified_base (414)..(414): a, c, t, g, unknown or other
  misc_feature (414)..(414): n is a, c, g, or t
tcagtcgtcgctcgcacgaccggtgctcgatttagacgcgatcgaagggtttggggagggaactgctcagttaggacccagacggagccatggaagccccagcgcagcttcgtcttcctcctgcttctcctggctcccagacaccactggagtgattgtgatgacgcagtctccagccaccctgtctctgtctccaggggaaagngttactctctcctgcaaggccagtcagagtgttggcatcgacgttgcctggtaccaacaaaaacctggccaggctcccagtctcctcatctatgggcatcctacaggatgaccggcagtcccagacaggttcagtgccagtgggtctgggacagacttcgactctcaccatcaacacactggcgcctgaacgatttgcagtgtattacngtcagtatgtatgtaggtcaccgtacacctttggctagggaccaagggtggagatcgagacgaatgtgctgcgacatctgtcttac

SEQ ID NO: 212819 - DNA, 594 bp, Homo sapiens
  misc_feature: GYAE6OF02JDR6Q.21.27.C05.1.454.CMB.1.raw
  modified_base (249)..(249): a, c, t, g, unknown or other
  misc_feature (249)..(249): n is a, c, g, or t
  modified_base (307)..(307): a, c, t, g, unknown or other
  misc_feature (307)..(307): n is a, c, g, or t
  modified_base (319)..(319): a, c, t, g, unknown or other
  misc_feature (319)..(319): n is a, c, g, or t
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
  modified_base (514)..(514): a, c, t, g, unknown or other
  misc_feature (514)..(514): n is a, c, g, or t
  modified_base (520)..(520): a, c, t, g, unknown or other
  misc_feature (520)..(520): n is a, c, g, or t
  modified_base (592)..(592): a, c, t, g, unknown or other
  misc_feature (592)..(592): n is a, c, g, or t
tcagtcgtcgctcgcacgaccggtgctcgatttagacgcgatcgattggggttttgggggaggaacttgctctacgttaggacccagacggtagccgatttcggaaggaccccagcggcagtctttctctttcctcctgccttctctcggctcccagacaccacctggagtcgtattgtttcggattggaccgtcgaacgtctcccagcccaccccttaggtctacggtcgtccctcccaagggggganccgccctaccctcctcccctgcacacgcccagtcagtctatccgcttcgactggtacncctcggttaccngcacgtaagtcctggccacggcctccccgaggtacctccgtcagtttacccgtggcctacgtcccaccgacggggccctacgtggtacgtcccagaccaggttcagtggcggtgatttgggacngtgttttcnctcaccntcaccagctggacgcctgaagtattttcgctagttgttattactgtcagctagtntggtanctccacctcccatctactctttcggccgtagggaccgtaaggtacgaactacgaacgtacgtgtgctgcacntc

SEQ ID NO: 212820 - DNA, 514 bp, Homo sapiens
  misc_feature: GYAE6OF02F8B3D.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatccaccagggcccactggtcgtcccagacaggttcaggtggcggtggatttgggacagtagttttcnctcaccatcagcgccctanagagtgaagntgttgctagtttattctgccagcaatataattactgctgcgtcgacgttcggacaacgggaccagggtacggaaatacgaaacgtacgtggtaggtctgccaccgatctgtcttac

SEQ ID NO: 212821 - DNA, 569 bp, Homo sapiens
  misc_feature: GYAE6OF02GF2ES.21.27.C05.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
  modified_base (370)..(370): a, c, t, g, unknown or other
  misc_feature (370)..(370): n is a, c, g, or t
tcagtcgtcgctcgcacgaccggtgctcgatttagacgcgatcgaagggtttgggggaggaactgctcagttaggacccagacggagccatggaaggccccagcgcagcttcctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccatcagaaatctggccaggctcccaggctcctcatttaccgncatcccaccagggcccactggtcgtcccagacaggttcagtggcggtggatttgggactagagttttcnctcaccatcagccgccctacagagtgaaagattgttgcttagtttatttctgtccagctaattataattactggccttgcgtcgacgtttccggccgaacgggaccctaagggtacggaaaacgttaccgaaaaaccggtaacgttagggtacggaccgttcggacctaaacccgtatttccgttacgttcctttaccg

SEQ ID NO: 212822 - DNA, 499 bp, Homo sapiens
  misc_feature: GYAE6OF02I7DA1.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatccaccagggccactggtcgtcccagacaggttcaggtggcggtggatttgggactagtagttttcnctcaccatcagcgccctanagagtgaagntgttgctagtttatttctgccagcaatataattactggcctgcgtcgacgttcgacaacgggacaggtggaatcgaaacgactgtgctgcacatctgtctc

SEQ ID NO: 212823 - DNA, 506 bp, Homo sapiens
  misc_feature: GYAE6OF02ILSMS.21.27.C05.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (297)..(297): a, c, t, g, unknown or other
  misc_feature (297)..(297): n is a, c, g, or t
  modified_base (319)..(319): a, c, t, g, unknown or other
  misc_feature (319)..(319): n is a, c, g, or t
  modified_base (363)..(363): a, c, t, g, unknown or other
  misc_feature (363)..(363): n is a, c, g, or t
  modified_base (428)..(428): a, c, t, g, unknown or other
  misc_feature (428)..(428): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccagggggancgccaccctntcctgcacagccagtcagtctatcgctgactggttagcctggtaccagcagaaatctggccaggctcccaggctcctcatttaccgngcatccaccagggcccatggtntcccagacaggttcagtggcggtgatttgggacagtagttttcncgtcaccatccaccagactggagcctgaagatttgctagtgttattactgtcagcagtatggtanctcacctcccatcgtactactttggcctaggggacctaaggtcggaaatcaaacgaactggtagctagcactatctcg

SEQ ID NO: 212824 - DNA, 509 bp, Homo sapiens
  misc_feature: GYAE6OF02G8LBF.21.27.C05.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
  modified_base (371)..(371): a, c, t, g, unknown or other
  misc_feature (371)..(371): n is a, c, g, or t
  modified_base (390)..(390): a, c, t, g, unknown or other
  misc_feature (390)..(390): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgngcatccaccagggccacgtggtcgtcccagacaggttcaggtggcggtggatttgggactagtagttttcnctcaccatcagcgccctanagagtgaagatgttgctagtttatttctgccagtctaatattaattactggtcctgcgttcgacgttcggcgaacgggacaggtagaaagtcgaaacgactgtgctgcacatctgtctc

SEQ ID NO: 212825 - DNA, 761 bp, Homo sapiens
  misc_feature: GYAE6OF02IN7H5.21.27.C05.1.454.CMB.1.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (301)..(301): a, c, t, g, unknown or other
  misc_feature (301)..(301): n is a, c, g, or t
  modified_base (462)..(462): a, c, t, g, unknown or other
  misc_feature (462)..(462): n is a, c, g, or t
tcagtcgtcgctcgcacgaccggtgctcgatttagacgcgatcgaagggtttgggggagggaacgtgctcagttaggacccagacggagccatggaagcccagcgcagcttctcttcctcctgcttctctggctccagacaccactggagtgattgtgatgacgcagtctccagccacctgtctgtgtctccagggggncgccacctctcctgcacagccagtcagtctatcgntgactggttancctggtaccagcagaaatctaggcccaggctcccgaggcctcctcacttttaccgngcactcccaccagtcgggacctacgtcgggtcgtaccccagaacctagggtttcaaggtgggcggtttgggaattttgggggaacctaggtacgtttttccgcttccaaccctattccgaaggtcccgaccccttaaccgaggtacgttaggaaaacggtnttacggtttggtaccttaagggtttttttaactttccgtacggtaccctaaggtaccttaaaatttaacttaaaacgtttttaccgtcgggtaacccctttggtccgttaccccggggttaaagtttccccgggggaaccccgttaaacccggggggtaaccccgtaaaaaggggtttaccggggtaaaaaaccgttccgtaaaaaacccggggtaaaacgttttccggggtttacggacccgggttttcgaaccccggttaaccccgtagttttaccccggttgtttttaacccccgg

SEQ ID NO: 212826 - DNA, 571 bp, Homo sapiens
  misc_feature: GYAE6OF02H4EFB.21.27.C05.1.454.CMB.1.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
  modified_base (368)..(368): a, c, t, g, unknown or other
  misc_feature (368)..(368): n is a, c, g, or t
  modified_base (386)..(386): a, c, t, g, unknown or other
  misc_feature (386)..(386): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggcctcctcatttaccgngcatccaccagggccactggtcgtcccagacaggttcagtggcggtggatttgggacagtagttttcnctcacatcagcgccctanagagtgaagatgttgcttagtttatttcgtgccagtactaatattaattacgtcggtcctggtccgttcgtaccggttcggaccgaccggggaaccgtaagggttacggaaacgttaccgaaaaccggtaacgtaggtacggacgttacggacctaacccgtagttccgttacggttccttaccg

SEQ ID NO: 212827 - DNA, 504 bp, Homo sapiens
  misc_feature: GYAE6OF02ISM5U.21.27.C05.1.454.CMB.1.raw
  modified_base (300)..(300): a, c, t, g, unknown or other
  misc_feature (300)..(300): n is a, c, g, or t
  modified_base (373)..(373): a, c, t, g, unknown or other
  misc_feature (373)..(373): n is a, c, g, or t
  modified_base (393)..(393): a, c, t, g, unknown or other
  misc_feature (393)..(393): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggcctcccaggctcctcatttaccgngcatcccaccagggcccactggtcgtcccagacaggttcaggtgggcggtggatttgggactagtagttttcnctcaccatcagccgccctanagagtgaagatgttgctagtttatttctgccagcaatataattactggcctgcgtcgtacgttcggaccacgggacaggtgaatcaaacgactgtgctgcacatctgtctc

SEQ ID NO: 212828 - DNA, 498 bp, Homo sapiens
  misc_feature: GYAE6OF02FTDWR.21.27.C05.1.454.CMB.1.raw
  modified_base (202)..(202): a, c, t, g, unknown or other
  misc_feature (202)..(202): n is a, c, g, or t
  modified_base (366)..(366): a, c, t, g, unknown or other
  misc_feature (366)..(366): n is a, c, g, or t
  modified_base (385)..(385): a, c, t, g, unknown or other
  misc_feature (385)..(385): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagtagttttcnctcaccatcagcgccctanagagtgaagatgttgctagtttattctgccagctaatataattactggcctgcgtcgacgttcggccacgggaccaggtggaactcaaacgactgtgctgcaccatctgtctc

SEQ ID NO: 212829 - DNA, 513 bp, Homo sapiens
  misc_feature: GYAE6OF02JA9UT.21.27.C05.1.454.CMB.1.raw
  modified_base (202)..(202): a, c, t, g, unknown or other
  misc_feature (202)..(202): n is a, c, g, or t
  modified_base (368)..(368): a, c, t, g, unknown or other
  misc_feature (368)..(368): n is a, c, g, or t
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggcccactggtcgtcccagacaggttcagtggcggtggatttgggacagtagttttcnctcaccatcagcgccctanagagtgaagntgtgctagtttnttctgcagcaatataattactcggcctgcgtcgtacgttcggacgaacgggaccaggtggaaactcgaaacgacgtagcggtactcgacacctatctgtcttac

SEQ ID NO: 212830 - DNA, 500 bp, Homo sapiens
  misc_feature: GYAE6OF02GXNPL.21.27.C05.1.454.CMB.1.raw
  modified_base (202)..(202): a, c, t, g, unknown or other
  misc_feature (202)..(202): n is a, c, g, or t
  modified_base (321)..(321): a, c, t, g, unknown or other
  misc_feature (321)..(321): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactggtntcccagacaggttcagtggcggtggatttgggacagtagttttctctcaccatcagccgccctacagagtgaagatgttgctagtttatttctgtccagacaatataattactggtcctgcgtcgacgttcggccacgggacaggtagaatcaaacgactgtagctgcacatctgtctc

SEQ ID NO: 212831 - DNA, 500 bp, Homo sapiens
  misc_feature: GYAE6OF02GBLI1.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (367)..(367): a, c, t, g, unknown or other
  misc_feature (367)..(367): n is a, c, g, or t
  modified_base (396)..(396): a, c, t, g, unknown or other
  misc_feature (396)..(396): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatccaccagggccactggtcgtcccagacaggttcagtggcggtggatttgggacagtagttttcnctcaccatcagcgccctacagagtgaagntgtgctagtttattctgccagctaatataattactggcctgcgttcgacgttcggccacgggaccaggtgaactcgaaacgactgtcgctgcaccatctgtctc

SEQ ID NO: 212832 - DNA, 580 bp, Homo sapiens
  misc_feature: GYAE6OF02H2C47.21.27.C05.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (410)..(410): a, c, t, g, unknown or other
  misc_feature (410)..(410): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggcctcctcattttaccgngccatcccaccgagggcccacgtggtcgtcccagaccaggttcaggtgggcggtggtagtttggggactaggtagttttctctcacctattcgagccgtaccccgtanaaggtagtagaagtatgttgactagttttatttctgccagactaataataattactggtcctgtaccgtcgtaccggttcggaccgtaccgggaaccgaagggtacggtaaataaccgaaacggtaactaggttcggcttacggaccacctacttcgttcgttcttaccg

SEQ ID NO: 212833 - DNA, 534 bp, Homo sapiens
  misc_feature: GYAE6OF02HQJTO.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtcgagaggccttgagtggcttggaaggacctatatacgtcccagtggtatgaagactatgcagattctgtgagcggtcgtctcaccatcaccccagacacgtcaacgaatacaggtctccctccacctaactcgtctcgtcactcccgacgaccacgtcacgtttattttgtgtcaagaggatcgacattcggtgtacctaccgttaccttcgtactccgtcgggtccgaggttaaccgg

SEQ ID NO: 212834 - DNA, 498 bp, Homo sapiens
  misc_feature: GYAE6OF02IA2VD.21.27.C05.1.454.CMB.1.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
  modified_base (397)..(397): a, c, t, g, unknown or other
  misc_feature (397)..(397): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggcctcctcatttaccgngcatccaccagggccactggtcgtcccagacaggttcagtggcggtggatttgggactgtagttttctctcaccatcagcgccctacagagtgaagntgttgctagtttatttctgccagcaatataattactgcctgcgtcgacgttcgccacgggaccaggtggaatcaaacgactgtgctgcaccatctgtcttc

SEQ ID NO: 212835 - DNA, 500 bp, Homo sapiens
  misc_feature: GYAE6OF02H70NS.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (368)..(368): a, c, t, g, unknown or other
  misc_feature (368)..(368): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatccaccagggcccactggtcgtcccagacaggttcagtggcggtggatttgggacagtagttttcnctcaccatcagcgccctacagagtgaagatgttgctagtttatttctgccagcaatataattactgcctgctcgacgttcggccgacgggacaggtgaaatcgaaacgtactgtgctgcaccatctgtcttc

SEQ ID NO: 212836 - DNA, 522 bp, Homo sapiens
  misc_feature: GYAE6OF02FK94I.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatctcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtcgagaggccttgagtggcttggaaggacctattatacgtccagtggtatgaagactatgcagattctgtgagcggtcgtctcacatcaccccagacacgtccaagaatcaggtctccctccacctaatgtctgtcactcccgacgacacggctagtttacttttgtgtacaagaggatacgacattcggtgtactactccttgacctccgtcgggcctagggtaacgg

SEQ ID NO: 212837 - DNA, 712 bp, Homo sapiens
  misc_feature: GYAE6OF02HZVSO.21.27.C05.1.454.CMB.1.raw
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (313)..(313): a, c, t, g, unknown or other
  misc_feature (313)..(313): n is a, c, g, or t
  modified_base (424)..(424): a, c, t, g, unknown or other
  misc_feature (424)..(424): n is a, c, g, or t
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgagggggggacccgccaccctctcctgaccacagcctagtcagtctancgntgactggtacncctgtaccagcaagaatcgtgccaggcctacccgaggccctcctactaacgtttaccgngcactacccaaccgacgggaccctacgttcgggtccgtacccgaagaccgtacggttcgaaggtcggggcggttaggtaacgtttggggaaacctaggtttacgtttttcncctaccaacctactcgaagccccgtaccctaaagaacgtaagtaggaaaacgtagttggttacgacttaacggtttttactttccgagtaccctaaagtacctaaaatttaacgttaaaacttttacgtcgggtaccttggaccggttaccgttaccgggttaccggaaacccggtaaccggggaacccggtaaagggttacggtaaaactaaccggtaaaaaccggacgttacgggttacggtacttacggaccttaaacccgtacgttacttcggttacttacccg

SEQ ID NO: 212838 - DNA, 537 bp, Homo sapiens
  misc_feature: GYAE6OF02IW3ZD.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtccacagatcaaactacagcagtctggtccaggactggtgaggcccctgcagaccctttcactcacctgtgacatctccggggaaaatgtcgctggcaacaatgttggaattggattaggcagtccccgtcgagaggccttgagtggcttggaaggacctagttatacggtcccagtgtatgaagactaatgcagtattctgtcgagcggtcgtctcaccatcacccagacacgtacaagatcaggtctcctcactatgtctgtcactcccgacgacacgctagttttatttcgtgcctaaggcggtataccgaactacgttcggtagtaccttaccttccttggacctccgtcgggtaccgagggttaccg

SEQ ID NO: 212839 - DNA, 691 bp, Homo sapiens
  misc_feature: GYAE6OF02IOTWS.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (300)..(300): a, c, t, g, unknown or other
  misc_feature (300)..(300): n is a, c, g, or t
  modified_base (370)..(370): a, c, t, g, unknown or other
  misc_feature (370)..(370): n is a, c, g, or t
tcagtcgtcgctcgcacgaccggtgctcgatttagacgcgatcgaagggtttgggggagggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttancctggtaccagcagaaatctggccaggctcccaggctcctcatttaccgncactccaccagggccactggtcgtcccagacaggttcaggtggcggtgatttgggactagtagttttccncttccaccattcgacgccgtaccctacgagtagtgaaagtattggtttcgacttaaggttttattttccgtaggccctaaggtacctaaaagtttaacttaaaacgttttaccgttacgggtccccgtttaggtacccggtttaccgggtaaccgggttttaccgggacccccggtaaccggggggttaaccccaaagggggtttacgggaaaaaccttaacccggtaaaaaccgggtaaccgtttacggggttacggtaccggttacggaacccgtaacccttaacggttacccgttttacgggtccctttttaacccgg

SEQ ID NO: 212840 - DNA, 550 bp, Homo sapiens
  misc_feature: GYAE6OF02JYZ4W.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (299)..(299): a, c, t, g, unknown or other
  misc_feature (299)..(299): n is a, c, g, or t
  modified_base (367)..(367): a, c, t, g, unknown or other
  misc_feature (367)..(367): n is a, c, g, or t
  modified_base (388)..(388): a, c, t, g, unknown or other
  misc_feature (388)..(388): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaaatctggccaggctccaggctcctcatttaccgngcatccaccagggccacgtggtgtcccagacaggttcaggtggcggtggatttgggacagtgttttcnctcaccatcgagcgaccctanagagtgaagtatgtgctagttttattcgtgacctagactaattattaacgttactagggtccttggccgttcgaaccggtttccggaccgacggggtacctagggtacggaaagtccgaaacgtaactggtacggtctacgcaacctagtcttagtccttac

SEQ ID NO: 212841 - DNA, 619 bp, Homo sapiens
  misc_feature: GYAE6OF02JH4EL.21.27.C05.1.454.CMB.1.raw
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
  modified_base (392)..(392): a, c, t, g, unknown or other
  misc_feature (392)..(392): n is a, c, g, or t
tcagtcgtcgctcgcacgaccggtgctcgatttagacgcgatcgaagggtttgggggagggaacgtgctcagttaggacccagacggagccatggaagcccagcgcagctctcttcctcctgcttctctggctcccagacaccactggagtgattgtgatgacgcagtctccagccaccctgtctggtgtctccgagggggggagcggcccaccctctccctggccacngccagtcagtctatcgctgacttggtagcctgtccagcagaatctgccaggcctccaggcctcctcactttaccgngacctatcccaaccgagggccacgtgggtcgtacccagacctaggttcaggtggcgggtggtagtttggggacaggtagtttttccnctaccgtacccagtaccgaggtcccgaccccttagacgtaacgtagaagtaacgttgttcgacggttattttaagttccgttacgtcccaagtccaaattattaagttaacctgggtaccctggtccgtaccgtacggttccggtacgaacgggtacccaagggtacgtaagtaacctaaaacgacggttgtaagggcctcggaacaccattaccgtgttaccttac

SEQ ID NO: 212842 - DNA, 617 bp, Homo sapiens
  misc_feature: GYAE6OF02GVYUQ.21.27.C05.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
  modified_base (390)..(390): a, c, t, g, unknown or other
  misc_feature (390)..(390): n is a, c, g, or t
  modified_base (427)..(427): a, c, t, g, unknown or other
  misc_feature (427)..(427): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgngcactccaccgagggcccacgtcgggtcgtccccaggacctaggttcaggtcgggcggttgggtagtttggggactaggtagtttttccnctaccgaccatccacgccgccctagagtagtagaagnttgttgcgttagttttactttcgtgtaccagtactaattaattaaagttacttgggtccttggtccgttacgtaccggttcggaaccgtaacgggaccgtaagggttacggtaaacgtacgaaaaccggtactacgggtacggtaccgttacggacccgtaacccgtagttaccgttcgttaccttaccg

SEQ ID NO: 212843 - DNA, 527 bp, Homo sapiens
  misc_feature: GYAE6OF02HBE9Q.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (371)..(371): a, c, t, g, unknown or other
  misc_feature (371)..(371): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatccaccagggccacgtggtcgtcccagacaggttcaggtggcggtggatttgggactaggtagttttcnctcaccatcagccgccctacagagtgaagatggttgctagtttatttctgccagtctaaattataattactggtcctgcgttcgacggttcggccgacgggaccaagggtgaaacgtcgaaacgtactggtacggtctacgcaccatctcgtcttc

SEQ ID NO: 212844 - DNA, 634 bp, Homo sapiens
  misc_feature: GYAE6OF02IU809.21.27.C05.1.454.CMB.1.raw
  modified_base (203)..(203): a, c, t, g, unknown or other
  misc_feature (203)..(203): n is a, c, g, or t
  modified_base (315)..(315): a, c, t, g, unknown or other
  misc_feature (315)..(315): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctgctccagacaccactggagtgattgtgatgacgcagtctccagcccaccctgtctgtgtctccggagggggganccgcccaccctctcctgccacacgccagtcagtctatcgctgacttggttacgccgtggtaccagcaagaaatcgtggccaggcctcccgaggcctcctctacgtttaccgngcactccaccgacgggccacgtggtcgtacccagacgtaggttcaggtcgggcggtggtagtttgggactaggttagttttctctcacctatcgacgccgtaccctacgaggagtagaagtagttgtgacgttagttttactttcgtcgacctagtactaaattaacttaaagtttacgtcggtcctggtccgttacggtaccggttccggaccgaaccggggtaaccgtaaggggttaacggaaacgttaaccggaaaaccggtaacgtcggtacggtaccgtacggacctaaccgtacttccgttacgttccttacg

SEQ ID NO: 212845 - DNA, 516 bp, Homo sapiens
  misc_feature: GYAE6OF02GM3XD.21.27.C05.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
  modified_base (388)..(388): a, c, t, g, unknown or other
  misc_feature (388)..(388): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctntccgtgcacagccagtcagtctatcgctgactggttancctggtaccagcagaaatctggccaggctcccaggctcctcatttaccgtgcatccaccagggccatggtgtcccagacaggttcagtggcggtggatttggggactagtagttttccttcaccgatcagcgccctanagagtgaagactgttgctagttttatttctgccagctaatataagttactggcctgcgttacgacgttcggctaacgggccaaggtggaaatcgaaaacgacgtgtaggctgacaccatctgtcttac

SEQ ID NO: 212846 - DNA, 524 bp, Homo sapiens
  misc_feature: GYAE6OF02JWGD1.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (371)..(371): a, c, t, g, unknown or other
  misc_feature (371)..(371): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngccatccaccagggcccagtggtctcccagacaggttcaggtggcggtggatttggggactagtagttttcnctacacctatcagcgaccctacgagagtagaagtatgttgctagtttattctgccagacaattataattactgtacctgcgtcgacgttcggcgaacgggaccaagggtagaaagtcgaaacgtactggtagactcgaccacatctgtacttc

SEQ ID NO: 212847 - DNA, 569 bp, Homo sapiens
  misc_feature: GYAE6OF02IZ5EZ.21.27.C05.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (298)..(298): a, c, t, g, unknown or other
  misc_feature (298)..(298): n is a, c, g, or t
  modified_base (372)..(372): a, c, t, g, unknown or other
  misc_feature (372)..(372): n is a, c, g, or t
  modified_base (394)..(394): a, c, t, g, unknown or other
  misc_feature (394)..(394): n is a, c, g, or t
  modified_base (423)..(423): a, c, t, g, unknown or other
  misc_feature (423)..(423): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggncgccaccctntcctgcacagccagtcagtctatcgctgactggttagcctggtaccagcagaaatctggccaggctcccaggctcctcatttaccgngcatccaccacgggccactggtcgtacccagaccaggttcaggtggcggtggtatttgggactagtagttttcnctcacctatcagtccgcctaangacgtgaagtatgtgcttagtttatttcngtccagacaattactaatttactggccttggcgttcgacggttccggaccgtaacgggacctaaggtacggaaacttaccgaaaacggtaccgttaggtacggtaccgtacggtaccaaccgtaacgtacgttacgttaccgttac

SEQ ID NO: 212848 - DNA, 496 bp, Homo sapiens
  misc_feature: GYAE6OF02ICM4G.21.27.C05.1.454.CMB.1.raw
  modified_base (202)..(202): a, c, t, g, unknown or other
  misc_feature (202)..(202): n is a, c, g, or t
  modified_base (298)..(298): a, c, t, g, unknown or other
  misc_feature (298)..(298): n is a, c, g, or t
  modified_base (363)..(363): a, c, t, g, unknown or other
  misc_feature (363)..(363): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccacctctcctgcacagccagtcagtctatcgctgactggttagcctggtaccagcagaaatctggccaggctcccaggctcctcatttaccgngcatccaccagggccactggtgtcccagacaggttcagtggcggtgatttgggactgagttttcnctcactatcagcgccctacagagtgaagatgttgctagtttatttctgccagcaattataattactggcctgcgtcgacgttcggctacgggaccaggtggaatcaaacgactgtgctgcaccatctgtcttc

SEQ ID NO: 212849 - DNA, 537 bp, Homo sapiens
  misc_feature: GYAE6OF02IEO5J.21.27.C05.1.454.CMB.1.raw
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacatgttggattgattagcagtcccgtcgagaggccttgagtggcttggaaggactattatacgtccagtggtatgaagactatncagattctgtgngcggtcgtctcaccatcaccccagacacgtccaagaatcaggtcttccctccgaccctaatcgtctcgtcacctacccgacaccgacgctagtttattttgtgacagagggatcacgtacttcggtgtaccgtaaccttccgttacgtactcccgtggggacccgtaggttaacccgg

SEQ ID NO: 212850 - DNA, 533 bp, Homo sapiens
  misc_feature: GYAE6OF02H8P1S.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtcgagaggccttgagtggcttggaaggacctattatacgtcccaagtggtatgaagactatgcagattctgtgagcggtcgtctcacatcaccccagacacgtccaagaatcaggtctccctccactaatgtcctgtcactcccgacgacacggctagttttactttgtgacaagagggatcgactagttcggagtacttaccgtccttgaccttccgtcggggtcccagggttaaccg

SEQ ID NO: 212851 - DNA, 656 bp, Homo sapiens
  misc_feature: GYAE6OF02JOZX6.21.27.C05.1.454.CMB.1.raw
  modified_base (322)..(322): a, c, t, g, unknown or other
  misc_feature (322)..(322): n is a, c, g, or t
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
tcagtcgtcgctcgcacgaccggtgctcgatttagacgcgatcgaagggtttgggggaggaacgtgcgtcacgttacggacccgtacgacggagccatggtaagccccagcgcagcttctcttcctcctgcttctctggctcccgagtacgaccactggagtggtattgtgatgtacgcagtctccagccaccctgtctgtgtctccgaggggggagcgcctacccgtctcctgcgaccaggccagtcagtctatcgctgactggttagcctggtaccagctagaaatctaggccaggctccgaggctcctcatttaccggnggcatccaccagggcccacgtggtctacccagacaggttcaagtggcgtgatttgggacagtacgttttcnctcgaaccntacgagccgaccctatacgagtaggaaacgtattcgtagactaggttttaatttccgtagtcctaagactaaagttaacttaaacgttaaccgttcgggacccgttggtccgttacgggtaaccggtttccggaacccgtaccggggtaacccgtaaggttacggtaaaacgttaccggaaaaccggtaacggttaggttacggtaccgtacggttaccgaaccgttaaggttacgttcggttacgtttaccgg

SEQ ID NO: 212852 - DNA, 647 bp, Homo sapiens
  misc_feature: GYAE6OF02JZS3Z.21.27.C05.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
  modified_base (265)..(265): a, c, t, g, unknown or other
  misc_feature (265)..(265): n is a, c, g, or t
  modified_base (304)..(304): a, c, t, g, unknown or other
  misc_feature (304)..(304): n is a, c, g, or t
  modified_base (581)..(581): a, c, t, g, unknown or other
  misc_feature (581)..(581): n is a, c, g, or t
tcagtcgtcgctcgcacgaccggtgctcgatttagacgcgatcgaagggtttgggggagggaactgctcagttaggacccagacggagccatggaagccccagcgcagcttctcttcctcctgcttctctggctccagacaccactggagtgattgtgatgacgcagtctccagccaccctgtctgtgtcctccaaggggggancgccaccctntccctgacacagccagtccagtcctatcgctgactggttancctggtaccngcagaaatctggccaggctccaggctcctcatttaccgntcatccacctagggccacgtcggtacgtcccaagaccgaggtttccaggttcgggcggttagggattttcgggggaactaggggtacttttttcgccttaccgaccgtaattcgaacggccgtacccctagacggaggttcgaaagtagtggtttcgacttaggttttaacttttcgaggtccccaagtacctaaattacttaaaactttcgtacggtccttggacgtttcggtaaccgttcgggccctaacggggacctaacggtagggttaaacnccgtaaaacggtacgtacggttacggccttaggacccgaactacggtactttgggtacccttaacg

SEQ ID NO: 212853 - DNA, 499 bp, Homo sapiens
  misc_feature: GYAE6OF02IKD12.21.27.C05.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (301)..(301): a, c, t, g, unknown or other
  misc_feature (301)..(301): n is a, c, g, or t
  modified_base (369)..(369): a, c, t, g, unknown or other
  misc_feature (369)..(369): n is a, c, g, or t
  modified_base (390)..(390): a, c, t, g, unknown or other
  misc_feature (390)..(390): n is a, c, g, or t
  modified_base (400)..(400): a, c, t, g, unknown or other
  misc_feature (400)..(400): n is a, c, g, or t
  modified_base (417)..(417): a, c, t, g, unknown or other
  misc_feature (417)..(417): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgntgactggttagcctggtaccagcagaaatctggccaggcctcccaggctcctcatttaccgngcaatccaccagggcccactggtgtcccagacaggttcagtggcggtgatttgggacagtagttttcnctcacctatcagccgccctanagagtgaagntgttgctagtttattcngccagcaatataattactgcctgcgtcgcgttcggccacggacaggtgaatcaaacgactgtggctgactaccatctgtctc

SEQ ID NO: 212854 - DNA, 584 bp, Homo sapiens
  misc_feature: GYAE6OF02GNAOL.21.27.C05.1.454.CMB.1.raw
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
  modified_base (496)..(496): a, c, t, g, unknown or other
  misc_feature (496)..(496): n is a, c, g, or t
tcagtcgtcgctcgcacgaccggtgctcgatttagacgcgatcgaagggtttggggggaagaggaagactgacggtcctgccacaggtggtgctgggcacggtgggccctcgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtcgtctcaccatcaccccagacacgtccaagaatcaggtctccctccacctaatgtctgtcactcccgacgacacggcagtttattttgtgcaagngggatcacattcggtnactacctccttgactcctggggccagggtacgtttgtcaccgtctcctcacgccctccaccaacgggcccagtccgtccttcccccgtggcccgccctgcctcccgacgggacnccacccgtccgacgacgccacacggcccggacccgtgggcctcgccgttcggtaccgaacggtaccttaccgttccccgaggacccgg

SEQ ID NO: 212855 - DNA, 509 bp, Homo sapiens
  misc_feature: GYAE6OF02IH5WH.21.27.C05.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (300)..(300): a, c, t, g, unknown or other
  misc_feature (300)..(300): n is a, c, g, or t
  modified_base (331)..(331): a, c, t, g, unknown or other
  misc_feature (331)..(331): n is a, c, g, or t
  modified_base (372)..(372): a, c, t, g, unknown or other
  misc_feature (372)..(372): n is a, c, g, or t
  modified_base (391)..(391): a, c, t, g, unknown or other
  misc_feature (391)..(391): n is a, c, g, or t
  modified_base (439)..(439): a, c, t, g, unknown or other
  misc_feature (439)..(439): n is a, c, g, or t
  modified_base (500)..(500): a, c, t, g, unknown or other
  misc_feature (500)..(500): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgntgactggttagcctggtaccagcagaaatctggccaggctcccaggctcctcatttaccgngcatccaccagggccactggtctcccagacnggttcaggtggcggtggatttggggaactaggtagttttcncgtcacatcagcgccctanagagtgaagatgttgctagtttattctgccagtcaaattataattacngtcctgcgttcgacgttcggccgacgggaccaggtagaatcgaaacgatgtgactgcaccntctgtctac

SEQ ID NO: 212856 - DNA, 540 bp, Homo sapiens
  misc_feature: GYAE6OF02HHT25.21.27.C05.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (399)..(399): a, c, t, g, unknown or other
  misc_feature (399)..(399): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgngcatcccaccagggccacgtggtcgtcccagacaggttcagtggcggtggatttgggacagtagttttcnctcacntcagccgcctagagagtgaagtntgtgcttagtttattctgccagactaattattaattacgtcggtaccttgtcgttcgtaccggttcggaccgtacgggaccagggtagtaacgtacgaaacgtacgtaggtacggtactcgacacctatcgtcgtcttacg

SEQ ID NO: 212857 - DNA, 529 bp, Homo sapiens
  misc_feature: GYAE6OF02I858P.21.27.C05.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (376)..(376): a, c, t, g, unknown or other
  misc_feature (376)..(376): n is a, c, g, or t
  modified_base (397)..(397): a, c, t, g, unknown or other
  misc_feature (397)..(397): n is a, c, g, or t
  modified_base (448)..(448): a, c, t, g, unknown or other
  misc_feature (448)..(448): n is a, c, g, or t
  modified_base (520)..(520): a, c, t, g, unknown or other
  misc_feature (520)..(520): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcaagaaatctggccaggctcccaggctcctctatttaccgngcactccaccagggcccagtggtcgtccccagaccaggttcaggttggcggtggatttgggacagtagttttcnctcacctatcatccgccctangagtgaagtatgttgactagtttacttctgacctagactaatataattacnggtcctggccgtcgacgttcggaccacgggaccaggtacggaatccgaaacgtactgtcggtctgccacctntctgtctac

SEQ ID NO: 212858 - DNA, 569 bp, Homo sapiens
  misc_feature: GYAE6OF02F96WP.21.27.C05.1.454.CMB.1.raw
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcaagaatctggccaggcctcccgaggcctcctctacttttaccgngcactcccaccgagggcccacgtggtcgtcccagactaggttcaggtggcggtggatcgtggactaatttcactctacacatcagcagtctgactaactgaagtatttcgacttaacttacttattcgtacaactagtacgttactatttactttcctttactacgttttccggcccgttacgggtaaccgtaagtcgtattacgtaccgtaaacgtacttggtacggtctacgacctacctacttcgttcgttaccttctacc

SEQ ID NO: 212859 - DNA, 543 bp, Homo sapiens
  misc_feature: GYAE6OF02IJOPR.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtcgtctcaccatccaccccagaccacgtaccaaagaactcaggtcctccctccaaccttaatcgtctgtcacctcccgacgacacggtctagtttacttttgtgacaagagggatcgactattcggtgacctaccttccttcgacctccggtacgggccgtagggttaaccgg

SEQ ID NO: 212860 - DNA, 568 bp, Homo sapiens
  misc_feature: GYAE6OF02GBR9S.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngccatcccaccgagggcccacgtggtcgtcccagacaggtttcaggtgggcggtggatttggggactagtagttttctctcacctatcagccgccctagagtagtagaagtatggttgctagttttattctgcctagctaaattattaattacgtggtcctggtccgttaccgtaccggttccggaccgacgggtaccgtaaggtacggaaaacgtccgaaaacgtacgtaggttacggctacgacctacctattccgttgtccttacg

SEQ ID NO: 212861 - DNA, 519 bp, Homo sapiens
  misc_feature: GYAE6OF02H8LVZ.21.27.C05.1.454.CMB.1.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
  modified_base (372)..(372): a, c, t, g, unknown or other
  misc_feature (372)..(372): n is a, c, g, or t
  modified_base (392)..(392): a, c, t, g, unknown or other
  misc_feature (392)..(392): n is a, c, g, or t
  modified_base (420)..(420): a, c, t, g, unknown or other
  misc_feature (420)..(420): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggcctcctcatttaccgngcactcccaccagggccactggtcgtcccagacaggttcaggtgggcggtggatttgggactggtattttcnctcaccatcagccgccctanagagtgaagatgttgctagtttatttcngccagcaaatataattactgcctgcgtcgacgttcggaccgacgggaccaggtaggaaactcgaaacgagtggtgctgacaccgtatctcgtcttaccg

SEQ ID NO: 212862 - DNA, 655 bp, Homo sapiens
  misc_feature: GYAE6OF02GY2R5.21.27.C05.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (388)..(388): a, c, t, g, unknown or other
  misc_feature (388)..(388): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcaagaaatctggccaggctcccaggctcctctatttaccgngcatcccaccagggcccacgtggtcgtcccagaccgaggtttccaaggttgggcggttggtaatttaggggaaagttgtttttccncgttaccaccgtatcgacgtccgtaccctacgaaggtacgtaggaaagtagttggttgaccttaagttttactttcgtcggtacctagtactaaattacttaaatttaccgtggtacccttggtaccggttcggtaaccggtttccgggacccgtaaaccggggtacccgtaaaggggttacggtaaacgtaccgtaaaacggtaaccgttggtacgggacttacgaccgtaaccgttagttcccgttagtttacctttacgtaccg

SEQ ID NO: 212863 - DNA, 545 bp, Homo sapiens
  misc_feature: GYAE6OF02HYZKF.21.27.C05.1.454.CMB.1.raw
  modified_base (411)..(411): a, c, t, g, unknown or other
  misc_feature (411)..(411): n is a, c, g, or t
  modified_base (433)..(433): a, c, t, g, unknown or other
  misc_feature (433)..(433): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtgagaggccttgagtggcttggaaggacctattatacgtcccagtggtatgaagactatgcagattctgtgagcggtcgtctcaccatcaccccagacacgtccaagatcaggtccnccctcacctatcgtctgtcacncccgacgacacggctagttttattttgtgacaaggtagggatcgaactagtttcggtacgtaccttaccttccgttacgacccttcccggtggggaccctaggggttaaccg

SEQ ID NO: 212864 - DNA, 506 bp, Homo sapiens
  misc_feature: GYAE6OF02IOSDQ.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (320)..(320): a, c, t, g, unknown or other
  misc_feature (320)..(320): n is a, c, g, or t
  modified_base (364)..(364): a, c, t, g, unknown or other
  misc_feature (364)..(364): n is a, c, g, or t
  modified_base (490)..(490): a, c, t, g, unknown or other
  misc_feature (490)..(490): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgccacagccagtcagtctatcgctgactggttagcctggtaccagcagaaatctggccaggctccaggctcctcatttaccgngcatccacagggccactggtntcccagacaggttcagtggcggtgatttgggacagtagttttcnctcaccatcagccgaccctacagagtgaagatggttgctagtttatttctgccagcaattataattactggtcctggcgtcgtacgttcggaccacggggaccaggtgaaatcaaacgactgtcgntcgcaccatctgtctc

SEQ ID NO: 212865 - DNA, 506 bp, Homo sapiens
  misc_feature: GYAE6OF02G56MH.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
  modified_base (364)..(364): a, c, t, g, unknown or other
  misc_feature (364)..(364): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatccacagggccatggtntcccagacaggttcagtggcggtggatttgggactagagttttcnctcaccatcagcnccctanagagtgaagatgttgctagtttattcngccagtcaatataattacngcctgcgtcgacgttcggaccacgggaccagggtggaaactcgaaacgtacgtgtggactgccaccatctgtcttac

SEQ ID NO: 212866 - DNA, 514 bp, Homo sapiens
  misc_feature: GYAE6OF02I3M2Y.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (301)..(301): a, c, t, g, unknown or other
  misc_feature (301)..(301): n is a, c, g, or t
  modified_base (377)..(377): a, c, t, g, unknown or other
  misc_feature (377)..(377): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaaatctggccaggctcccaggcctcctcatttaccgngcatcccaccgagggcccactggtctccccagacaggttcaggtggcggtggatttggggactaggtacgttttcnctcacctatcagccgccctanaggagtgaagntgttgctagtttattctgccagacaatatattactggcctgcgtcgacgttcgccacgggaccaggtagaatcaaacgactgtagctacgcacctatctgtctac

SEQ ID NO: 212867 - DNA, 532 bp, Homo sapiens
  misc_feature: GYAE6OF02FMPMI.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtgagaggccttgagtggcttggaaggacctattatacgtcccagtggtatgaagactatgcagattctgtgagcggtcgtctcaccatcaccccagacacgtccaagaatcaggtctccctccacctaatcgtctcgtcacctcccgacgacacggctagtttattttgtcgcgaagaggatcgactattcggtgaccttaccgtcttacgacctccgtcggggtcctagggtaaccg

SEQ ID NO: 212868 - DNA, 621 bp, Homo sapiens
  misc_feature: GYAE6OF02IWVEX.21.27.C05.1.454.CMB.1.raw
  modified_base (202)..(202): a, c, t, g, unknown or other
  misc_feature (202)..(202): n is a, c, g, or t
  modified_base (304)..(304): a, c, t, g, unknown or other
  misc_feature (304)..(304): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccaccctgtctgtgtctccgagggggganccgccaccctctcctgcacagccagtcagtctatcgctgactggttagcctggtaccagcaagaaatctggccaggcctcccaggcctcctctatttaccgngcatcccacagggcccacgtggtcgtacccagacctaggttcaggtggcggtggagtttgggactagtagttttctctacacctatccacgccgaccctagagagtagaagtatgttgcttagttttatttcgtacgcctagtactaaattattaaacttacgttcggtcctggtaccggttaccgtaacgggttccggaaccgtaaccggggtaacctaaggggttaacggtaaaacgtaccggtaaaaaccggtaacgttacgggtacggtaccgtacggtacctaaccgtagttccgttacggttaccttaccg

SEQ ID NO: 212869 - DNA, 528 bp, Homo sapiens
  misc_feature: GYAE6OF02F673T.21.27.C05.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (380)..(380): a, c, t, g, unknown or other
  misc_feature (380)..(380): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccaggcctcctcatttaccgngcactccaccagggcccacgtgggtcgtcccagacaggttcaggtgggcggtggtagtttggggactagtagttttcnctcaccatcagccgccctacgagagtagaagattgtgctagtttatttctgccagactaattattaattacgtgcctgcgtcgtacgttcggacgaacgggacaggtagaatcgaaacgtactgtagctacgcacctatcgtgtctac

SEQ ID NO: 212870 - DNA, 586 bp, Homo sapiens
  misc_feature: GYAE6OF02I2UQT.21.27.C05.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (434)..(434): a, c, t, g, unknown or other
  misc_feature (434)..(434): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccagggggggancgccaccctntcctgcacagccagtcagtctatcgctgacttggttagcctggtaccagcaagaaatcgtggccaggcctcccgaggcctcctctactttaccgtgctactcccaccgacgggccacgtggtcgtacccagaccgtaggttcaggtcgggcggtaggtacgtttggggactagtacgttttctctccaccatcgacgccgtaccctacgagagtagaagtntgtgcgttagtttatttctcgtccagtactaataattaagttacgtacggtcctggtacgtcgtacggttccggaccgacgggaccgaggtaggtaacgtaacgaaacgtaacgtacggtacgtcgtacgacctacctagttcttacgtctc

SEQ ID NO: 212871 - DNA, 516 bp, Homo sapiens
  misc_feature: GYAE6OF02GDB1Q.21.27.C05.1.454.CMB.1.raw
  modified_base (201)..(201): a, c, t, g, unknown or other
  misc_feature (201)..(201): n is a, c, g, or t
  modified_base (300)..(300): a, c, t, g, unknown or other
  misc_feature (300)..(300): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccagggggancgccaccctctcctgcacagccagtcagtctatcgctgactggttagcctggtaccagcagaaatctggccaggctcccaggcctcctcatctatggtncatccagcagggccacgtggcatcccagacaggttcagtggcagtgggtctgggacagacttcactctcacatcaccagactggacgccgtagaagtattttgctagtgtattacgtgtactagactagtagtgtatctcacctccatcgtactacgtttcggaccgtacgggaccgtaaggtacggtaacgtaccgaaacgtacgtagtagtacg

SEQ ID NO: 212872 - DNA, 714 bp, Homo sapiens
  misc_feature: GYAE6OF02I0ZBC.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (300)..(300): a, c, t, g, unknown or other
  misc_feature (300)..(300): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaaatctggccaggctcccaggctcctcatttaccgngcactcccacagggcccacgtggcgtcccaagaccaggtttcaggttcgggcggttggtagttttaggggaactaggttacgtttttccgtcttaccgaacctacgttcaacggtcccggtaccccttaacgaaggtaggttacggaaaacggtagtttaggttacgacgttaaggtttttaacttttccgttacgtaccctaacggtacctaaaagtttaactttaaactttaccgttacgggtacccttggacccggtttaccggtaaccggttttcccgggaacccgggtaaccggggtaacccgtaaggggttacggtaaaacgttacccgaaaaacggtaaaccggttacggtacgggtaccttacggaccctaaacccgtacttaccgtttcggttaccctttaaccg

SEQ ID NO: 212873 - DNA, 529 bp, Homo sapiens
  misc_feature: GYAE6OF02GZ3QX.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtcgtctcaccatcaccccagacacgtccaagaatcaggtctccctccacctaatcgtctgtcacctcccgacgacacggctagtttattttgtcgtcaagagggatcgactattcggtgacttacctcttcgaccttccgtcgggcctagggttaccg

SEQ ID NO: 212874 - DNA, 551 bp, Homo sapiens
  misc_feature: GYAE6OF02IWYEZ.21.27.C05.1.454.CMB.1.raw
  modified_base (202)..(202): a, c, t, g, unknown or other
  misc_feature (202)..(202): n is a, c, g, or t
  modified_base (303)..(303): a, c, t, g, unknown or other
  misc_feature (303)..(303): n is a, c, g, or t
  modified_base (389)..(389): a, c, t, g, unknown or other
  misc_feature (389)..(389): n is a, c, g, or t
  modified_base (543)..(543): a, c, t, g, unknown or other
  misc_feature (543)..(543): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgccacagccagtcagtctatcgctgactggttagcctggtaccagcagaaatctggccaggctcccgaggcctcctcactttaccgngccactcccaccgagggcccacgtggtcgtcccaggactaggttcaggttgggcggttggtagtttggggactaggtacgttttcncgtacaccctatccacgccgtccctaagacggtagtagaagtagtgttagactagtttatttctcgccagctaatattaacttacgtgcctgcgtcgacgttccggacgtacgggactaggtagaactcgaaacgtacgtgtagctagctaccntctgtctc

SEQ ID NO: 212875 - DNA, 599 bp, Homo sapiens
  misc_feature: GYAE6OF02GJTL4.21.27.C05.1.454.CMB.1.raw
  modified_base (374)..(374): a, c, t, g, unknown or other
  misc_feature (374)..(374): n is a, c, g, or t
  modified_base (483)..(483): a, c, t, g, unknown or other
  misc_feature (483)..(483): n is a, c, g, or t
  modified_base (507)..(507): a, c, t, g, unknown or other
  misc_feature (507)..(507): n is a, c, g, or t
tcagtcgtcgctcgcacgaccggtgctcgatttagacgcgatcgaagggtttgggggcgagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcggcagaccctttcactcacctgtgacatctaccggggaaaatgtcgctggcaacatggttgaattggattagcagtcccgtgagaggccttgagtggcttcggaaggtacctagttataccgtcccagtggtactgaacgtactaatggactaagattcgngttggagtccggttcgtctccgaccataccaccccgtagaccacggtaccaaagaactcgaggttcctcccacctaactatacgtctagtacctacctcccggacaacnccggactagtttttaactttgganacgtaaggtaggtaatcctaacgtatttccgggtataaccttaccctttccgtacggtaacccttcgggtacgggtacgacgggttaaccgg

SEQ ID NO: 212876 - DNA, 752 bp, Homo sapiens
  misc_feature: GYAE6OF02JCWP9.21.27.C05.1.454.CMB.1.raw
  modified_base (551)..(551): a, c, t, g, unknown or other
  misc_feature (551)..(551): n is a, c, g, or t
tcagtcgtcgctcgcacgaccggtgctcgatttagacgcgatcgaagggtttggggaggaactgctcagttaggacccagacggagccatggaagccccagcgcagtcttcttcttcctcgtcgtcttctcgtcgtcctaccgagaccacctacgtaggagtagtagtttggtagtagtacggaccgacgtacgttcctaccgaccgacccctaccgttcgttcgttggttcgttccgtaccggggaagggggcgcccgacccctacccgttccttccgtcgaccacgaccgaccgtacgtacgtacgttactacgtccgtcgtacgtacggtttaggttaccgtccggttaccggtaaccgacgacgaaaagtaactcggtaccggaccgacggtccctaccggacggtcccttacctactttaccgtttaccggtcgacctacctacccgaaccggaccgggtacctacggttcggttcccaccgaacgacgttacggttcgacgggtcgggtcgggtagtttcggttacggacgtagtttcgtttccnctacactctcgacgcctacccgtaagagtagtagaagtgttggttacgagtttagttttacttcgtcgtacgacgtactaattacttaacttacgcgtactgtcgtacgttccgtccgaccgggaaccgtacgtaggtacgaacgtaacgtaacgtacgtcggtacgtacgtacgacgtacctacgtcgttcgttcctacg

SEQ ID NO: 212877 - DNA, 590 bp, Homo sapiens
  misc_feature: GYAE6OF02GY1QY.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (409)..(409): a, c, t, g, unknown or other
  misc_feature (409)..(409): n is a, c, g, or t
  modified_base (443)..(443): a, c, t, g, unknown or other
  misc_feature (443)..(443): n is a, c, g, or t
  modified_base (456)..(456): a, c, t, g, unknown or other
  misc_feature (456)..(456): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcaagaaatctggccaggcctcccgaggcctcctctactttaccgtgccactcccgaaccgacgggcccacgtcgggtccgtaccccaggaccgtaggtttcgaggttcggggcggttgggtagtttggggaactaggtacgtttttcnctcacctatcagccgccctagagtagtagaagtntgttgctagtttnttcgtgcagtactaaattataacttactggtcctgtcgttcgtacgttcggacgtaaccgggacgtaggtacggtaaacgtacgaaaacgtacgtaggtacgtcgtacggaccaacctagtctacgttctaccg

SEQ ID NO: 212878 - DNA, 621 bp, Homo sapiens
  misc_feature: GYAE6OF02JUAPW.21.27.C05.1.454.CMB.1.raw
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
  modified_base (366)..(366): a, c, t, g, unknown or other
  misc_feature (366)..(366): n is a, c, g, or t
  modified_base (437)..(437): a, c, t, g, unknown or other
  misc_feature (437)..(437): n is a, c, g, or t
  modified_base (583)..(583): a, c, t, g, unknown or other
  misc_feature (583)..(583): n is a, c, g, or t
tcagtcgtcgctcgcacgaccggtgctcgatttagacgcgatcgaagggtttgggggagggaacgtgctcagttaggacccagacggagccatggaagccccagcgcagcttctcttcctcctgcttctctggctccagacaccactggatgattgtgatgacgcagtctccagccacctgtctgtgtctccaggggggancgccaccctctcctgcacagccagtcagtctatcgctgactgttancctggtaccagcagaaatctggccaggcctccaggctcctcatttaccgtgcatccacagggccactggctccagacaggttcagtggcggtggaatttcggggaacaggtagttttcncgtacaccaattcgacgtccgaccctaacgacgtagtgaaaggatcgtttaggactaggttttaattttcncgacccgtaaggtaccctaaattaactttaaaattaccgtagggtaccccttagggccgtttaccggaacgttttcggaacccggttacgggaacctaacgggtaggtaaaaacgtccggtaaaaacgaaccttaggtaaccggtnttacggacgtacctaagttaccgttgttaccgttaacc

SEQ ID NO: 212879 - DNA, 569 bp, Homo sapiens
  misc_feature: GYAE6OF02HGHOQ.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggtggaattggattaggcagtccccgtgagaggccttgagtggcttggaaggactattatacgtccagtggtatgaagactatgcagattcgtgtgagcggtacgtctcaccatcaccccagaccacgtaccaaagaactcgacggtcctccctccgaacctaatcgtctacgtccaccttacccgacgtaccgacgtactagttttacgttttgagtacaaggagggactcgaactacgttcggtacgtaccgttacctcccgttacgtaccgtccggtcgggtccgtaagggttaaccgg

SEQ ID NO: 212880 - DNA, 611 bp, Homo sapiens
  misc_feature: GYAE6OF02H69C0.21.27.C05.1.454.CMB.1.raw
  modified_base (433)..(433): a, c, t, g, unknown or other
  misc_feature (433)..(433): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccgggggaaaatgtcgctggcaacaatggtggaattggattaggcagtccccgtcgagaggccttgagtggcttaggaaggacctattatacgtcccagtggtatgaagactatgcagattctgtgaggcggtcgtctacaccatccaccccgagaccactcaaagaatcaggtctccctcacctaatctcngttcaccgttccccgacgtaaccacggtacctaagtttttagttttcgtacgacgtaaggtacgggtactacgtaacctaacggtttccgggtaacggttaacccttaacccgtttcccgtttacggacccgttaaccccgggttcggggggtacccgtaacgggggtttaaacccgg

SEQ ID NO: 212881 - DNA, 580 bp, Homo sapiens
  misc_feature: GYAE6OF02G5JK6.21.27.C05.1.454.CMB.1.raw
  modified_base (202)..(202): a, c, t, g, unknown or other
  misc_feature (202)..(202): n is a, c, g, or t
  modified_base (376)..(376): a, c, t, g, unknown or other
  misc_feature (376)..(376): n is a, c, g, or t
  modified_base (405)..(405): a, c, t, g, unknown or other
  misc_feature (405)..(405): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcactttaccgtgccatcccaccgagggcccagtcggtctcccagacaggttcaggtggcggtggtagtttgggactagtagttttcnctcaccatcagccgcctagagagtgaagntgttgactagtttactttctgcctagtcctaattacttaattacgtcggtccttggtccgttacggttaccggttccggaccggtaacgggaccgtaagggtacgaaacgtaccgaaaacggtacgttcggtaggtccgtacggacctaccgtacgttcgtacggttccttaccg

SEQ ID NO: 212882 - DNA, 557 bp, Homo sapiens
  misc_feature: GYAE6OF02GAGW4.21.27.C05.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (304)..(304): a, c, t, g, unknown or other
  misc_feature (304)..(304): n is a, c, g, or t
  modified_base (380)..(380): a, c, t, g, unknown or other
  misc_feature (380)..(380): n is a, c, g, or t
  modified_base (416)..(416): a, c, t, g, unknown or other
  misc_feature (416)..(416): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccngcagaatctggccaggcctcccgaggcctcctctactttaccgngcactccaccgagggccacgtggtctcccagactaggttcaggtggcggtggagtttggggactaggtagttttcnctcacctatcacgccgaccctagagtagtagaacgntggttcgcgttagtttatttctcgtccaagtactaattacttaagttactcggtcctggtcgtcgtaccgtcggacgaacgggactagggtagaagtacgaaacgtacgtggtacgtactcgctaccgatcttagtcttac

SEQ ID NO: 212883 - DNA, 572 bp, Homo sapiens
  misc_feature: GYAE6OF02FXIJ1.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatccaccagggccactggtgtcccagacaggttcaggtggcggtggagtttgggactagtagttttcnctcaccatcagcgccctanagagtgaagatgttgctagtttatttcgtgcctagctaaatattaaattactggtcctggtccgttacgtacgtttccggacccgtaacggggaacccgtagggtacggaaaacgtaccgtaaaaccggtaacgttgggttacggtccttagcctaaacccgagttccgttagttcctttaccg

SEQ ID NO: 212884 - DNA, 578 bp, Homo sapiens
  misc_feature: GYAE6OF02F52S6.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaaatgtcgctggcaacaatggttggaattggattaggcagtccccgtgagaggccttgagtggcttggaaggacctattatacgtcccagtcggtatggaagactatgcagtattcgtgtgagcggtcgtctcacctatccacccgagacgacgtaccaagaactcacggtcctccctaccacctaatcgtctcgtcaccgtcccgacgaccacggtcttagttttatttgcgtacgaaggtacgggatcgaacttacgtttaccgggtcgtaacccttacccgttccgttacgtaccgttccgtacgggggtccaaggggttaccgg

SEQ ID NO: 212885 - DNA, 532 bp, Homo sapiens
  misc_feature: GYAE6OF02GL3OL.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtgagaggccttgagtggcttggaaggacctattatacgtcccagtggtatgaagactatgcagattctgtgagcggtcgtctcaccgatcaccccagacacgtccaagaatcaggtctccctccacctaatgtctgtcactcccgacgacaccggctagtttattttgtgtcaaggaggatcactattcggtagactacctccgttcgaccttccgtcggggaccgagggttaaccgg

SEQ ID NO: 212886 - DNA, 555 bp, Homo sapiens
  misc_feature: GYAE6OF02HR1O6.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaaatgtcgctggcaacaatggttggaattggattaggcagtccccgtcgagaggccttgagtggcttggaaggacctattatacgtcccagtggtatgaagactatgcagattctgtgagcggtgtctcaccatccaccccagacacgtccaaagatcaggtcctccctccacctaatgtctcgtcacctcccgacgacacggctagttttagttttgtcgtacaaggacgggtatacgaactacgttcggtacgtacctacccttccgttcgaccttcccgtggggtaccctagggttaacccgg

SEQ ID NO: 212887 - DNA, 546 bp, Homo sapiens
  misc_feature: GYAE6OF02GN6OD.21.27.C05.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
  modified_base (385)..(385): a, c, t, g, unknown or other
  misc_feature (385)..(385): n is a, c, g, or t
  modified_base (458)..(458): a, c, t, g, unknown or other
  misc_feature (458)..(458): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccgaggcctcctcacttttaccgngcactccaccgagggcccacgtggtcgtcccagacaggttcaggtgggcggtggtatttggggactaggtagtttttccnctcaaccatcagccgtccctacagtagtgaagtattgttgctagtttattcgtgccagcaattataattacgngtcctgcgtcgtacgttcggacgacgggtaccaaggtacggtaaactcgaaacgtacgtggtagctagctacctatcttcgtcttacg

SEQ ID NO: 212888 - DNA, 592 bp, Homo sapiens
  misc_feature: GYAE6OF02IQVEW.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaaatgtcgctggcaacaatggttggaattggattaggcacgtccccgtcgagaggccttggagtggcgttggaaggacctattactacgtcccagtggtatgaagactatgcagattctgtgagcggtcgtctcaccatccaccccagaccaacgtaccaagaactcgacgtcctacccctacctaccttaatcgtctcgtccaccttcccgacgaccgaccggtcttagttttacttttgtacgtacgaaggtagggactccgtaacgtacgttcggtcgtaaccgttaccgttccgtttacgtacccgttccggtacggggtaccctaggggttaaccgg

SEQ ID NO: 212889 - DNA, 632 bp, Homo sapiens
  misc_feature: GYAE6OF02I7O6N.21.27.C05.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (425)..(425): a, c, t, g, unknown or other
  misc_feature (425)..(425): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaaggggggncgccacctctccngcacagccagtcagtctatcgctagacttggttacgccgtaggtaccagcaagaaactcgtcggaccacggcctacccgaggtccttccgtctacgtttaccgcgacctactcccgaaccgacgggccctacgttcgggtaccgtacccgaagaccgtacggttcgaggttcgggcgggttggtagtttcgggaactagttacgttttcncgtaccactatccgacgccgtaccctagaggtacgtaggaagtagttgtcgacttagtttactttctacgcctagtactaattattaacgttacgtcggtccttggtccgttacgtaccggttcgaccgtacgggaccgtagggtacgtaacgtaaccgaaacgtacgtaggtacggtctacgacctacgtagttcgtcgtcttacg

SEQ ID NO: 212890 - DNA, 610 bp, Homo sapiens
  misc_feature: GYAE6OF02G9U1V.21.27.C05.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
  modified_base (404)..(404): a, c, t, g, unknown or other
  misc_feature (404)..(404): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccaggcctcctctactttaccgngccactccaccgacgggccacgtggtcgtcccagactaggttcaggtgggcggtggtagtttcgggactagtagttttctctcacctatcagccgcctanacgagtagaagtatgttgacttagtttactttctacgtaccagtactaaattattaaacgtttactggtcctggtccgttaccggtaccggtttccgggacccgtaacggggtaacccgtaaggggtacggtaaacgtaaccggaaaacgtaaccgtggtacggtaccgtacggacctaacccgtattccgttcgttaccttaccg

SEQ ID NO: 212891 - DNA, 607 bp, Homo sapiens
  misc_feature: GYAE6OF02ILS7P.21.27.C05.1.454.CMB.1.raw
tcagtcgtcgctcgcacgaccggtgctcgatttagacgcgatcgaagggtttggggggaagaggaagactgacggtcctgccacaggtggtgctgggcacggtgggccctcgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtcgtctcaccatcaccccagacacgtccaagaatcaggtctccctccacctaatgtctgtcactcccgacgacacggcagtttattttgtgctaagagggatcacattcggtgactacctccttgacctccgtggggcccagggtaacgtttgtacaccgttctcctcacgcctccaccgaacgggcccattccggtccttaccccctggcccgtccctgcctccgacggacgtccaacccttccgacgtacgccaacgtacggccgggtcccctcggggtcctcggccccttgggtacccaaagggtacccttacgtttaccccggagtacccggg

SEQ ID NO: 212892 - DNA, 596 bp, Homo sapiens
  misc_feature: GYAE6OF02JJ7AH.21.27.C05.1.454.CMB.1.raw
  modified_base (204)..(204): a, c, t, g, unknown or other
  misc_feature (204)..(204): n is a, c, g, or t
  modified_base (252)..(252): a, c, t, g, unknown or other
  misc_feature (252)..(252): n is a, c, g, or t
  modified_base (310)..(310): a, c, t, g, unknown or other
  misc_feature (310)..(310): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (408)..(408): a, c, t, g, unknown or other
  misc_feature (408)..(408): n is a, c, g, or t
tcagtcgtcgctcgcacgaccggtgctcgatttagacgcgatcgaagggtttgggggagggaacgtgctcagttaggacccagacggagccatggaagccccagcgcagcttctcttcctcctgcttctctggctcccagacaccactggagtgattgtgatgacgcagtctccagccacctgtctgtgtctccgaggggggancgcccaccctctcctgcacagccagtcagtctatcgctgactggttancctggtaccagcaagaaatcgtggcccaggcctcccgaggcctcctcacttttaccgngccactccaaccgcgggccctacgtgggtctcccgagacaggttcagtggcggtggatttgggacaggtnttttcnctcactagtcagcctaccctanaggatgaagattgtgcttagtttactttctgcctagactaaattataaactttacgtcggccttaggccgtttacgaccggtttcggacccgtaacgggaaccgtagggtaacggaaacttaacggaaaaccgtaggttcggtacggtccgtacgaccgaacccttaggtctttacggttccttaccg

SEQ ID NO: 212893 - DNA, 656 bp, Homo sapiens
  misc_feature: GYAE6OF02JQK01.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttacgcctggtaccagcaagaaactctggccaggcctcccgaggcctcctctacgtttaccgtgccactcccaccgagggccacgtggtctcccagactaggttcaggttcggcggttaggtagtttcggggactaggttacgtttttccaccgttccaaccgtagtccgacgtccgaccccttaagaaggtacgtagaagtagttcggttacgtacgttagttttatttccgtacgccgtaagtactaaattaattaaacgtttacgtcggtcccttaggtacccggttacggtaccggttaccggaacccgtaaccggggtaaccgtaagggttacggaaaccttaaccggaaaccgttacgtaggttcgacgttacgacctaccgtattaccgttcgttacttaccg

SEQ ID NO: 212894 - DNA, 550 bp, Homo sapiens
  misc_feature: GYAE6OF02I320P.21.27.C05.1.454.CMB.1.raw
tcagtcgtcgctcgcacgaccggtgctcgatttagacgcgatcgaagggtttgggggaggaactgctcagttaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcagtgggtctgggacagacttcactctcaccatcacgcagactggacgcctgaagtattttgctaatgtaattactgtcagacaatatgtcctcacccccgtatctaccttaccgaccgaaggaccacgactgacagatacgacgaactggtacgctacgaccacctagttcctggttccttactacgttccgttaccccgtacccg

SEQ ID NO: 212895 - DNA, 559 bp, Homo sapiens
  misc_feature: GYAE6OF02I1FO6.21.27.C05.1.454.CMB.1.raw
  modified_base (202)..(202): a, c, t, g, unknown or other
  misc_feature (202)..(202): n is a, c, g, or t
  modified_base (451)..(451): a, c, t, g, unknown or other
  misc_feature (451)..(451): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggcctcctctatttaccgtgcactccaccgacgggcccacgtggtcgtccccagacctaggttcaggtcggcggtggtagtttgggactagtaccttcactctcaccatccaccagacgtggacgcctgaagtatttgctagttgtattactgtcagtcagtatggtanctactacctcctatcgtacttacgtttcgccggtaacgggaccgtaaggtacggaaactaaccgaaacgtacgttacggtcggtaccgtacggacctacctagttacg

SEQ ID NO: 212896 - DNA, 527 bp, Homo sapiens
  misc_feature: GYAE6OF02G2OJU.21.27.C05.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (381)..(381): a, c, t, g, unknown or other
  misc_feature (381)..(381): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgacttggttagcctggtaccagcagaaatctggccaggctcccaggctcctcatttaccgngcatcccaccagggcccacgtggtcgtccccagacctaggttcaggtgggcggtgggatttggggactaggtagttttcnctcacctatcagccgccctacagagtgaagatgttgcttagtttattctgccagactaattataattactgactgcgtcgtacgttcgacgacgggaccaggtagaacgtacgaacgtacgtgtgcgtgacaccatctgtcttacg

SEQ ID NO: 212897 - DNA, 589 bp, Homo sapiens
  misc_feature: GYAE6OF02IKCSL.21.27.C05.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
  modified_base (376)..(376): a, c, t, g, unknown or other
  misc_feature (376)..(376): n is a, c, g, or t
  modified_base (414)..(414): a, c, t, g, unknown or other
  misc_feature (414)..(414): n is a, c, g, or t
  modified_base (423)..(423): a, c, t, g, unknown or other
  misc_feature (423)..(423): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccgaggctcctcactttaccgngcactccaccagggccacgtggtcgtccagacnggttcaggtcggcggtgtagtttgggactagtagttttcnctcaccatcacgccgccctagagagtgaagtattgtgnttaagtttntttcgcgactagactaattataacttacgtcggtccttggtccgttacggtccggttacggaaccgtaaccgggtaaccgtagggtaacggtaacgtaaccggaaacggttaacgtggtacggtacgtacggacctaaccgtacgttcgttacgttaccttacccg

SEQ ID NO: 212898 - DNA, 509 bp, Homo sapiens
  misc_feature: GYAE6OF02GTO32.21.27.C05.1.454.CMB.1.raw
  modified_base (202)..(202): a, c, t, g, unknown or other
  misc_feature (202)..(202): n is a, c, g, or t
  modified_base (377)..(377): a, c, t, g, unknown or other
  misc_feature (377)..(377): n is a, c, g, or t
  modified_base (400)..(400): a, c, t, g, unknown or other
  misc_feature (400)..(400): n is a, c, g, or t
  modified_base (470)..(470): a, c, t, g, unknown or other
  misc_feature (470)..(470): n is a, c, g, or t
  modified_base (500)..(500): a, c, t, g, unknown or other
  misc_feature (500)..(500): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccgaggcctcctcatttaccgtgcactccaccgagggcccactgggtctacccagaccaggttcagtgggcggtgagtttggggacaggtagttttcncttcacctatcacgccgccctanagagtgaagatgtgctagtttattctgcagcaatataatactgctgcgtcgcgttcggacacggacaggngtaactacgaacgactgtcgctcgcacctntactgtctc

SEQ ID NO: 212899 - DNA, 518 bp, Homo sapiens
  misc_feature: GYAE6OF02G7RQU.21.27.C05.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
  modified_base (373)..(373): a, c, t, g, unknown or other
  misc_feature (373)..(373): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgngcatcccaccgagggccacgtggtcgtcccagacaggttcaggtggcggtggatttgggactagtagttttcnctcaccatcagcgccctacagagtagaagatgttgctagtttatttctgcagacaatataattactgctgcgtcgacgttcggacgaacgggaccaggtagaatacgaaacgtacgtgtaggctacgacacctatcttgtcttac

SEQ ID NO: 212900 - DNA, 541 bp, Homo sapiens
  misc_feature: GYAE6OF02I5WZV.21.27.C05.1.454.CMB.1.raw
  modified_base (468)..(468): a, c, t, g, unknown or other
  misc_feature (468)..(468): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaatgtcgctggcaacaatggttaggaattggattaggcagtccccgtgagaggccttgagtggcttggaagacctatatacgtccagtggtatgaagactatgcagattctgtgagtcggtcgtctcaccatccacccagacaccgtacaagaatcgacggtcctcctccacctaatgtctgtcacctcccgacgaccacggtctagttttatttcgtanacgaagagggtactcgactagttccggtatacctccgtccttcgaccttccgtcgggtaccgagggttaaccg

SEQ ID NO: 212901 - DNA, 621 bp, Homo sapiens
  misc_feature: GYAE6OF02G1N26.21.27.C05.1.454.CMB.1.raw
  modified_base (203)..(203): a, c, t, g, unknown or other
  misc_feature (203)..(203): n is a, c, g, or t
  modified_base (398)..(398): a, c, t, g, unknown or other
  misc_feature (398)..(398): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttacgcctggtaccagcaagaaatctggccaggcctcccgaggtcctcctctactttacccgtgaccactcccaccgagggcccacgtggtcgtacccagacctaggttcaggtcgggcggttgggtagtttggggactaggtagttttcnctacacctatcgacgccgaccctacgaggagtagaagtattggttcgtacttagttttactttcgtcgacctagtacctaaattattaaactttacgtggtacctaggtccgttacgtaccggttccggaccgtaaccgggtaccgtaagggtacggaaacgtaccggtaaacgtacgtacggtacggtctacggacctaccgtagttcgttacgtacttacg

SEQ ID NO: 212902 - DNA, 511 bp, Homo sapiens
  misc_feature: GYAE6OF02FUNZ6.21.27.C05.1.454.CMB.1.raw
  modified_base (202)..(202): a, c, t, g, unknown or other
  misc_feature (202)..(202): n is a, c, g, or t
  modified_base (369)..(369): a, c, t, g, unknown or other
  misc_feature (369)..(369): n is a, c, g, or t
  modified_base (397)..(397): a, c, t, g, unknown or other
  misc_feature (397)..(397): n is a, c, g, or t
  modified_base (501)..(501): a, c, t, g, unknown or other
  misc_feature (501)..(501): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactgggtcgtcccagaccaggttcagtggcggtggatttgggacagtagttttcnctcaccatcagcgcctacagagtgaagnttgtgctagtttattctgccagcaatataattactgtctgcgttcgacgttcggccgacgggacctaggtcggaaatcgaaacgtacgtgtacggctgccacgntcttgtcttc

SEQ ID NO: 212903 - DNA, 609 bp, Homo sapiens
  misc_feature: GYAE6OF02GMEM6.21.27.C05.1.454.CMB.1.raw
  modified_base (278)..(278): a, c, t, g, unknown or other
  misc_feature (278)..(278): n is a, c, g, or t
  modified_base (414)..(414): a, c, t, g, unknown or other
  misc_feature (414)..(414): n is a, c, g, or t
tcagtcgtcgctcgcacgaccggtgctcgatttagacgcgatcgaagggtttgggggaggaactgcgtcagttaggacccagacggagccgaatggaacgcccctagcgtcgagcttctcttcctcctgacttctctggctcccagacaccacttggagtgattgtggtatgacgcagttctccagcccacctgtcctggtgtctccgagggggagcgcctaccctcggtccgtggcaccagccctaggtccacgtctactcgcctgacctggttacncctggtacctagcctaggtaaactctggccagctcccaggcgtccgtcgactttaccggcaagtccacgagggtccacgtggtcgtacccagcctaggttcaggtgggcggtggtatttgggactagacgttttcnctcgacaatcgagtccgaccctacagtacgtagaagatagttgactaagtttattctgtcctagtctaaattaattaacttaactcggtcctgcgtcgtacgttcggaccgtacgggacctagggtaggtaacgtacgtaaaccgtacgttacggtcggtacgtacgaccgtaccagttcgttcgttacttaccg

SEQ ID NO: 212904 - DNA, 704 bp, Homo sapiens
  misc_feature: GYAE6OF02JY78O.21.27.C05.1.454.CMB.1.raw
  modified_base (217)..(217): a, c, t, g, unknown or other
  misc_feature (217)..(217): n is a, c, g, or t
  modified_base (325)..(325): a, c, t, g, unknown or other
  misc_feature (325)..(325): n is a, c, g, or t
tcagtcgtcgctcgcacgaccggtgctcgatttagacgcgatcgaagggtttggggaggaactgcgtcagttaggacccagacggagccatggaagccccagcgcagcttctcttcctcctgcttctctggctcccagacaccactggagtgattgtgatgacgcagtctccagccaccctgtctgtgtctccgaggggggacccgccacctctccngaccacacgccagtcagtctagtccgctgaccttggtacgtccgtaggtaccagctaagaacttcgacggccacggtcctaccgacggtcctcctctacgtttaccgngcctactcccaccgacggcctacgtcggtccgtacccagtaaccggtacggttcaacgggtcgggtcgggttaggtacgtttacgggaacttagggtttcgttttccaccgtaccgtacctacgtccgtacgtaccgtacccgtacgacgtaacggtacgtaagtacgttggttacgtacgttagtttactttacgtacgtccgtaagtactaaacttaacgttaaacgttacgttacgtaccgttacgtaccggtaccgttaccggttaccggaaccgtaaccgggaaccgtaacgggtaacgaacgtaaccgtaaaccgtacgttacggtacggtaccgtacgtacgtaaccgtacgttaccgtacgttaccgttac

SEQ ID NO: 212905 - DNA, 496 bp, Homo sapiens
  misc_feature: GYAE6OF02F3QVL.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (370)..(370): a, c, t, g, unknown or other
  misc_feature (370)..(370): n is a, c, g, or t
  modified_base (389)..(389): a, c, t, g, unknown or other
  misc_feature (389)..(389): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatccaccagggccacgtggtctcccagactaggttcaggtggcggtggagtttgggacagtagttttcnctcaccatcagcgccctanagagtgaagatgttgctagtttattctgccagcaatataattactgctgcgtcgacgttcgcacgggaccaggtgaatcaaacgtactgtgctgcaccatctgtctc

SEQ ID NO: 212906 - DNA, 564 bp, Homo sapiens
  misc_feature: GYAE6OF02G5NA3.21.27.C05.1.454.CMB.1.raw
  modified_base (204)..(204): a, c, t, g, unknown or other
  misc_feature (204)..(204): n is a, c, g, or t
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (304)..(304): a, c, t, g, unknown or other
  misc_feature (304)..(304): n is a, c, g, or t
  modified_base (389)..(389): a, c, t, g, unknown or other
  misc_feature (389)..(389): n is a, c, g, or t
tcagtcgtcgctcgcacgaccggtgctcgatttagacgcgatcgaagggtttgggggagaactgctcagttaggacccagacggagccatggaagccccagcgcagcttctcttcctcctgcttctctggctcccagacacccactggagtgattgtgatgacgcagtctccagccaccctgtctggtgtctccgaggggggancggccacccgtctcctgcacagccagtcagtctatcgctgactggtancctggtaccngcagaatctggccaggctcccgaggtctcctcactttaccgngcactccaccgagggcccacgtggtacgtcccaggactaggttcaggtcgggcggtggtagtttggggactaggtacgttttccnctccacctagttccacgtccgtaccctagacggtagtagaagtagttggttagacttagttttactttcgtcgccagtactaattattaattcgtgccttaggcgtacgtacggttcgaccgacgggaccgaggtcgaaatcgaacgtactggtagctagccactatctgtctcg

SEQ ID NO: 212907 - DNA, 581 bp, Homo sapiens
  misc_feature: GYAE6OF02GUV33.21.27.C05.1.454.CMB.1.raw
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
  modified_base (366)..(366): a, c, t, g, unknown or other
  misc_feature (366)..(366): n is a, c, g, or t
  modified_base (407)..(407): a, c, t, g, unknown or other
  misc_feature (407)..(407): n is a, c, g, or t
tcagtcgtcgctcgcacgaccggtgctcgatttagacgcgatcgaagggtttgggggtaggaactcgctcagttaggacccagacggagccatggaagccccagcgcgagcttctcttcctcctgcttctctggcctcccagacacccactggacgtgacttgtgatcgacgcgagtctccaggcccaccgtgtctgtgtctccgagggggacnccgccaccctcncctgcacgagccagtcagtctatcgctgactggttagcctggtaccagcaagaatcnggccagctccgaggctcctcatttaccgncatccacgaggccactggtcgtcccagacaggttcaggtgcggtgattgggacngtagtttcctctcaccatcgagccgccctagagtgtagaantgttgacttaagttttatttcgtcgaccagtacctaaataattaattacgttaggccttgccgttacgtaccgttcggaccaaacgggtacctaagggtagtaaacgtacaaaaccggtaacgtacggtaggttaccgacggtacccaacctagttcttacggtacctttaccg

SEQ ID NO: 212908 - DNA, 616 bp, Homo sapiens
  misc_feature: GYAE6OF02JPPDX.21.27.C05.1.454.CMB.1.raw
  modified_base (201)..(201): a, c, t, g, unknown or other
  misc_feature (201)..(201): n is a, c, g, or t
  modified_base (248)..(248): a, c, t, g, unknown or other
  misc_feature (248)..(248): n is a, c, g, or t
  modified_base (304)..(304): a, c, t, g, unknown or other
  misc_feature (304)..(304): n is a, c, g, or t
  modified_base (381)..(381): a, c, t, g, unknown or other
  misc_feature (381)..(381): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccagggggancgccaccctctcctgcacagccagtcagtctatcgctgactggttancctggtaccagcaagaaactctggccaggctcccgaggcctcctctactttaccgngcactccaccgacgggccacgtggtcgtcccagacaggttcagtggcggtaggtagtttgggactagtacgttttcnctcacctagtccgacgtccgccctagacgtagtagaagtagttggtcgacttagtttactttcgtacgtcctaagactaattaagttaacttacgtacggtcctaggtccgttacgtaccggttcggaaccgtaaccggggtaaccgtacgggtaacggtaaacgtaccggtaaaacgtacgttacggtacggtacgttacggaccaaccgtacttaccgttcgttaccttaccg

SEQ ID NO: 212909 - DNA, 542 bp, Homo sapiens
  misc_feature: GYAE6OF02GELBR.21.27.C05.1.454.CMB.1.raw
  modified_base (463)..(463): a, c, t, g, unknown or other
  misc_feature (463)..(463): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatgggggtgtcctgtcacagatcaaactacagcagtctggtccaggactggtgaggccctcgcagaccctttcactcacctgtgacatctccggggaaatgtcgctggcaacaatggttggaattggattaggcagtccccgtcgagaggccttgagtggcttggaaggactattatacgtccagtggtatgaagactatgcagattctgtgagcggtcgtctcaccatcaccccagacacgtccaagaatcgaggtcctccctccacctaatcgtctgtccactcccgacgacacgctagtttattttgngtacaaggtaggactacgactagttcggtcgtacttaccttccttacgtacctccggtcgggtaccgagggttaaccgg

SEQ ID NO: 212910 - DNA, 559 bp, Homo sapiens
  misc_feature: GYAE6OF02GFBWP.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtcgagaggccttgagtggcttggaaggacctattactacgtcccagtggtatgaagactatgcagattctgtgagcggtcgtctcaccatcaccccagacacgtccaagaactcacggtcctccctccacctaatcgtctcgtcaccgtcccgacgaccacggctagttttatttgtcgcaaggtacggatcgaactacgtttcgggtacgtaccttacccttccgtttcgaccttccggtacggggtcccaaggggttaaccgg

SEQ ID NO: 212911 - DNA, 831 bp, Homo sapiens
  misc_feature: GYAE6OF02H8VHG.21.27.C05.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagacgcgatcgaagggtttgggggagggaactgctcagttaggacccagacggagcatggaagccccagcgcagcttctcttcctcctgcttctctcggcctcccagacaccgactgggagtgattgtgatgacgcagtctccagccaccctgtctgtgtctccgagggggancgcccacctctcctgcacacgccagtacagtactatcgctgacttggttagccttaggtaccagcgaagaactcgtacggaccaggccttacccgaggtccctacctaccgttaacgttttaccccggagtaccttaacgtcccgaaccggtacgggtccctacggttcgggttcgtacccgaggtaaccgtacggttccgaggttcggggtaggttacgggtacgtttacggggacttacggttaccgtttttcctacccgttacccaaccgtaccgttaccgaccggtacccggtacccccgttaacgtaacggtaacggttacgggtaaaacgtacggtttacgggttacggttacggtttaacgtttttaacgttttaccgtacgttacccgtaagtaccttaaaagttaactttaaacgtttaacggtaccgttaccgttacgggttaaccgttaccgggttaccgggtttaccggaaccccggtaaccgggggtaaaccgtaacgggtttaacggtaaaaccggtaccggtaaaacccggttacggtcgggttaaccgtaccggtaccgtaacccgtaacccgttaacgtttaccggtttaccggtaccgtttaccccg

SEQ ID NO: 212912 - DNA, 591 bp, Homo sapiens
  misc_feature: GYAE6OF02HCXBM.21.27.C05.1.454.CMB.1.raw
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaatgtcgctggcaacaatggttggaattggattaggcagtccccgtcgagaggccttgagtggcttggaaggacctattatacgtcccagtggtatgaagactatgcagattctgtgagcggtacgtcgtcaccatccaccccagaccacgtccaagaatcgagtctcccncacctatntctcgtcactacccgagaccacggcctagttttacttttggtacgtacaaggtacgggtactaccgaaccgtaagtttccgggtacgtaacccgtttaacccgttacccgtttacggtaacccgttcccggttacgggggtaccctaagggggtttaacccgg

SEQ ID NO: 212913 - DNA, 578 bp, Homo sapiens
  misc_feature: GYAE6OF02IGB4Z.21.27.C05.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (302)..(302): a, c, t, g, unknown or other
  misc_feature (302)..(302): n is a, c, g, or t
  modified_base (329)..(329): a, c, t, g, unknown or other
  misc_feature (329)..(329): n is a, c, g, or t
  modified_base (396)..(396): a, c, t, g, unknown or other
  misc_feature (396)..(396): n is a, c, g, or t
  modified_base (436)..(436): a, c, t, g, unknown or other
  misc_feature (436)..(436): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgntgactggtagcctggtaccagcagaaatctggccaggctcccgaggcctcctctattttaccgngcactccaaccagggcccacgtcggtntcccagacaggtttcagtggacggtgtagtttgggactagtagttttctctcacatcacgcacctanagagtgaaagagtgttgacttagtttacttctgtcctagntaaatattaattacgtcggtacctggtcgttacgtacggtttaggaccgtaaacgggacctaacggggtagtaaacgtaaccgtaaaacgaacgttcggtacgacgtacgaccgtacccgtattccgttacggtccttaccg

SEQ ID NO: 212914 - DNA, 724 bp, Homo sapiens
  misc_feature: GYAE6OF02FYRP9.21.27.C05.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcaagaaatctggccaggcctcccgaggtcctcctctacttttacccggngccactccccaccgacgggcccacgttgggtccgtcccagaccgtaggttcaggttgggcggttagggtagttttacggggactaggttagtttttcctccgttacccaaccgtattccgacggtcccgtacccctaacaggtaacggttaggaaacggtagttcgggtttacgtacgtttaaggtttttacttttaccgtcggtaccctaaggtacctaaaagtttaactttaaacgttttaccgtacgggtacccgttacgggtcccggtttaccggtacccggtttccgggaacccgtaaccggggaacccgtaaggggtaacggtaaacgtaccgaaaaccggttaacggtcggttacggtacgttaccggaccgtacccgtaacgttcccgttacggttaccttacccg

SEQ ID NO: 212915 - DNA, 612 bp, Homo sapiens
  misc_feature: GYAE6OF02GPKXF.21.27.C05.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
  modified_base (383)..(383): a, c, t, g, unknown or other
  misc_feature (383)..(383): n is a, c, g, or t
  modified_base (405)..(405): a, c, t, g, unknown or other
  misc_feature (405)..(405): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaatctggccaggcctcccaggcctcctctactttaccgngcactcccaccgacgggcccacgtcggtcgtcccagactaggttcagtgggcggtggagtttgggactagtacgttttcnctcacctatcacgccgacctanagtagtagaagtatgttgactagtttacttcgtcgcctagactaattattaacttacgtcggtccgttggtccgttaccggtaccggtttccggacccgtaccggggtaaccgtaagggttacggtaaacgttaccggaaaaccggtaaccgttacgggtacggtaccgtacggacctaaccgtacgttacgttcgttaccttaccg

SEQ ID NO: 212916 - DNA, 495 bp, Homo sapiens
  misc_feature: GYAE6OF02HCX22.21.27.C05.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (299)..(299): a, c, t, g, unknown or other
  misc_feature (299)..(299): n is a, c, g, or t
  modified_base (371)..(371): a, c, t, g, unknown or other
  misc_feature (371)..(371): n is a, c, g, or t
  modified_base (390)..(390): a, c, t, g, unknown or other
  misc_feature (390)..(390): n is a, c, g, or t
  modified_base (468)..(468): a, c, t, g, unknown or other
  misc_feature (468)..(468): n is a, c, g, or t
  modified_base (481)..(481): a, c, t, g, unknown or other
  misc_feature (481)..(481): n is a, c, g, or t
  modified_base (491)..(491): a, c, t, g, unknown or other
  misc_feature (491)..(491): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctntcctgcacagccagtcagtctatcgctgactggttagcctggtaccagcagaaatctggccaggctcccaggctcctcatttaccgngcatccaccagggccacgtggtcgtcccagactaggttcaggtggcggtggatttgggactagtagttttcnctcaccatcagcgccctanagagtgaagatgttgctagtttattctgccagcaatataattactgctgcgtcgacgttcgacacggacaggtagaancaacgactgtcgntgcacatctntctc

SEQ ID NO: 212917 - DNA, 604 bp, Homo sapiens
  misc_feature: GYAE6OF02HLJQK.21.27.C05.1.454.CMB.1.raw
  modified_base (208)..(208): a, c, t, g, unknown or other
  misc_feature (208)..(208): n is a, c, g, or t
  modified_base (327)..(327): a, c, t, g, unknown or other
  misc_feature (327)..(327): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
tcagtcgtcgctcgcacgaccggtgctcgatttagacgcgatcgaagggtttgggggaggaactgcgtcagttaggacccagacggagccatggaagccccagcgcagtcttctcttcctcctgcttctctggctccagacaccactggagtgtattgtgatgtacgctagtctccagccaccctgtctgtgtcgtccgaggggggancgccacccgtcgtcctgcacagccaggtcacgtctatccgctgactggttacgccgtggtaccaggcaagaactcgtaggtaccaggtcctacccgaggtcctcctctacgtttaccgngacactccgacgacgggccacgtcggtctaccagacgtaggttacaggtggacggtggtatttcgggactagtcgttttcncgtcacctntacacgtccgtaccctacgagacgtagaacgtagttgttcgtacttagtttactttcgtacgaccagtactaattattaattacgtcgtacgtgcgttcgtacgttcggaccgtacggacgtaggtacggtaacgtacgaacgtacgtagtacggcgtacgaccgtactagtcgttagtaccttacg

SEQ ID NO: 212918 - DNA, 551 bp, Homo sapiens
  misc_feature: GYAE6OF02G58FK.21.27.C05.1.454.CMB.1.raw
  modified_base (202)..(202): a, c, t, g, unknown or other
  misc_feature (202)..(202): n is a, c, g, or t
  modified_base (398)..(398): a, c, t, g, unknown or other
  misc_feature (398)..(398): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaaacctggccaggctcccagtctcctcatctagtggggcatcctacaggatgaccggcactcccagacaggttcagtcgccagtgggtctgggacagacttcactctcacctatcaacacactggctcctgaagtntttgctagtgtaattactgtacagtatagtagtggtagtcaccgttactacgtttgaccgacggggaccagggtggagtacgtacgaggaacgtaacgtggtacgcgtacgccaccgtattccgttggtcctttacgtacttccgttaccccg

SEQ ID NO: 212919 - DNA, 616 bp, Homo sapiens
  misc_feature: GYAE6OF02IQWKO.21.27.C05.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
  modified_base (381)..(381): a, c, t, g, unknown or other
  misc_feature (381)..(381): n is a, c, g, or t
  modified_base (389)..(389): a, c, t, g, unknown or other
  misc_feature (389)..(389): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctggtaccagcaagaaatctggcaggctcccagctcctcatttaccgngcactccacgacgggccacgtggtctcccagaccgtaggttcaggtcgggcggttggtagtttgggactagtacgttttcnctcacctntcagccgccctacgagagtagaagtagtggtgacttagtttacttcgtcgtacctaagtactaattaattaacgttaaccgtggtaccgttaggtccgttaccgggtaaccggttaccggacccgtaaccggggtaaccgtaacgggtacggtaaacgtaaccggtaaaaccggaacgttaggtacgggtacttacggacctaccgtacttacgttcgtaccttacg

SEQ ID NO: 212920 - DNA, 595 bp, Homo sapiens
  misc_feature: GYAE6OF02G08US.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (308)..(308): a, c, t, g, unknown or other
  misc_feature (308)..(308): n is a, c, g, or t
  modified_base (391)..(391): a, c, t, g, unknown or other
  misc_feature (391)..(391): n is a, c, g, or t
tcagtcgtcgctcgcacgaccggtgctcgatttagacgcgatcgaagggtttgggggaggaactgctcaattaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaaatcgtggccaggcctcccgaggcctcctctattttacccggngcactcccaccgagggcccacgtggtcgtacccagactaggttcaggtggcgggttggtagtttggggactaggtagttttcnctcacctatcacgccgccctagagagtagaagtattggttgacgttagttttatttccgtgccagtactaaattattaacttacgtcggtcctggtccgttacgtaccggttcggacccgtacggggaaccgtaagggtagtaaacgtaccgtaaacggtactcgggttacggacgtacgccaaccgtacgtcgttcgtcttcc

SEQ ID NO: 212921 - DNA, 666 bp, Homo sapiens
  misc_feature: GYAE6OF02J29G2.21.27.C05.1.454.CMB.1.raw
  modified_base (353)..(353): a, c, t, g, unknown or other
  misc_feature (353)..(353): n is a, c, g, or t
  modified_base (629)..(629): a, c, t, g, unknown or other
  misc_feature (629)..(629): n is a, c, g, or t
tcagtcgtcgctcgcacgaccggtgctcgatttagacgcgatcgaagggtttggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcggcacgtacccctttcactcacctgtgacatcgtaccggggaaatgtcgctgtaacaatggttaggaattggattaggcacgtccccgtgagagtccttgagtggcgttggaaggtacctattactacgtcccagtggtanagaagactaagtgcgagtacttcgtgtgacggtcggttcgtcctaccactacgacccacccgacgtacaaccgttcaaaacggtactaccgtaacggtcctaccccttacccgtaaccttaagttccgtcgttaccgtacctaacccgttcccccggaacgtaaccgtaccggtaacgtttaacgtttttaacgttttaggaccgttacgaagggtaacggtactacgtactaacggtttccggactacccgtttaccgtacccgttacggtcccnccgggttacgggtaccgtacgggttaccgtttacccg

SEQ ID NO: 212922 - DNA, 586 bp, Homo sapiens
  misc_feature: GYAE6OF02GIWTE.21.27.C05.1.454.CMB.1.raw
  modified_base (202)..(202): a, c, t, g, unknown or other
  misc_feature (202)..(202): n is a, c, g, or t
  modified_base (395)..(395): a, c, t, g, unknown or other
  misc_feature (395)..(395): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcaagaaatcgtggccaggcctcccaggcctcctctactttaccgtgcactcccaccgagggcccacgtggtcgtcccaggactacggttcaggtgggcgggtgggtagtttcggggactaggttacgtttttccncttcaccctatccgacgtccgtaccctacagtagtagaagtagtgttgcttaagttttatttctcgtccagtactaaattattaacttacgtcgtcctcgtcgttcgtacggttcggaccgtaacggaccgtagggtagaaactacgaaacgtacgtagtcggtctcgacctaccgtatcgtcgttctacg

SEQ ID NO: 212923 - DNA, 525 bp, Homo sapiens
  misc_feature: GYAE6OF02HEYWT.21.27.C05.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (367)..(367): a, c, t, g, unknown or other
  misc_feature (367)..(367): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatccaccagggccactggtctcccagacaggttcagtggcggtggatttgggactagtagttttcnctcacatcagccgccctacagagtagaagattgttgctagtttattctgccagtcaattataattcgtgcctgcgttacgacgttcggacgaacgggtaccaaggtggaaactcgaaacgtactggtagccgtacgacctacctatccgtgtcttacg

SEQ ID NO: 212924 - DNA, 633 bp, Homo sapiens
  misc_feature: GYAE6OF02HGSBO.21.27.C05.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
  modified_base (397)..(397): a, c, t, g, unknown or other
  misc_feature (397)..(397): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcaagaaatctggccaggcctcccgaggcctcctctactttaccggngcactcccaccagggcccacgtgggtcgtccccagactaggttccaggttgggcgggttggtagttttgggggactaggtagtttttccncttacgacctattccacggtcccgaccctaacgaggacgttaggaagtagttggttagtacttaaggttttactttcgtcgtaccagtactaaattaattaaactttaccgtggtaccctggtccgttacgtaccggttcggaaccgtaaccgggaccgaagggtacggtaaacgtaaccgaaacgtaacgtacggtaggccgtacgaccgtaccttactcgttacgttacttacg

SEQ ID NO: 212925 - DNA, 668 bp, Homo sapiens
  misc_feature: GYAE6OF02IQ0MW.21.27.C05.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (260)..(260): a, c, t, g, unknown or other
  misc_feature (260)..(260): n is a, c, g, or t
  modified_base (306)..(306): a, c, t, g, unknown or other
  misc_feature (306)..(306): n is a, c, g, or t
  modified_base (399)..(399): a, c, t, g, unknown or other
  misc_feature (399)..(399): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgntgactggttancctggtaccngcagaaatctggccaggcctcccgaggtctcctctacgtttaccgngtccactcccaaccgacgggcctacgtggtcgtacccagacgtacggttcaggtcgggcggtggtaagtttcggggactaggttacgttttcncttacgacctagtcgtacgccgtccctacgacgtagtacgtaagtagttacgttgtacgttagtttactttacgttcgtaccgtacgtacgtaaattaagttaacgttacgttacggtaccgtcgtaccggttaccggttaccggttacggtaccggtaacgggtaaccggtaacggtaacggtaacggtaaacgtaaaccggtaacggtcgttaaaaacgggtcgttacgtaccgtaaccgtacgtacgttacgttacgtttaacccg

SEQ ID NO: 212926 - DNA, 699 bp, Homo sapiens
  misc_feature: GYAE6OF02JS345.21.27.C05.1.454.CMB.1.raw
  modified_base (204)..(204): a, c, t, g, unknown or other
  misc_feature (204)..(204): n is a, c, g, or t
  modified_base (423)..(423): a, c, t, g, unknown or other
  misc_feature (423)..(423): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacncgccaccctctcctgcacacgccagtcagtctatccgctgactggttacgccgtggtaccagacaagaaactctggaccaggcctcccgaggccctccgtctacgtttccgtgaccactccccaaccgacgggcccaacgtcggtccgtacccaaggtaccgtaggttcgaggtcgggccggttagggtagtttacggggactaggttacggttttccncgtaccgtaccctaagttaccgacggacccgtaccctaacggaggtaaggtacgtaagtacgttcggttacgtacgtttagttttcttacgttcgtaccgtagtaacttaattaacttacgttaccgtccggtaccgttcggtcccggttaccggtacggttaccggacccgggtaacgggtaaccggtagggtaacgtaaacgtaaccggtaaaccggtaacgtcgggtacggtaccacggtacctaccgtacgtttccgtacgttaccttaccg

SEQ ID NO: 212927 - DNA, 855 bp, Homo sapiens
  misc_feature: GYAE6OF02JPPN1.21.27.C05.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagacgcgatcgaagggtttgggggagggaactgctcagttaggacccagacggagccatggaagccccagcgcagcttctcttcctcctgcttctctggctccagacaccactggagtgattgtgatgacgcagtctccagccacctgtctgtgtctcgaggggggncgccaccctctcctgcacgacgccagtcagtctatcgctgacttggtacgcctggtaccagacagaactctaggcaggctcccgaggcctcctctacgtttaccgtgcctacgtcccaccgaacgggccctacgtgggttaccgcccgaggtaaccgaggtttccgaaggggtttcgggtaaccggggttgggttaagtttaccggggggaacttaacggggtttaacgttttttcccgaccgtttacccgtaacccgtacgttaccgtaaccgggtcccggttaccccgttaaacgaacggttaacgggttacgggaaacggttacgtttacgggttaaggtccgtttaaacggtttttaacgtttttcccggacggttacctacgggttaacctaaagggtttaaacctttaacgtttaacccggtttcggggtacccgtttagggtacccggtttaccgggttaacccgggtttcgggtaaaccccgggtaaaccgggggtaacccggttaaacggggtttaaaccgggtaaacggttaaaacccggttaaaaaccggtaaacgggttaccgggttaaccgggtacggtttacccgaaaccggtaccgttaacccggtttaacccggtttacggtttaccccgttttaaccg

SEQ ID NO: 212928 - DNA, 606 bp, Homo sapiens
  misc_feature: GYAE6OF02G8B33.21.27.C05.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
  modified_base (386)..(386): a, c, t, g, unknown or other
  misc_feature (386)..(386): n is a, c, g, or t
  modified_base (419)..(419): a, c, t, g, unknown or other
  misc_feature (419)..(419): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccgaggcctcctctatttaccgngcactcccaccagggcccacgtgggtcgtcccagactaggttcaggtgggcggtggtatttggggactaggttacgttttcncttcacctatcagccgcctagagagtagaagtntgttgacttagtttactttctgcctagtactaattaattaattacgtcggtccttggtccgttacgtaccggttccggacccgtaccgggaaccgtaagggttacggaaacgttaccgaaaacggtaccgttaggtacggtaccgttacggaccgtaaccgtacgttaccgttcgttaccgttaccg

SEQ ID NO: 212929 - DNA, 852 bp, Homo sapiens
  misc_feature: GYAE6OF02JZBML.21.27.C05.1.454.CMB.1.raw
tcagtcgtcgctcgcacgaccggtgctcgatttagacgcgatcgaagggtttgggggcgagagcctgctgacttctggctgaccagggcagtcaccggagctccagacaatgtctgtctccttctcatcttcctgcccgtgctgggcctcccgatggggtgtcctgtcacagatcaaactacgagcagtctggtccaggactgggtgacggcccctgccacgtacccctttcaccgttcaccttggtacgactagtccgtaacccgggggaaaattcggtcgcgttggacaacgaagttagggttggtaaatttgggaactttagggacctacggttacccccggtacggaaggtacggtcccttagggtacggtaggtccgttaaggggtaacggtaaacccttaagttttacggtaaaccccggttccccgaaggtttacgggtaaacgttggaaaacggtaccttaagtcggtaccgaaaggttactttaccgtgggtttacggaaacgggttccgggttaccggttccctacgtacccgtacgtaccccgtaacccccgaacggtaaccctaaccggttaacccgaaaacggtaaccgttacccgtaacgggttacccttaccccggttaacccctaaccgttaaaccgttcgttaccgttccgttacctaaccccgttacccggaaccgtacccggtaaccggtcctttaaacggttttaacttttggacgtacgtaacggtacgggtcttaccgaacgttacgttacccgggtactaacccgtttacccgttacccgttaacgtcccggttaccggtacggggtacccgtaaggggtttaacccgg

SEQ ID NO: 212930 - DNA, 662 bp, Homo sapiens
  misc_feature: GYAE6OF02GZ78W.21.27.C05.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
  modified_base (399)..(399): a, c, t, g, unknown or other
  misc_feature (399)..(399): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgcccaccctctcctgcacagccagtcagtctatcgctgactggttagcctggtaccagcagaaatctggccaggcctcccgaggtcctcctctactttaccgngcctactcccaccgagggcccacgtcgggtcgtaccccaggacctaggttcaggtgggcggtggtacgtttggggactaggtacgttttccnccgtaccaccatccgacgccgtaccctacgaggagtggaagtagttggttcgacttagttttactttccgtcgtaccgtagactaaagttattaaacgttaccgtcggtcccttggtccgttaccggtaccggttccggacccgtaaccggggtaacccgtaaggggttaacggtaaaaccgttaaccggaaaaccggttaacggttacgggtacggtaccgttacggacctaacccgtacgttccgttacgttaccttaccg

SEQ ID NO: 212931 - DNA, 591 bp, Homo sapiens
  misc_feature: GYAE6OF02IOZDR.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtatatcgctgactggttancctggtaccagcagaaatctggccaggctcccaggctcctcatttaccgtgccatcccaccgacgggcccacgttggtcgtcccagacaggttcaggtgggcggtggtagtttggggactaggtacgttttctctcacctatcacgccgaccctacaggacgtgaaagtagtggttgacttaggttttatttctgaccctaagtactaaattaattaacgtttaccgtcggtccttggtccgttaccgtaccggttccggacccgacgggtaccgagggttacggtaaacgtcgaaaacgtacgtcggtacggtactcgacaccgtatcgtgttcttaccg

SEQ ID NO: 212932 - DNA, 612 bp, Homo sapiens
  misc_feature: GYAE6OF02JZA2N.21.27.C05.1.454.CMB.1.raw
  modified_base (239)..(239): a, c, t, g, unknown or other
  misc_feature (239)..(239): n is a, c, g, or t
  modified_base (512)..(512): a, c, t, g, unknown or other
  misc_feature (512)..(512): n is a, c, g, or t
tcagtcgtcgctcgcacgaccggtgctcgatttagacgcgatcgaagggtttgggggcgagagcctgctgacttctggctgaccagggcagtcaccggagctccagacaatgtctgtctccttcctcatcttctgcccgtgctgggcctcccatggggtgtcctgtcacagatcaaactacagcagtctggtccagggactgggtgaggcccctcgcacgaccctttcactcaccttgngacatcgtaccggggaaatgtcgctggcaacatggttaggaatgggattaggacacgtccccgtgagacggccttgagtggcttaggaaggacctagttacacgtccagttggatgaagtactagtgacagattcgtagtgagtcgtagtctccacacgtacacccgagacaccgtaccgaagactacgagtccgtaccctaccaaccttactacgtcgttacgtcctaccgtacccgacgaccgaaccgtcgttaacgtttagtttttacgngtaccgtaaggtacggtattaccgaacttagttccggtacgtaaccttacccgttaccttcggaacctttccggtacgggttcccgaagggtttaaccgg

SEQ ID NO: 212933 - DNA, 588 bp, Homo sapiens
  misc_feature: GYAE6OF02H8G22.21.27.C05.1.454.CMB.1.raw
  modified_base (204)..(204): a, c, t, g, unknown or other
  misc_feature (204)..(204): n is a, c, g, or t
  modified_base (252)..(252): a, c, t, g, unknown or other
  misc_feature (252)..(252): n is a, c, g, or t
  modified_base (388)..(388): a, c, t, g, unknown or other
  misc_feature (388)..(388): n is a, c, g, or t
  modified_base (428)..(428): a, c, t, g, unknown or other
  misc_feature (428)..(428): n is a, c, g, or t
tcagtcgtcgctcgcacgaccggtgctcgatttagacgcgatcgaagggtttggggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgccacagccagtcagtctatcgctgactggttancctggtaccagcaagaatcgtggccaggcctcccgaggcctcctcacttttaccggcactcccaacgagggcccagtgggtctcccagactaggttcaggtgggcggtggtagtttggggactaggtatttttccnctacacctatcgacgcccgtacctagaggtagtagaagtnttggttcgtacgtttaagttttacttcgcgacctagtactaaattattaacgttcgcggtcctggtccgtacggtacggttcggaaccgaacgggtactaagggtacgtaaactacgaaacgtagtggtacgactacgacctacctattccgttgtcctc

SEQ ID NO: 212934 - DNA, 620 bp, Homo sapiens
  misc_feature: GYAE6OF02H0P65.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttctcatcttcctgcccgtgctgggcctcccatggggtgtcctgtcacagatcaaactacagcagtctggtccaggactggtgacggccctcgcacgaccctttcactcacctgtgacatccgtaccggggaaaatgtcgctggacaacgtaagtggttaggaattggagttaggacgacggtccccgtggaggacggtccgtggaggtggcgtttagggaagtaccgtattactacgtccgtagtggtatgaacgtactagtgacagtattcgtgtgacggtcggtcgtctacacactccacccagacctacgtaccaagactcgacgttcctaccctacctaactatcgtctcgtactacccgtaccgacgtacgtacgtacttagttttacgtttcgacgtacgtaacggtaggtactacgtacgttacgttcggtacgttaccgtaccgttccgttacgtaccgttacccgggtcgggtaccgtaagggttaccgg

SEQ ID NO: 212935 - DNA, 583 bp, Homo sapiens
  misc_feature: GYAE6OF02HOT6M.21.27.C05.1.454.CMB.1.raw
  modified_base (203)..(203): a, c, t, g, unknown or other
  misc_feature (203)..(203): n is a, c, g, or t
  modified_base (388)..(388): a, c, t, g, unknown or other
  misc_feature (388)..(388): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcaagaaatctggccaggctcccgaggcctcctctacgtttaccgtgcctactcccaaccgagggcccacgtgggtcgtcccagactaggttcagtgggcggtggtagtttgggactagtagttttcnctcactatcagcgccctagagagtagaagatgtgcttagtttacttcgtcgacctagactaaatattaacttacgtggtcctggtacgtcgtaccggttcggaccgaacgggtaaccgtaagggtacggtaaacgtacaaacggtacgtaggtacggacgttacgaccgtacctacgttaccttgttaccttacg

SEQ ID NO: 212936 - DNA, 543 bp, Homo sapiens
  misc_feature: GYAE6OF02HE1Y0.21.27.C05.1.454.CMB.1.raw
  modified_base (203)..(203): a, c, t, g, unknown or other
  misc_feature (203)..(203): n is a, c, g, or t
  modified_base (375)..(375): a, c, t, g, unknown or other
  misc_feature (375)..(375): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggctccaggctcctcatttacccgtgcatccaccgagggcccacgtggtcgtcccagactaggttccaggtgggcggtggatttgggactagtagttttcnctcacctatcagccgccctacgagagtgaagatgttgctagtttatttctgccagcaattataatttactggtcctggtcgttccgtacggttccggaccgacgggacctagggtagaaacgtaccgaaacgtaacgtgtacggtctacgacacctatctgtcttacg

SEQ ID NO: 212937 - DNA, 577 bp, Homo sapiens
  misc_feature: GYAE6OF02F34B8.21.27.C05.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatcgtggccaggctcccgaggcctcctcactttaccggngccactcccaccgagggcccacgtcgggtcgtcccagacctaggttcaggtggcggtggtagtttgggactaggtagttttctccgttcacctactcacgccgtccctaacgagtagtagaagtagttgttgacttaagtttactttctcgcctagactaataattaattacgtcggtcctagtccgtacgtacgttcggacgaacgggaccgtaggtagaaacgtcgaaaccgtacgtcgtaggacgtgaccacgtatcgtcgtcttaccg

SEQ ID NO: 212938 - DNA, 666 bp, Homo sapiens
  misc_feature: GYAE6OF02JA38R.21.27.C05.1.454.CMB.1.raw
  modified_base (204)..(204): a, c, t, g, unknown or other
  misc_feature (204)..(204): n is a, c, g, or t
  modified_base (437)..(437): a, c, t, g, unknown or other
  misc_feature (437)..(437): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacncgccacctctccgtgccacgacgccagtcagtctatcgctagacgttggttacgccgtaggtaccagacaagaactcgtcggaccgaggcctacccgaggtcctcctacgtacgtttaccgcgacctactcccgaaccgacgggccctacgttcggtaccgtacccgaagtacgtacggttcgagggtcgggtacgggttaggtacgttacgggaactaggttacgttttccnctaccacgtactaccgacgtacgtacgtaggacgtaccgtagtaacgttagtttacgacgtagttagttacttacgtagtacgacgtacgtagttagtaggtacgtacctacctaccgttacctagttacgtacgttacgttacggaccggtacgggtaaccgtaagggtaacgtaaactacggtaaacgtacgttaggtacggtactacgaccgtactacgttcgtcg

SEQ ID NO: 212939 - DNA, 506 bp, Homo sapiens
  misc_feature: GYAE6OF02GCPH1.21.27.C05.1.454.CMB.1.raw
  modified_base (202)..(202): a, c, t, g, unknown or other
  misc_feature (202)..(202): n is a, c, g, or t
  modified_base (249)..(249): a, c, t, g, unknown or other
  misc_feature (249)..(249): n is a, c, g, or t
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
  modified_base (368)..(368): a, c, t, g, unknown or other
  misc_feature (368)..(368): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttancctggtaccagcagaaatctggccaggctcccaggctcctcatttaccgngcatccaccagggccactggtntcccagacaggttcaggtggcggtggatttggggacagtagttttcnctcaccatcagcgccctacagagtgaagatgttgctagtttattctgccagcaataattaattactggcctgcgttcgacgttcggccacgggaccaggtagaaatacgaaacgaactgtgctgcaccatctgtcttc

SEQ ID NO: 212940 - DNA, 705 bp, Homo sapiens
  misc_feature: GYAE6OF02JRZRM.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
tcagtcgtcgctcgcacgaccggtgctcgatttagacgcgatcgaagggtttgggggaggaacgtgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtacncctggtaccagcagaaatctggccaggctccgaggcctcctctacttaccgtgccactcccaccgtagggccctaacgtgggttacgtccccaggacctacggttccaagggttcgggccggttgggtaattttcgggggaactaggttacgtttttcaccgttacaacccgtaatttccgaccggtacccgtaccccgttacgtaacgggaacggttacggaaaacgtacgttacggttttacgacctttaagggtttttaacttttccgtacggtacccgtaaggtacctaaagttaacgtttaaactttaccgttacgggtacccttaggtcccgttaaccgtacggttaccggaccggtaaaccgggtaccggtaagggtacggtaaacgtccgtaaaacggtacgttaacggtcggtactacggacctaccgtatcgttacgtccttacg

SEQ ID NO: 212941 - DNA, 552 bp, Homo sapiens
  misc_feature: GYAE6OF02HY23D.21.27.C05.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (390)..(390): a, c, t, g, unknown or other
  misc_feature (390)..(390): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgcccaccctctcctgcacagccagtcagtctatcgctgactggttagcctggtaccagcagaaatctggccaggctcccaggctcctcatttaccgngccatccccaccaggggcccacgttgggtcgtcccaggacctaggttccaggttgggcggtggtatttggggactaggtagtttttccnctcacctatcgagccgccctacagagtgaagatggttgacttagtttatttctgccaagtctaaattattaaatttaccgtgggtacctgtcgttcgacggttcggaccgaacgggaccaagggtcgaaatcgaaacgactgtagctgccaccatctgtctc

SEQ ID NO: 212942 - DNA, 522 bp, Homo sapiens
  misc_feature: GYAE6OF02F1GX8.21.27.C05.1.454.CMB.1.raw
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
  modified_base (485)..(485): a, c, t, g, unknown or other
  misc_feature (485)..(485): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcacatggtggattggattaggcagtccccgtgagaggcttgagtggcttggaaggacctattatacgtcccagtggtatgaagactatgcagattctgtgagcggtctctcaccatcaccccagaccacgtccaaagaactcaggtcctccctccacctaactgtcctgtacacctcccgacgaccacggctagtttattttgngcaagnggancacattcggtnactacctccttgacctccgtgggaccagggttaaccg

SEQ ID NO: 212943 - DNA, 898 bp, Homo sapiens
  misc_feature: GYAE6OF02J3RG9.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttctcatcttctgcccgtgctgggcctcccgagttgggggtctcccgtgtaccaacgagtactaaccaaaacctacgacgtcgtacggttccgttccggtaccgaagggtacgttcgggtacggacccggtcccgtccgacgtacccgttaccctttcacctacctaccgttggtacactacgttacccgggtaaaccgggtaattccggtacgtcgtacgaacctaacgttaggtttagggttaaggttaagttaggtacgttacggaccttacccggtaccccggtaggtacggtacggtccgttaggtacggtcggttaacggtacgggaaccgtaacttaattaccggtaccgtaccgtaggttacggtaagacgtaaacgtattacggtccgtaacgtaacgttcgttacgtacggttacgggaccgggttcccggtacgttcccgtaacccgaaccgttaccgaccccgtaacccgaacggtaaacccgtaccggtaaaccgaaacgtttaccgtaaccggtccgttaccccgttaaccctaaccgtaaacgttcgttccgtaccgtaccgttaacccgtacccgtaaccccggagttaacccggttaccggtttagtttttaacggtttttacgttacggaccgtaacgggaacggtccgttactaaccgtaaccggtttcgtaaccgggttacctttaacccgtacccgtttcgggttacccgaccccgggtttacgggtaccggggtaaccggtttaacggtttcccgg

SEQ ID NO: 212944 - DNA, 585 bp, Homo sapiens
  misc_feature: GYAE6OF02HKIKI.21.27.C05.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
  modified_base (395)..(395): a, c, t, g, unknown or other
  misc_feature (395)..(395): n is a, c, g, or t
  modified_base (430)..(430): a, c, t, g, unknown or other
  misc_feature (430)..(430): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctggtaccagcaagaaatctggccaggcctcccgaggcctcctctactttaccgngcactccaccgagggcccacgtggtcgtacccagaccaggttcaggttcgggcggttagggtagtttggggactaggttacgttttcnctccactatcgacgccgccctagagagtagaagtnttgttgacttagttttactttctcgaccagtactaaattattaattacgtcggtccttggccgttacgtacggttcggacgaacgggaccgagggtacgaacgtaacgaaacgtacgtggtacggactcgacctaccgactcgttcgttcttacg

SEQ ID NO: 212945 - DNA, 586 bp, Homo sapiens
  misc_feature: GYAE6OF02HSOPV.21.27.C05.1.454.CMB.1.raw
  modified_base (205)..(205): a, c, t, g, unknown or other
  misc_feature (205)..(205): n is a, c, g, or t
  modified_base (224)..(224): a, c, t, g, unknown or other
  misc_feature (224)..(224): n is a, c, g, or t
  modified_base (357)..(357): a, c, t, g, unknown or other
  misc_feature (357)..(357): n is a, c, g, or t
tcagtcgtcgctcgcacgaccggtgctcgatttagacgcgatcgaagggtttgggggcgagagcctgctgacttctggctgaccagggcagtcaccggagctccagacaatgtctgtctccttcctcatcttcctgcccgtgctgggcctcccatgggggtgtcctgtcacagatcaaactacagcagtctgtccaggactggtnaggccctgcagaccctttnactcacctgtgacatcgtacggggaaaatgtcgctggcaacaatggttggaattggattaggcagtcccccgtgagacggccttgacgtggcttggaagacctatatacgtcccagtgtatgaagactatganacgattctgtgagtcggcgtctacacatccaccccaggacacgtcaagaatctaatgtacctcctcctaactaatcgtcttagtccaaccttcccgacgaccacgggacttagttttaacttttgacgtacgtaagacggggtactcaaccgtagttaccgggttaccgtaaccttaccccgtttccgtttacgtaaccccgtttcgggtaccggaccggtaacggggg

SEQ ID NO: 212946 - DNA, 637 bp, Homo sapiens
  misc_feature: GYAE6OF02FQFFD.21.27.C05.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcaagaaatctggccaggcctcccgaggcctcctcactttaccgngcactccaccgacgggccacgtggtcgtcccagactaggttcaggtgggcggtagggtagtttggggactaggttacgtttttctcgtaccacctatccaccgaagtaccgttagggacgtacccgttaggtaaacgttagttttacggactaggttagtttaatttacgttggttacgagtcgtaagttagttggtacgtcctaccgtacccttaccctattacgtacttacgtttcgggaccgtacggggtaaccgtaagggttacggaaacgttaccgaaaaccgtacgttaggtacggaccgtacgaccctaccgtacgttcgttacg

SEQ ID NO: 212947 - DNA, 502 bp, Homo sapiens
  misc_feature: GYAE6OF02FH4QI.21.27.C05.1.454.CMB.1.raw
  modified_base (202)..(202): a, c, t, g, unknown or other
  misc_feature (202)..(202): n is a, c, g, or t
  modified_base (249)..(249): a, c, t, g, unknown or other
  misc_feature (249)..(249): n is a, c, g, or t
  modified_base (300)..(300): a, c, t, g, unknown or other
  misc_feature (300)..(300): n is a, c, g, or t
  modified_base (368)..(368): a, c, t, g, unknown or other
  misc_feature (368)..(368): n is a, c, g, or t
  modified_base (387)..(387): a, c, t, g, unknown or other
  misc_feature (387)..(387): n is a, c, g, or t
  modified_base (494)..(494): a, c, t, g, unknown or other
  misc_feature (494)..(494): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttancctggtaccagcagaaatctggccaggcctcccaggctcctcatttaccgngcatccaccagggccactggtcgtcccagacaggttcagtggcggtggatttgggacagtagttttcnctcaccatcagcgccctanagagtgaagtatgttgactagttttattctgccagctaatataatactggcctgcgtcgacgttcggccgacgggaccaggtagaatcaaacgactgtgctgcaccntctgtctc

SEQ ID NO: 212948 - DNA, 742 bp, Homo sapiens
  misc_feature: GYAE6OF02GWDYV.21.27.C05.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagaccaccactggagtgattgtgatgacgcagtctccagccaccctgtctgtgtcctccggagggggganccgccaccctctcctgcacagccagtcagtctatcgctgacttggttacgccgtcggtaccagacaaggtaaacttcgtcggaccgacggtccctccccgacggtcccttaccgtacctaacgttttacccggtcgacctactccccgaacccggaacgggtccctacgttcgggtccgtacccgagtaccgtacggtttcgagggttcgggtcggttggtaggtttcgggactagtttacgttttcctacctaccgacctactcgacgaccgtaccctacgacggagtagaacgtagttggtagtacgttagtttactttcgttacgactaagtactaaattaacttaaacttaccgttcggtaccgttcggttaccgggttaccgttaccggttacccgggtaccgggtaaaccggggtaaccgtaaggggttaaccggtaaacgtaaaccggtaaaaccggttaaccggtacggtacgggtaccgtacggtacccgtaaaccgttacgttccgttacgttaccgtttaacccg

SEQ ID NO: 212949 - DNA, 551 bp, Homo sapiens
  misc_feature: GYAE6OF02H8LCW.21.27.C05.1.454.CMB.1.raw
  modified_base (300)..(300): a, c, t, g, unknown or other
  misc_feature (300)..(300): n is a, c, g, or t
  modified_base (367)..(367): a, c, t, g, unknown or other
  misc_feature (367)..(367): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggcctcctcatttaccgngcactccaccagggccactggtgtcccagacaggttcagtggcggtggatttgggactgagttttcnctcactatcagccgccctacagacgtgaagatggttgcgtagttttactttcgtagcctagactaattaattaactttacgtggtccttagccgttcgtacgttcggaccgaacgggaccgagggtaggaaacgtacgaaaccggtacgtggtaggtctaggaccacctacgtcttcgtcttac

SEQ ID NO: 212950 - DNA, 591 bp, Homo sapiens
  misc_feature: GYAE6OF02GW38G.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaaatgtcgctggcaacaatggttggaattggattaggcagtccccgtcgagacggccttggagtggcttggaaggactattatacgtcccagtggtatgaagactatgcagattctgtgagcggtcgtctcacatccacccagacacgtaccaagaactcgacggtcctaccctccgaacctatcgtctcgtccacctcccgacgaccacggtcttagttttacttttgacgtacgaaggtacgggtactacgtaacgtaacgtttccgggtacgtaaccgttacccgttccgtttacggtaccgttcccggtcggggtacccgtacggggtttaacccgg

SEQ ID NO: 212951 - DNA, 552 bp, Homo sapiens
  misc_feature: GYAE6OF02IQ297.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaatggtggaattggattaggcagtccccgtgagaggccttgagtggcttgggaaggtacctattatacgtcccagtggtatgaagactatgcagatctgtgagcggtcgtctcaccatccaccccgagaccacgtaccaagtaatcgacggtcctccctaccacctaatcgtctgtccactcccgacgaccacggctagttttatttgacgacgaagaggtatcgactagttcggacgtaccttaccgttcttacgaccttccggtcgggaccgtagggttaaccgg

SEQ ID NO: 212952 - DNA, 547 bp, Homo sapiens
  misc_feature: GYAE6OF02GJ9W9.21.27.C05.1.454.CMB.1.raw
  modified_base (358)..(358): a, c, t, g, unknown or other
  misc_feature (358)..(358): n is a, c, g, or t
  modified_base (479)..(479): a, c, t, g, unknown or other
  misc_feature (479)..(479): n is a, c, g, or t
  modified_base (541)..(541): a, c, t, g, unknown or other
  misc_feature (541)..(541): n is a, c, g, or t
tcagtcgtcgctcgcacgaccggtgctcgatttagacgcgatcgaagggtttgggggaagaggaagactgacggtcctgccacaggtggtgctgggcacggtgggccctcgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtcgtctcaccatcaccccagacacgtccaagaatcaggtctccctcacctaatgtctgtcactcccgacgacacggcagtttattttgngcaagagggatcacattcgtgactacctcttgactcctgggccagggacttgtcaccgtctcctcacgcctccaccaagggcccatccggtcttcccctggccgccctcgcctccacggcncaccctccgacgacgcacacgccggccctcgggcctcgcccgtggtccaaggctaccttccngtacgg

SEQ ID NO: 212953 - DNA, 597 bp, Homo sapiens
  misc_feature: GYAE6OF02IPXDE.21.27.C05.1.454.CMB.1.raw
  modified_base (202)..(202): a, c, t, g, unknown or other
  misc_feature (202)..(202): n is a, c, g, or t
  modified_base (311)..(311): a, c, t, g, unknown or other
  misc_feature (311)..(311): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggnccgccaccctctcctgcacacgccagtcagtctatcgctgacttggttagcctggtaccagcaagaaatcgtggccaggcctcccgaggtcctcctctacgtttaccgngacactccaccgacgggcccagtcggtcgtcccgagaccgtaggttcaggttggcgggtggtagtttcggggactaggtttacgtttctcctacaccctatccgacgcccgaccctacgagagtagaagtattggtactcgttagttttacttcgtcgacctacgtactaaattattaacttacgttcggcctcggtcgtcgttaccggttccggacccgtacgggaaccgtagggacggtaaactacgaaacgtacgtgacgctacgcaccgtatctcgtctacg

SEQ ID NO: 212954 - DNA, 522 bp, Homo sapiens
  misc_feature: GYAE6OF02GZN4X.21.27.C05.1.454.CMB.1.raw
  modified_base (428)..(428): a, c, t, g, unknown or other
  misc_feature (428)..(428): n is a, c, g, or t
  modified_base (460)..(460): a, c, t, g, unknown or other
  misc_feature (460)..(460): n is a, c, g, or t
  modified_base (506)..(506): a, c, t, g, unknown or other
  misc_feature (506)..(506): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaatgtcgctggcaacaatggttggaattggattaggcagtccccgtcgagaggccttgagtggcttggaaggacctatatacgtcccagtggtatgaagactatgcagattctgtgagcggtcgtctcacatccaccccagacacgtccaagatcagtctccctcctacctaatgtctntcactcccgacgacacggctagtttattttgngtcagaggatacactacttcggtgtacttacctcttgaccttccgngggtccagggttaccg

SEQ ID NO: 212955 - DNA, 507 bp, Homo sapiens
  misc_feature: GYAE6OF02HQ5VA.21.27.C05.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
  modified_base (372)..(372): a, c, t, g, unknown or other
  misc_feature (372)..(372): n is a, c, g, or t
  modified_base (394)..(394): a, c, t, g, unknown or other
  misc_feature (394)..(394): n is a, c, g, or t
  modified_base (422)..(422): a, c, t, g, unknown or other
  misc_feature (422)..(422): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgngcatccacagggccagtggtcgtcccagacaggttcaggttggcggtggtatttggggactagtagttttcncgtccaccatcagccgccctanagagtgaagatgttgctagtttatttcngtccagctaatataattactgcctgcgtcgacgttcgccgacgggacaggtaggaatcgaaacgatgtagctgcacatctgtctc

SEQ ID NO: 212956 - DNA, 542 bp, Homo sapiens
  misc_feature: GYAE6OF02F7B2Y.21.27.C05.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (376)..(376): a, c, t, g, unknown or other
  misc_feature (376)..(376): n is a, c, g, or t
  modified_base (398)..(398): a, c, t, g, unknown or other
  misc_feature (398)..(398): n is a, c, g, or t
  modified_base (428)..(428): a, c, t, g, unknown or other
  misc_feature (428)..(428): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctntcctgcacagccagtcagtctatcgctgactggttagcctggtaccagcagaaatctggccaggcctcccaggctcctcatttaccgtgcatccaccagggccacgtggtcgtcccagactaggttcaggtgggcggtggtagtttgggactaggtagttttcnctcaccatcgacgccgccctanagagtgaagattgttgctagtttatttcgngcctagctaattattaattacgtcggtcctgcgttcgtacggttcggacgaacgggacagggtagaaactcgaaacgtacgtagtcggtactcgacaccgtatcgtgtcttacg

SEQ ID NO: 212957 - DNA, 637 bp, Homo sapiens
  misc_feature: GYAE6OF02JO54O.21.27.C05.1.454.CMB.1.raw
  modified_base (203)..(203): a, c, t, g, unknown or other
  misc_feature (203)..(203): n is a, c, g, or t
  modified_base (252)..(252): a, c, t, g, unknown or other
  misc_feature (252)..(252): n is a, c, g, or t
  modified_base (307)..(307): a, c, t, g, unknown or other
  misc_feature (307)..(307): n is a, c, g, or t
  modified_base (403)..(403): a, c, t, g, unknown or other
  misc_feature (403)..(403): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggacncgcccaccctctcctgcacagccagtcagtctatcgctgacttggttancctggtaccagcagaaatctggctaggctcccgaggcctccgtctactttaccgngccactcccaaccgagggccctacgtcggtcgtacccgagacctaggttccaaggttcgggcggttaggtatttcggggactagttagtttttccncgtacacctatcgacgccgtaccctagacgacgtagaagtagttcgttagtacttagttttactttctcgaccgtaagtactaaattaacttaacttacgtcggtaccttacggtaccgttacgtaccggttccggacccgtaacgggtaaccgtagggtaacgtaaacgtaacgtaaacgtacgttcggtacgtacgtacgaccgtaccgtacgttacgttacgttccgttac

SEQ ID NO: 212958 - DNA, 589 bp, Homo sapiens
  misc_feature: GYAE6OF02HJMBX.21.27.C05.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggctaggctcccaggctcctcatttaccgngcactccaccgagggccacgtggtctcccagacaggttcagtggcggtggagtttgggactagtagttttctctcacctatcagtccgaccctacgagtagtagaagtattgttgacttagtttactttctcgacctagactaaattaattaacgttaccgtacggtccttggtaccgttaccggtaccggttccggacccgtaccgggaaccgtaagggtagtaaacgtaccgaaaccggtaacgtggtacggacgttgacccacctatttccgtcgttaccttaccg

SEQ ID NO: 212959 - DNA, 541 bp, Homo sapiens
  misc_feature: GYAE6OF02I6XCB.21.27.C05.1.454.CMB.1.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (368)..(368): a, c, t, g, unknown or other
  misc_feature (368)..(368): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggctaggctcccaggctccnctatttaccgngcatccaccngggcccagtggtcgtcccagacaggttcaggtggcgtggatttgggactgtattttcnctnaccntcagccnccctanagagtgaagntgttgacttagttttatttcngccagtaccaaattataattctggtcctgcgttcgacggtttccgacctacgggacctagggtaggaaacgttacgaaacgacgttggtacggtcgtacgccactactcgttacgtcttacc

SEQ ID NO: 212960 - DNA, 714 bp, Homo sapiens
  misc_feature: GYAE6OF02JRTXB.21.27.C05.1.454.CMB.1.raw
  modified_base (174)..(174): a, c, t, g, unknown or other
  misc_feature (174)..(174): n is a, c, g, or t
  modified_base (209)..(209): a, c, t, g, unknown or other
  misc_feature (209)..(209): n is a, c, g, or t
  modified_base (249)..(249): a, c, t, g, unknown or other
  misc_feature (249)..(249): n is a, c, g, or t
  modified_base (263)..(263): a, c, t, g, unknown or other
  misc_feature (263)..(263): n is a, c, g, or t
  modified_base (272)..(272): a, c, t, g, unknown or other
  misc_feature (272)..(272): n is a, c, g, or t
  modified_base (320)..(320): a, c, t, g, unknown or other
  misc_feature (320)..(320): n is a, c, g, or t
  modified_base (422)..(422): a, c, t, g, unknown or other
  misc_feature (422)..(422): n is a, c, g, or t
tcagtcgtcgctcgcacgaccggtgctcgatttagacgcgatcgaagggtttgggggagggaacgtgctcagttaggacccagacggagccatggaagccccagcgcagcttctcttcctcctgcttctctggctacccacgacaccactggagtgattgtgatgacgcagtcnccagccaccctgtctgtgtctcccgaaggggggcncgcccgaccctctcctgccacacgccagtccagtccttancgctgactggtacncgtggaccngcagaactgtggccgtgacctcccgagacctcctactacgtttaccgngacctactcccaaccgacgggacctacgtcggtcgcccgaagacctaggttccaggtcggcgggtggttacgtttacgggggactgggtaacgttttttccncgtttaccgactattccgacggtacccgacccgttaccgtaacgtacgggttaaggaaccggttaagttccgggttagtaccgttaacgtttttaacggttttcctaacggtaccgttaaacgaccgtttaaagttaacgtttaaagtttacccgtacgggtttacccgttggtaccgggtttaccgtaacgggttccgaaccggtaacggtaaccggtaggtacgggtaacctaacgaacggttaacgtacggtacgtacgtaccgtacgactacttacggttcctgttac

SEQ ID NO: 212961 - DNA, 527 bp, Homo sapiens
  misc_feature: GYAE6OF02H9OLU.21.27.C05.1.454.CMB.1.raw
  modified_base (204)..(204): a, c, t, g, unknown or other
  misc_feature (204)..(204): n is a, c, g, or t
  modified_base (303)..(303): a, c, t, g, unknown or other
  misc_feature (303)..(303): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (510)..(510): a, c, t, g, unknown or other
  misc_feature (510)..(510): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggggancgccaccctctcctgcacagccagtcagtctatcgctgactggtagcctggtaccagcaagaaatctggccaggctcccaggcctcctcattttaccgngcatccccaccgagggccacgtggtcgtcccagaccgaggtttcaggtgggcggttggatttggggaactggtagttttcnctcaccatcagcnccctangagtgaagatgttgctagtttatttctgccagctaaatataacttacgtgcctgcgtcgacgtcggaccgacggaccaaggtcggaaatcgaaacgtacgtgtcggntcgcaccatctgtcttc

SEQ ID NO: 212962 - DNA, 647 bp, Homo sapiens
  misc_feature: GYAE6OF02IS3DJ.21.27.C05.1.454.CMB.1.raw
  modified_base (202)..(202): a, c, t, g, unknown or other
  misc_feature (202)..(202): n is a, c, g, or t
  modified_base (250)..(250): a, c, t, g, unknown or other
  misc_feature (250)..(250): n is a, c, g, or t
  modified_base (309)..(309): a, c, t, g, unknown or other
  misc_feature (309)..(309): n is a, c, g, or t
  modified_base (403)..(403): a, c, t, g, unknown or other
  misc_feature (403)..(403): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgcacacgccagtcagtctatcgctgactggtancctggtaccagacaagaaatcgtggccaggcctcccgaggcctcctctacgtttaccgngcctactcccaccgacgggcccacgtcgggtctaccccgagaccgtaggtttcaggtcgggcggttaggtagtttgggactagttacgttttcnctacacctagtcgacgtcccgaccctacgaggtaggtagaagtagttcggttcgtacgtttagttttactttcgtcgtacctagtactaattaattaacgtttacgtacgtccgttggtccggttaccggtacgggtttccggaacggtaaccggggaaccgtagggtaacgtaaacgtaccgtaaaacgtacgttaggtacggtacgtacggacctaaccgtagttccgttacgttccttacg

SEQ ID NO: 212963 - DNA, 570 bp, Homo sapiens
  misc_feature: GYAE6OF02I52FW.21.27.C05.1.454.CMB.1.raw
  modified_base (201)..(201): a, c, t, g, unknown or other
  misc_feature (201)..(201): n is a, c, g, or t
  modified_base (303)..(303): a, c, t, g, unknown or other
  misc_feature (303)..(303): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggancgccaccctctcctgcacagccagtcagtctatcgctgactggttagcctggtaccagcaagaaatcgtggccaggcctccaggcctcctctactttaccgngcactccaccgagggcccacgtcggtcgtcccaagaccgtaggttcaggtcgggcggttaggtagtttgggacagttgttttcactccacctatccgagcccgaccctacgaggagtagaagagttgtgtacttagtttactttcgtcgtccaagtctaaattaattaacttacggtcgtcctggtcgtcgtacggttccggaccgacggacgaggtagaaactcgaaacgtagtcgtaggctcgactaccgatccgtattctaccg

SEQ ID NO: 212964 - DNA, 491 bp, Homo sapiens
  misc_feature: GYAE6OF02F5QR7.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (300)..(300): a, c, t, g, unknown or other
  misc_feature (300)..(300): n is a, c, g, or t
  modified_base (370)..(370): a, c, t, g, unknown or other
  misc_feature (370)..(370): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaaatctggccaggctcccaggctcctcatttaccgngcatccaccagggccacgtggtcgtcccagacaggttcagtggcggtggatttggggacagtagttttcnctcaccatcagcgcctacagagtgaagatgtgctagtttattctgccagctaatataatactgctgcgtcgacgtcgacacggacaggtagaatcgaaacgatgtgctgcacatctgtctc

SEQ ID NO: 212965 - DNA, 581 bp, Homo sapiens
  misc_feature: GYAE6OF02I1I9I.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctgtccaggactggtgacggccctcgcagtacccctttcaccttccacccttgtgacatccgtaccggggaaaatgtcgctggcaacaatggttggaattggattaggcagtcccgtcgagaggccttgagtggcttggaaggacctattatacgtcccagtgtatgaagactatgcagtatctgtgagcggtcgtctcaccactcaccccacacacgtccaacgatcgacggtcctccctccaccttaactctcctcgtccactcccgacgaccgtaccggtctacgttttattttacggtcacgtaacggaggtataccgtactagtttcggtacgttacctaccgttaccgttacgtacccgtccggttcgggaccgtagggttaacccgg

SEQ ID NO: 212966 - DNA, 695 bp, Homo sapiens
  misc_feature: GYAE6OF02HZR8P.21.27.C05.1.454.CMB.1.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
  modified_base (414)..(414): a, c, t, g, unknown or other
  misc_feature (414)..(414): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggncgcccaccctctcctgcacagccagtcagtctatcgctgactggttagcctggtaccagcaagaaatcgtcggccaggtcctcccgaggccctcctctactttaccgngcctactcccaccgacgggccacgttcggtcgtcccgaagaccgtaggttccgagggtcgggcgggttggtaagttttcggggaactagggttacgtttttccncgttacccaacctagtaccgacggtcccgtaccccgttaacgacggaacggttagaaagttagttggttcgtacgtttaggttttaacttttcgtacgtacctaagtactaaattaactttaacgttacgtccggtccgttggtaccgtccggttaccggttaccgggacccgtaaccggggtaaccgtaagggtacggtaaaacgtacgtaaaaccgggtacgttacggtacggtaccttacgggacctaacccgttacgttcttcggtttaccttaccg

SEQ ID NO: 212967 - DNA, 640 bp, Homo sapiens
  misc_feature: GYAE6OF02IQUAJ.21.27.C05.1.454.CMB.1.raw
  modified_base (203)..(203): a, c, t, g, unknown or other
  misc_feature (203)..(203): n is a, c, g, or t
  modified_base (413)..(413): a, c, t, g, unknown or other
  misc_feature (413)..(413): n is a, c, g, or t
tcagtcgtcgctcgcacgaccggtgctcgatttagacgcgatcgaagggtttgggggaggaactgctcagttaggacccagacggagccatggaagccccagcgcagcttctcttctcctgcttctctggctcccagacaccactggagtgattgtgatgacgcagtctccagccaccctgtctgtgtctccgaggggggacnccgcctaccctctcctgcacacgcctagtcagttctatcgctacgacttggttacgccgtcggtaccagacaagtaaactcgtggcccgaggcctacccgacgtccttcctctactttaccgcgactactaccaccgtagggcctacgtggtcctaccgagtactaggttcgaggtcgggcggtaggtacgttggactagttagttttcnctacactactccacgccgtaccctagacgtacgtagaagtagttgttagcttagtttacttcgtcgaccagtactaaattaacttaacgttacgtcggtaccttcgaccggttacgtaaccggttcggtaccgtaaccgggtaacgtacgggtaacggtaaacgtaaccgtaaacggtaacgttcggtacgtacgtacgacctaccgtacttacgttcgttacctac

SEQ ID NO: 212968 - DNA, 633 bp, Homo sapiens
  misc_feature: GYAE6OF02HVJZA.21.27.C05.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (383)..(383): a, c, t, g, unknown or other
  misc_feature (383)..(383): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggcctcctctatttaccgngcatcccaccagggcccacgtggtctcccaggacaggttcaggtgggcgtgggtagtttcggggactaggtagtttttccncgttacaccatccgacgccggacccttacgagtagtgaagtacttgttgcttagttttactttcgtcgtaccgaagacctaaattattaaacttacgttacggtcccttggtaccggttcgtacccgggttccggacccgtaaccggggtacctaacggggttaacggtaaaacgtaccgtaaaacgttacggtaaaccgttggtacggaccgttacggacccgtaacctacgtttacgtcgtttacccg

SEQ ID NO: 212969 - DNA, 573 bp, Homo sapiens
  misc_feature: GYAE6OF02I7GRU.21.27.C05.1.454.CMB.1.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
  modified_base (333)..(333): a, c, t, g, unknown or other
  misc_feature (333)..(333): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggcctcccaggctcctcatttaccgngcatccacgacggccacgtggtcgtcccagacnggttcaggtggcggtgagtttgggactagtacgttttcacctcacctatcacgccgtaccctagagtacggtagaagtagttgttagcttagtttagtttctcgccagtacctaattacttaacttacgtcggaccttggccgttacgtacggttcggacgaaccgggaccgtaggtaggtaactacgaaacgtaacgtggttacggacttcggacctaccgattccgtagtaccttacg

SEQ ID NO: 212970 - DNA, 595 bp, Homo sapiens
  misc_feature: GYAE6OF02GU3UC.21.27.C05.1.454.CMB.1.raw
  modified_base (203)..(203): a, c, t, g, unknown or other
  misc_feature (203)..(203): n is a, c, g, or t
  modified_base (383)..(383): a, c, t, g, unknown or other
  misc_feature (383)..(383): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcaagaaatctggccaggctcccaggcctcctctatttaccgtgccactccaccgagggccacttcggtctcccaggactaggttcaggtggcggttggtagtttgggactagtacgttttcnctacacctatcacgccgtacctagagtagtagaagtagttgtacgcgttagttttatttcgtacgcctagtactaattaacttaaattacgtcgtacctggtaccgttaccggtacggttccggaccgaacggggtaacctagggtacgtaaacgtaccgaaacggtacgtggtacggtacgtcgacctaccgtagtcgttagttccttacg

SEQ ID NO: 212971 - DNA, 539 bp, Homo sapiens
  misc_feature: GYAE6OF02GLWD7.21.27.C05.1.454.CMB.1.raw
  modified_base (417)..(417): a, c, t, g, unknown or other
  misc_feature (417)..(417): n is a, c, g, or t
  modified_base (451)..(451): a, c, t, g, unknown or other
  misc_feature (451)..(451): n is a, c, g, or t
  modified_base (459)..(459): a, c, t, g, unknown or other
  misc_feature (459)..(459): n is a, c, g, or t
  modified_base (465)..(465): a, c, t, g, unknown or other
  misc_feature (465)..(465): n is a, c, g, or t
tcagtcgtcgctcgcacgaccggtgctcgatttagacgcgatcgaagggtttgggggcgagagcctgctgacttctggctgaccagggcagtcaccggagctccagacaactgtctgtctccttcctcatcttcctgcccgtgctgggcctcccatggggtgtccctgtcacagatcaaactacagcagtctggtccaggactggtgaggccctcgcagaccctttcactcacctgtgacatctaccgggaaaatgtcgctggcaacaatggttggaacttggattaggcagtccccgtgagaggccttgagtggcttggaaggactatatacgtcccagtgtatgaagactatgcagtattctgtgagtcggtcgtctcgaccatccaccccgagacacgtccaagactcacgtcnccctcactatgtctgtcactccgactacacggtnacgttttnttttgntacgagtacggatacgactattcggtataccgtaccttaccgttcgtaccttccgcgggtaccagggttaaccg

SEQ ID NO: 212972 - DNA, 542 bp, Homo sapiens
  misc_feature: GYAE6OF02GRRNO.21.27.C05.1.454.CMB.1.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
  modified_base (375)..(375): a, c, t, g, unknown or other
  misc_feature (375)..(375): n is a, c, g, or t
  modified_base (537)..(537): a, c, t, g, unknown or other
  misc_feature (537)..(537): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggggancgccaccctctcctgcacagccagtcagtctatcgctgactggttagcctggtaccagcagaaatctggccaggctccaggctcctcatttaccgngcactccaccagggccacgtggtcgtcccagacaggttcagtcgggcggtggtagtttgggactagtagttttcnctcaccatcagccgccctacagagtagaagagtgttagcttagtttattctgtccagactaaatattaattactcggcctggcgttacgtacgttccggaccgacgggaccgaggtaggaactacgaaacgtacgtaggtcgactcgacacctatcgtcgtnttacc

SEQ ID NO: 212973 - DNA, 499 bp, Homo sapiens
  misc_feature: GYAE6OF02FFM8L.21.27.C05.1.454.CMB.1.raw
  modified_base (202)..(202): a, c, t, g, unknown or other
  misc_feature (202)..(202): n is a, c, g, or t
  modified_base (249)..(249): a, c, t, g, unknown or other
  misc_feature (249)..(249): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
  modified_base (490)..(490): a, c, t, g, unknown or other
  misc_feature (490)..(490): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttancctggtaccagcagaaatctggccaggcctcccaggcctcctcattttaccgtgcatccaccagggccacgtggtcgtcccagacaggttcagtggcggtggatttgggacagtagttttcnctcaccntcacgcnccctanagagtagaagtntgtgctagtttatctgccagctaatatattactgctgcgtcgacgttcggccacggacaggtgaagtcaacgactgtgctgacaccntctgtctcg

SEQ ID NO: 212974 - DNA, 572 bp, Homo sapiens
  misc_feature: GYAE6OF02HVMNV.21.27.C05.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (405)..(405): a, c, t, g, unknown or other
  misc_feature (405)..(405): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcaagaatctggccaggcctcccaggcctcctctactttaccgngcactcccaccgacgggcccagtggtcgtcccgagacaggtttcaggtgggcggtgagtttggacngtagttttcntcacntcagccnccctanagagtanaagtatgttcgattagttttactttcgtcgccagtactaattaagttaacttacgtcgtccgttgtccgtaccgttcggttcgaccgtacgggaacctaagggtacgaaagtaccgtaaacgtacgtaggtacggctacgacctacgacttactcggttaccttccg

SEQ ID NO: 212975 - DNA, 716 bp, Homo sapiens
  misc_feature: GYAE6OF02JQEB0.21.27.C05.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
  modified_base (404)..(404): a, c, t, g, unknown or other
  misc_feature (404)..(404): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgccacagccagtcagtctatcgctgactggtgcctggtacagcaagtaatctggccaggcctcccgaggcctccgtctacgtttaccgngcacgtccaccgacgggccctacgtcgggtcgtaccccaagtaccgtaggttcgaggtcgggcggttaggtagtttggggactaggttacgttttcnctacgtacctagttccgacgtcccgtacccttaagacggtaacggttaggaaacgtagttcggttacgtaccgttaaggttttactttccgtaggtaccctagtacctaaagtttacttaaactttaccgtacgggtaccctagggttaccggttaccgttaaccgggttttcccgggacccggtaacccggggtaaccgtaacggggttaacggtaaaacgtaaccggttaaaaccgggaacgttaagggttaccggtaccgtacggtaacccgaaccgttcgtttaaccggtttccgttacgtttacccg

SEQ ID NO: 212976 - DNA, 753 bp, Homo sapiens
  misc_feature: GYAE6OF02G38QS.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgacttggttagcctggtaccagcagaatcgtggccaggctcccaggcctcctcactttaccgtgcactccaccgagggccacgtggtcgtcccaagcacggttcaggtcgggcggttaggtagttttggggaactaggttacgttttttccgaccttaccgtaaccctaagtttccgacggtaccccgtacccccgttaacgaacgggtaaggttaggaaaacggttactttacgggtttacgtaccgtttaaggttttttaaccttttccgttacggtaccctaaaggttacctaaaacgtttaacgtttaaaacgttttaccgttacgggtccctttacgggtacccggttttaccggttaaccggggttttcccggacccggtaacccgggggttaaccgttaacggggttaacggtaaaaccgttaacccggaaaaccggttaaccgttacgggttacggtaccgttacggaccgtaccgtacgttacgtttaccggttacctttaccg

SEQ ID NO: 212977 - DNA, 584 bp, Homo sapiens
  misc_feature: GYAE6OF02GXEA1.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatgggggtgtcctgtcacagatcaaactacagcagtctggtccaggactggtgaggccctcgcacgaccctttcactcacctgtgacatcgtacggggaaatgtcgctggcaacaatggttggaattggattaggcagtccccgtgagaggccttgagtggctgggaaggacctattatacgtccagtggtatgaagactatgcagattctgtgaggtcggtcgtctcaccactccaccccagacaccgtacaacgaatccaggtcctccctcccacctaatcgtctcgtcaccgtacccgacgaccgacggtaccttagttttacgttttgtacgtactaaggacggtactacgtactagtttccggtagtaacccgttacccttccgtttacgtaccgtccggttcggggtacccgtagggttaacccgg

SEQ ID NO: 212978 - DNA, 833 bp, Homo sapiens
  misc_feature: GYAE6OF02G97K7.21.27.C05.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
tcagtcgtcgctcgcacgaccggtgctcgatttagacgcgatcgaagggtttgggggagggaactgctcagttaggacccagacggagccatggaagccccagcgcagcttctcttcctcctgcttctctggctcccagacaccactggagtgattgtgatgacgcagtctccagccacctgtctgtgtcctcgaggggggancggccaccctctcctgcacgagccagtcagtctatcgctgactggttacgcctggtaccagcaagaaatctggccaggcctcccaggcctcctctacgtttaccggngcaactcccgacgtacggggaccctacgtcgggtcgtaccccaaggtaccgtagggtttccaaggggttcggggccgggttagggtaacgttttcggggggaaacctagggtttaacggttttttcccaccttaccggaaaccctagttacccgaacgggtcccgtaacccccgttaaacggtaaacggtaacggttacggtaaaaggttaacgtttacgggtttaccggtaccgtttaaggttttttaacctttacccggttacgtacccgtaacgttaacctaaaacgtttaacgtttaaacgtttaccgttaccggggaccctttacgggacccggtttaacccgggttaaccgggtttacccgggaccccgggtaaaccgggggtaacccggttaacggggttaacgggaaaaaccgtttacccggaaaaaccgggttaacccgtttagggtaccgggtaccgttaccgggtaccgtaaacccgttacgtttacccgtttacggttccctttaacccgg

SEQ ID NO: 212979 - DNA, 565 bp, Homo sapiens
  misc_feature: GYAE6OF02GO3QG.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (299)..(299): a, c, t, g, unknown or other
  misc_feature (299)..(299): n is a, c, g, or t
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaatctggccaggctcccaggctcctcatttaccgngcatccacacgggccacgtggtctcccagactaggttcaggtggcggtggtatttggggacagtagttttcnctcacctatcacgccgccctanagagtagaagntgttgctagtttattctgccagtactaattattaacttacgtcggtccttgccgttacgtacggttccggaccgacgggacctagggtacggaaacgtacaaaaccggtacttcggtaggtaccttacggacctaacccgtatccgttacgtccttacccg

SEQ ID NO: 212980 - DNA, 514 bp, Homo sapiens
  misc_feature: GYAE6OF02FPUTM.21.27.C05.1.454.CMB.1.raw
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (319)..(319): a, c, t, g, unknown or other
  misc_feature (319)..(319): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
  modified_base (510)..(510): a, c, t, g, unknown or other
  misc_feature (510)..(510): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggacgccacctctcctgcacagccagtcagtctatcgctgactggttagcctggtaccagcagaaatctggccaggctcccaggctcctnatttaccgngcatccaccagggccactggtntcccagacaggttcagtggcggtggatttggggacaggtagttttcnctcaccatcagcnccctanagagtgaagatgttgctagtttaattctgtccagctaaatataaattctggcctgcgtcgacgttccggccaacgggaccaaggtggaaatacaaacgtaactgtacggctgcaaccgatctgtnttcg

SEQ ID NO: 212981 - DNA, 654 bp, Homo sapiens
  misc_feature: GYAE6OF02HBW32.21.27.C05.1.454.CMB.1.raw
  modified_base (495)..(495): a, c, t, g, unknown or other
  misc_feature (495)..(495): n is a, c, g, or t
tcagtcgtcgctcgcacgaccggtgctcgatttagacgcgatcgaagggtttgggggcgagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactgggtcgaggcccctggcaggaacccctttcactcaacctgtgacatccgtaccgggggaaaaatcgtacgctggacaacaatggtaggaagttggaatttaacgggcgacgtccccgtgaacgaggtaccttggagtcggcgttaggaaggaccttattaataccgttaccgagtcggtatgaagactagtgacagtattctagtgaggtcggtcgtctccgaaccataccaccccagtaacaccggtaccaaagtaacgtcaaggtcctccctaacccgtaacctaagttctntaccggttaccaacgttccccggaacgaccgtaccggacctttaaggtttttacttttcggtagtaacccgaaagggtacgggataccgtaactaacggtttcggacggtaccttacccttcgtacgtacctccggttacggggccaaggggttaaccg

SEQ ID NO: 212982 - DNA, 601 bp, Homo sapiens
  misc_feature: GYAE6OF02F1FW1.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaaatgtcgctggcaacaatggttgaattggattaggcagtccccgtgagaggccttgagtggcttggaaggtcctattatacgtcccagtggtatgaagactatgcagattctgtgagcggtctctcaccatccaccccagactacgtccaaagactacacgtcctccctacctaacctaatcgtactgtacctacccgtcccgaaccgaccgtaccggtacttaagttttactttttggtgtaccgtaaggacgggtactaccgtaactacggtttcggtacgtaaccctttacccgttcccgtttacggtaccgttcccggtcggggtacccgtaacgggtttaacccgg

SEQ ID NO: 212983 - DNA, 569 bp, Homo sapiens
  misc_feature: GYAE6OF02GC0CW.21.27.C05.1.454.CMB.1.raw
  modified_base (203)..(203): a, c, t, g, unknown or other
  misc_feature (203)..(203): n is a, c, g, or t
  modified_base (411)..(411): a, c, t, g, unknown or other
  misc_feature (411)..(411): n is a, c, g, or t
  modified_base (557)..(557): a, c, t, g, unknown or other
  misc_feature (557)..(557): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccgaggcctcctctatttaccgtgccactccaccgagggcccacgtggtcgtcccagactaggttcaggtggcggtggatttggggactaggtagttttctcgtaccacctatcacggccgtacccgtanaggtagtagaagtattgttgcttagttttacttcgtcgcctagactaaattaattaactttacgtggtccttggaccgttcgtaacggttacgaacgaaccgggaccaagggtagaaactacgaaacgtactggagctagccaccntacttgtcttac

SEQ ID NO: 212984 - DNA, 761 bp, Homo sapiens
  misc_feature: GYAE6OF02JDOLQ.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggacncgccaccctctcctgaccacgacgccgagtccgtacgttctacgtccgctagtacgttaggttacgtccgttacggtaccagacaagtaacgtcgtacggaccgacggtcctacccgacggtcctacctacttacgtttaccgtcgacctactacccgaccggtacgggtacctacggttcggtaccgtacccgaacggtaccgtacggttacgacgggttcgggtcgggttaggttacggttacgggactaggtttacgttttccacctaccaccttacgtccgtacggtacccgtacccgtaagaaggtaggtacggtaaggttagttcggttacgtactttaagttttacgtttccgacgtaccgtaagtaactaaattaactttaacgttacgttcggtaccgttacggtaccggttaccggttacccggttaccggtacccggtaaccgggttaaccgtaacgggtaacggtaaaccgtaaaccgtaaaccggttaacgtacggttacggtacgtaccgtacctaccgtaaccgttacgttacgttcttaccg

SEQ ID NO: 212985 - DNA, 591 bp, Homo sapiens
  misc_feature: GYAE6OF02JE5T9.21.27.C05.1.454.CMB.1.raw
  modified_base (257)..(257): a, c, t, g, unknown or other
  misc_feature (257)..(257): n is a, c, g, or t
  modified_base (398)..(398): a, c, t, g, unknown or other
  misc_feature (398)..(398): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgaccgtgctgggcctcccatggggtgtcctgtcacagatcaaactacagcagtctggtccaggactggtgacggccctcgcagaccctttcactcacctgtgacatctaccggggaaatgtcnctggcaacaatggttgaattggattaggcagtccccgtagagaggccttggagtcggcttgggaacggtaccctaagttactacgtacccgagtacggtaatggaagactatgcagattcgtgtgagcggtcgtactcacnctccaaccgtacgacacgtaccaagtaactcgagtcctccctaccactaacgtgtctacgtaccacgtacccgacgtactacggccttagtttacgtttcgtgactaaggacgtataccgtaactacgttacggtaactccgttaccgtaccgttacggaccttacccggtcgggtacctacgggttaaccgg

SEQ ID NO: 212986 - DNA, 583 bp, Homo sapiens
  misc_feature: GYAE6OF02IQ80Z.21.27.C05.1.454.CMB.1.raw
  modified_base (202)..(202): a, c, t, g, unknown or other
  misc_feature (202)..(202): n is a, c, g, or t
  modified_base (302)..(302): a, c, t, g, unknown or other
  misc_feature (302)..(302): n is a, c, g, or t
  modified_base (381)..(381): a, c, t, g, unknown or other
  misc_feature (381)..(381): n is a, c, g, or t
  modified_base (423)..(423): a, c, t, g, unknown or other
  misc_feature (423)..(423): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccgaggcctcctctatttaccgngcactcccacgagggcccagtggtcgtcccagactaggttcaggtggcggtggtagtttcgggactaggttagttttcncctcacccgatcacgcccgtaccctacgaggtagtagaagtnttcggttacgtcttagttttacttctcgtaccagtactaaattattaacttacgtggtccctggtccgtcgtacggttccggaacgaaccgggacgtaggtagtaaacgtccgtaaaacgacgttggacggtcgtacgctacctatccgtagttcctacg

SEQ ID NO: 212987 - DNA, 528 bp, Homo sapiens
  misc_feature: GYAE6OF02JFONV.21.27.C05.1.454.CMB.1.raw
  modified_base (224)..(224): a, c, t, g, unknown or other
  misc_feature (224)..(224): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (470)..(470): a, c, t, g, unknown or other
  misc_feature (470)..(470): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttnactcacctgtgacatctccggggaaaatgtcgctggcaacaatggttgaattggattaggcagtcccgtgagaggccttgagtggcttggaaggacctagttatacgtcccagtggtatgaagtactatagcagtattcgtgtgagtcggtcgtctcacatcacccagacacgtacaagaatcagtcctccctacactaatntctntcacnccgacgacacggctagtttatttcgagactaaggnggatcgactagttcggtagtacctacctctagtacctccgtagggtcctagggttacg

SEQ ID NO: 212988 - DNA, 926 bp, Homo sapiens
  misc_feature: GYAE6OF02G2OIV.21.27.C05.1.454.CMB.1.raw
tcagtcgtcgctcgcacgaccggtgctcgattttagacgcgatcgaagggtttggggggaggaacgtgcgtcacgttaggacccagacgggaagccgagtggtaacgcccctaggcgcaggcttctcgttacctccctgcgttctctcggctcccgagtacgaccactgggacgtggatttcgtggtatcgtaccgttacaggttctcccaggtccaccctggtctgtcgttcgtccggagggggggactcggggccacccgttcgttccctaggcccgacggaacgggtcccctaagggtaccaacggttccttaacgttcgggaccttacgggacctttggggtttaacggcccgtttacgggttaacccctaggaccgaaacggtaaaaacttccgttcgggggaccccaaggggtcccttacccccgaacggggtcccgttcccccgtacgtaacgtttttaccccggtcggaaccgtaaccgttaccccgggaacccgtaacgggggacccctaaccgggttggggtacccgttaacccccgaaaggtaaccgttacgggtttacaaggggtttcggggaccgggtttaggggaaggtttttcgggggaacttaagggttaacgttttttcaccgtccgaaaccgtacgttccggaacgggacccggtaccccgttaaagtaacggtaacggtacggtaaacgtcgttacggtttacgacctttaagtttttacttaccgtacgacctaacgtacctaaattattaaaccgttacgtacggtacctacggtaccgtaccgtaaccggttacgggaacgaaccggggaacctaagggtacggtaaacgtaacgttaaaaccggtacgttacggtacggtcgttacggaccgtaaccggtaggttcggttacgtctttacccg

SEQ ID NO: 212989 - DNA, 710 bp, Homo sapiens
  misc_feature: GYAE6OF02HFVWW.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcaagaaatctgccaggcctccgagctcctctactttaccgtgctatcccacgtagggccctagtcggtccgtcccaaggtacgacggtttcgaggttgggtccggtaggtagtttacggggaactaggttacgttttcacgttccgaacctattccgacgtccgtaccctaagaggtagtagaaggtgttggtgtacgttaggttttatttcctacggtaccgtaacgtctaaagtttaacgttaaagtttaccgtaggtacccttgggtacccggtttaccgtaaccgggtttcccggaacccggtaaccgggggtaaccgtaagggggtttaaccggaaaaccgtttaacccgggaaaaaccggttaacggttacggggtaccggtaccgttaaccggtacccctaaacggttaccgtttaccggtttaccgttaccgttttaacccc

SEQ ID NO: 212990 - DNA, 583 bp, Homo sapiens
  misc_feature: GYAE6OF02JC7K1.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatgggggtgtcctgtcacagatcaaactacagcagtctggtccaggactggtgaggccctgcagaccctttcactcacctgtgacatcgtaccggggaaaatgtcgctggcaacaatggttggattggattaggcagtccccgtcgagaggccttgagtggtctggaaggacctattatacgtcccagtggtatggaagtactatgcagattctgtgagcggtcgtctcaccatccaccccagaccacgtaccaagaactcgagtcctccctacctacctaatgtctcgtccacctaccccgaacgaccaacggtctaagtttttacttttcggtagacgaaggtagggaactcgaactagtttccggtacgtaaccttaccttccgtttacgacccgttccggtacggggacccgtaagggttaacccgg

SEQ ID NO: 212991 - DNA, 627 bp, Homo sapiens
  misc_feature: GYAE6OF02GIPY0.21.27.C05.1.454.CMB.1.raw
  modified_base (205)..(205): a, c, t, g, unknown or other
  misc_feature (205)..(205): n is a, c, g, or t
  modified_base (254)..(254): a, c, t, g, unknown or other
  misc_feature (254)..(254): n is a, c, g, or t
  modified_base (308)..(308): a, c, t, g, unknown or other
  misc_feature (308)..(308): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtcgtctccgaggggggacnccgcccaccctctcctgcacagccagtcagtctatcgctgactggttancctggtaccagcagaatctggccaggcctcccgaggcctcctctaactttccgngccactcccaaccgagggccacgtcggtcgtacccagaccgtaggttcaggtcggcggtggtagttcgggactagtagttttcgctaccacctagtccacgccgtaccctaacgagtagtagaacgtcgttaggttacgacgttagttttactttcgacgtacctaagtacttaaagttattaaacgttacgtcggtaccgttggtaccgttaccgtaccggttccggaccgaaccgggtaccgtaagggtacgtaaacgtaccgaaacggtacgttggacggtacgttacgacctacgtcttacgtcgttaccttacg

SEQ ID NO: 212992 - DNA, 781 bp, Homo sapiens
  misc_feature: GYAE6OF02IEWZF.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgacttgggttacgccttggtacccagcaagaaacttcgtgggaccagggtcctaccccgagggtcccttcccttactaccgttttaccggcgtacctactccccgaaccgacggggtcccctacggttcgggtccgtacccgaaggtaccgtacgggtttccaaggggtccggggtcgggttagggtaaggtttcggggaaccttagggtttacgttttttccctccgtacctaaccgtcgttaccgtaacggtcccgtaaccccgtaacgaaggtaacggttaggtaaacggtagttcggtttcggacgttttaagttttactttccgtgtaccctaagtaactaaattaacgtttaacgtttacgtcgggtacccttcgggtaccgttaccggttaaccggtttacgggaaccgggtaaacccggggaacgttaaacgggttaacgggtaaaccttaacccgggaaaacggttacggttacggtaccgggtacttacggaccgttaaaccttacgtttaccgttcgttaccctttaccg

SEQ ID NO: 212993 - DNA, 675 bp, Homo sapiens
  misc_feature: GYAE6OF02IV4NP.21.27.C05.1.454.CMB.1.raw
  modified_base (202)..(202): a, c, t, g, unknown or other
  misc_feature (202)..(202): n is a, c, g, or t
  modified_base (250)..(250): a, c, t, g, unknown or other
  misc_feature (250)..(250): n is a, c, g, or t
  modified_base (402)..(402): a, c, t, g, unknown or other
  misc_feature (402)..(402): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttacncccggtacagcagaaatctggccaggcctcccaggcctccctctagtttaccgtgtccactcccaccgacgggccctaacgtggtcgtaccccagtacctaggttccgaggtcgggccgggtggtacgttttggggaactggtactttttcncctactaccatcacgccgaccctaacgagacgtgaagtagtgttgcttagttttattcgtgtaccagtactaaagttattaactttacgtcggtacccgttggtccggttaccgtaccggttttaccgggaccccggtaaacccggggtaacccgtaacggggttacggtaaaaccgttaaccggtaaaaacgggtaacccgttaggggtaccggtaccgtacggaaccctaccgaaccgttccgtttaacggtttcccttaccgttaacccg

SEQ ID NO: 212994 - DNA, 549 bp, Homo sapiens
  misc_feature: GYAE6OF02G0Q76.21.27.C05.1.454.CMB.1.raw
  modified_base (203)..(203): a, c, t, g, unknown or other
  misc_feature (203)..(203): n is a, c, g, or t
  modified_base (394)..(394): a, c, t, g, unknown or other
  misc_feature (394)..(394): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggctaggcctcccaggcctcctcatttaccgtgcatcccaccgacgggcccactcgggtcgtccccaggaccgaggtttcaggttgggccggttgggtagttttggggactaggtagtttttcnctccaccatcagccgccctacgagagtagaagtatgttgctagttttatttctgccagtcaattattattactggcctgcgttcgacgttcggccgacgggaccaggttggaatccgaaacgtaacgtggtggctgccaccgatcgtgttcttac

SEQ ID NO: 212995 - DNA, 648 bp, Homo sapiens
  misc_feature: GYAE6OF02JJW2M.21.27.C05.1.454.CMB.1.raw
  modified_base (202)..(202): a, c, t, g, unknown or other
  misc_feature (202)..(202): n is a, c, g, or t
  modified_base (249)..(249): a, c, t, g, unknown or other
  misc_feature (249)..(249): n is a, c, g, or t
  modified_base (306)..(306): a, c, t, g, unknown or other
  misc_feature (306)..(306): n is a, c, g, or t
  modified_base (394)..(394): a, c, t, g, unknown or other
  misc_feature (394)..(394): n is a, c, g, or t
  modified_base (471)..(471): a, c, t, g, unknown or other
  misc_feature (471)..(471): n is a, c, g, or t
tcagtcgtcgctcgcacgaccggtgctcgatttagacgcgatcgaagggtttgggggaggaactgctcagttaggacccagacggagccatggaagcccagcgcagcttctcttcctcctgcttctctggctcccagacaccactggagtgattgtgatgacgcagtctccagccaccctgtctgtcgtctccgagggggancgccaccctctctagcacagccagtcagtctatcgctgacttggtancctggtaccagcaagaactctaggccaggcctcccgaggctcctctagtttaccgtnccactcccacgacgggccacgtcggtcgtcccagtacctggtttcacggtgggcggtaggtagtttcgggactaggttcgtttttccncttccgacgtatcgagtcccgacccttaagagtacggtagaagtacgttggttacgccgttaaggttttctttaccnggccctaagtacctaaatttacgttaaactttacggtcggtaccttcgggaccgttttacgtaccgggttccgacccggtacggggtaacgtacggggtaaggtaaacctaacgggtaaacgtacggttcgggtacgtcgtacgtaccgtaaccgtacttcgggttacttcccgtaa

SEQ ID NO: 212996 - DNA, 869 bp, Homo sapiens
  misc_feature: GYAE6OF02JPHPV.21.27.C05.1.454.CMB.1.raw
tcagtcgtcgctcgcacgaccggtgctcgatttagacgcgatcgaaggtttagggggcgagagcctgctgacttctggctgaccaggcagtcaccggagctccagacaactgtctgtctccttcctcatcttcctgcccgtgctggcctcccatgggtgtcctgtcacagatcgaaactacagcagtctgtccagactggtgacggccctcgcagaccctttcactccacctgtcgacagtcctaccggggaaaatcggttaccgccgtggacctaaacgaacgttcggggtttacggaaagtttgggtaacgtttaaagggcccgtaacccgggtttaccccccgggttacccggtaaacggtaaccggggtccccgtttttaagggaacggtttacggggtccccggttttagggggtaaaacggggttaacccccgtttaaagttttaaccgggttaaccccgggtttaccccccgtaaggggtttaccggggtttaaacgttaggggtaaaaaccgggtaacctttaaagttcgggttacccgaaagggtaaacttttccgtacgggttaggtaacgggtccgggtttaaccggttccctttaaccgaacccgtaaactttccccgaacccccgttaacggaccctaaccgggttacccaaaagtaactaccggaaccgggttccttaccccgtaccctaacttaacgtgttccgttactacccgtaccgtaccccgacgtaaccgtacggtaccttagggtttttaacttttgtcgactaccgggtaagccgtactaacgtcgtttggacgttaccttacccgttcgttacgaccgttccggcggggtaccacgggtttaaccg

SEQ ID NO: 212997 - DNA, 712 bp, Homo sapiens
  misc_feature: GYAE6OF02F5VXF.21.27.C05.1.454.CMB.1.raw
  modified_base (363)..(363): a, c, t, g, unknown or other
  misc_feature (363)..(363): n is a, c, g, or t
tcagtcgtcgctcgcacgaccggtgctcgatttagacgcgatcgaagggtttgggggaagaggaagactgacggtcctgccacaggtggtgctgggcacggtgggccctcgcagaccctttcactcacctgtgacatctccggggaaaatgtcgctggcaacaatggttggaattggattaggcagtccccgtgagaggccttgagtggcttggaaggacctattatacgtcccagtggtatgaagactatgcagattctgtgagcggtcgtctcaccatcaccccagaccacgtaccaagaatcaggtcctccctccacctaatgtctgtccacctcccgacgacacgctagtttattttgngtacaaggaggtaatcaactacgttacggtgtaccttacccgtacctttcgaccttcccggtaggggacccgtaacggggttaaacgttttcggtacctaacccgttcctcccgtacaaccggcccttacccaaaccgaacgggcccctagtcccggttcctttccccccgagggcccgtcccccgttcgtcccgttaccgaacgggtccgtaccacccgttaccgaagtaccggaccaaccgtaacgggcccgggtacccggtacggggtcccgttaccggacccgttacgggttaacccgaaaaccgggttacccttaacccggtttaccccggaggtaaccccggg

SEQ ID NO: 212998 - DNA, 675 bp, Homo sapiens
  misc_feature: GYAE6OF02HMR1W.21.27.C05.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
  modified_base (328)..(328): a, c, t, g, unknown or other
  misc_feature (328)..(328): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttacgctggtaccagcaagaaatctggccaggcctcccaggctcctntactttaccgngcatccaccgagggccagtggtcncccagaccgaggttcaggtcggcggtggtagtttgggactagtacgttttctctaccgaacctatccgacgtcccgtaccctagaggtacgtagaaacgtagttcggttagtacgttacgttttacgtttctacgtacctaagtactaaagttaacttaaacgttacgttacgggtccttaggtaccggttaccggttaccgggtttacccgggacccggtaaccggggtaacccgtaaggggttaacggtaaaaccgttaaccggaaaaccggtaacggttagggtaacggtaccttacggggaaccctaaccgtacgtttaccgtttaccggttacctttacccg

SEQ ID NO: 212999 - DNA, 584 bp, Homo sapiens
  misc_feature: GYAE6OF02I7SUS.21.27.C05.1.454.CMB.1.raw
  modified_base (203)..(203): a, c, t, g, unknown or other
  misc_feature (203)..(203): n is a, c, g, or t
  modified_base (386)..(386): a, c, t, g, unknown or other
  misc_feature (386)..(386): n is a, c, g, or t
  modified_base (428)..(428): a, c, t, g, unknown or other
  misc_feature (428)..(428): n is a, c, g, or t
  modified_base (444)..(444): a, c, t, g, unknown or other
  misc_feature (444)..(444): n is a, c, g, or t
  modified_base (470)..(470): a, c, t, g, unknown or other
  misc_feature (470)..(470): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcaagaaatctggccaggcctcccgaggcctccctctagtttaccgtgctatcctaccgagggcccacgtggtcgtcccagtacaggttcaggtggcggtaggtagtttgggactaggtgttttcnctactacctatcgacgtccgaccctagaggtagtagaaagtntaggttgcttagtttnttctcgccagactaaattataacttncggtctagtcgttcgtaccggttcgaccgtaacgggaccgtaagggtagtaaacgtaccggaaacgtacgttggtacgccgtacgacctaccgtaagtcgttacgtcttacccg

SEQ ID NO: 213000 - DNA, 520 bp, Homo sapiens
  misc_feature: GYAE6OF02GI6OK.21.27.C05.1.454.CMB.1.raw
  modified_base (160)..(160): a, c, t, g, unknown or other
  misc_feature (160)..(160): n is a, c, g, or t
  modified_base (223)..(223): a, c, t, g, unknown or other
  misc_feature (223)..(223): n is a, c, g, or t
  modified_base (461)..(461): a, c, t, g, unknown or other
  misc_feature (461)..(461): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtntcctgtcacagatcaaactacagcagtctggtccaggactggtgaggccctgcagaccctttnactcacctgtgacatctctggggaaaatgtcgctggcaacaatggttgaattggattaggcagtccccgtgagaggccttggagtggcttggaaggacctattatacgtcccagtcggtatgaagactatgcagattctgtgagcggtcgtctcaccatccaccccagacacgccaagaactcaggttctccctcacctaatcgtctgtcactccgacgacacgtctagtttatttgngtcagtaggatacactagttcggtgactaccttccttgacctcgtcgggcctaacgggg

SEQ ID NO: 213001 - DNA, 685 bp, Homo sapiens
  misc_feature: GYAE6OF02IITSI.21.27.C05.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgcccaccctctcctgcacagccagtcagtctatccgctgactggtagcctggtaccagcaagaaatctggccaggcctcccgagcctccgtctatttacccgngccactccaccgacgggcccacgttggtcgtacccagacctaggttacaggtcgggcggtggtagtttggggaactaggtacgttttctacgtccaacctagtccacggcccgtaccccttaacgaaggtacggtaggaaaggagttcgtttaggacgtttaaggttttaacttttccgtacgaccctaggtaacctaaaattaagttaaacgttaccgttcggtcccgttagggtacccggttaccggttaacggtttccgggaacccgtaccgggggtaaacccgtaaggggttaacggaaaacgttaccgaaaaccggtaccgtaggttacggacgttacgacccgaacgtacttccgttacgttacctttaccg

SEQ ID NO: 213002 - DNA, 733 bp, Homo sapiens
  misc_feature: GYAE6OF02JXOO3.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgcacagccagtcagtctatcgctgacttggttacgcctggtaccagacaagaaatcgtggccaggcctcccgaggtcctcctctactttccgagccactcccaccgacgggccaacgttcggtcgtacccgacgacgtacggtttaccgagggttgggtcggttagggtacggtttggggaacctagggttacgtttttccacgtaccgtacctaatccgacggtcccgtacccctaagacggtagtacggtaaacgtagttacggttagtacgtttaagtttttacgtttaccgttacggtacccgtagtaaccttaaagttaactttaaacgtttacggttaccggtacccgttacggttacccgttacgggttacccggttaccgggtaacccggtaaccgggggtaaccgttaacggggtaacgtaaaacggttaaccggaaaacggttaacggttacggtacggtaacggtaccgaccgtaaccgtacgtttaccgttcgttaccttaccg

SEQ ID NO: 213003 - DNA, 548 bp, Homo sapiens
  misc_feature: GYAE6OF02GUVFW.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtgagaggccttgagtggcttggaaggacctattatacgtcccagtggtatgaagactatgcagtattctgtgagcggtacgtctcaccatccaccccagacacgtccaagatcgagtcctccctccacctaatcgtctcgtacacctcccgacgaccacggtctagttttatttgtgacgaagagggtactctactagttccggtagtacccttacctccttcgaccttccggtcgggacctagggttaaccgg

SEQ ID NO: 213004 - DNA, 586 bp, Homo sapiens
  misc_feature: GYAE6OF02FOK5V.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaaatgtcgctggacaacaatggttaggaattggattaggcacgtccccgtcgaggaggccttgagtggcttggaagactattatacgtcccagtggtatgaagactatgcagtatctgtagagcggtcgtctcaccatccacccagacacgtaccaagactcgacggtcctccctacctaccttaactcgtctcgtactaccgtacccgacgaccgtacggacttacgtttattttcgtacgtacgtaacggtaggtactacgtactacgtttacgggtactaccttaccgttaccttcgtaccgttccggtcggggtaccgtacgggttaaccgg

SEQ ID NO: 213005 - DNA, 602 bp, Homo sapiens
  misc_feature: GYAE6OF02F5V2B.21.27.C05.1.454.CMB.1.raw
  modified_base (508)..(508): a, c, t, g, unknown or other
  misc_feature (508)..(508): n is a, c, g, or t
tcagtcgtcgctcgcacgaccggtgctcgatttagacgcgatcgaagggtttggggggaagaggaagactgacggtcctgccacaggtggtgctgggcacggtgggccctcgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtcgtctcaccatccaccccagacacgtccaagatcaggtcctccctccacctaatgtctgtcactcccgacgacacggctagttttattttgtgcaagaggatcactagttcggtgaccttacctccttgacctccgtcggggccctagggtaacgttttcgctaccgtctcctcgacgccctccaaccacgggccctagtccgtccttccccgtgccgccctgcctccgagggaccnccacccgtccgacgacgccacgacggcccggcccgtggggcccttcggcccgttggtacccgaacggtacccttaccgttcccgaggtacccgg

SEQ ID NO: 213006 - DNA, 730 bp, Homo sapiens
  misc_feature: GYAE6OF02IWVOY.21.27.C05.1.454.CMB.1.raw
  modified_base (203)..(203): a, c, t, g, unknown or other
  misc_feature (203)..(203): n is a, c, g, or t
  modified_base (433)..(433): a, c, t, g, unknown or other
  misc_feature (433)..(433): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgacgtggttacgcctaggtaccagcagaaatcgtggccaggcctcccgaggcctcctctagtttaccgtgacctactacccgaccgacgggtcccacgttcgggtcgtaccccgaaggaccgtagggtttccaagggttggggtccgggttagggttaaggttttcgggggaacttaggttacgtttttccncgttaccaccctagtccgacgcccgtaccctacgaggtacgtagaagtagttggttcgacgtttaagttttactttcgtacgtaccctaagtaaccttaaattaacgttaaacgtttaccggtacgggtcccgtttacgggtacccgggttacccgggtaaccgggttttccccgggaaacccggtaaccggggtaacccggtaagggtaacggtaaaaccgtaaccggtaaaaaccgtacgttcgggtacggacgttcggaaccctacccgtacttcccggttcgttaccttaccg

SEQ ID NO: 213007 - DNA, 529 bp, Homo sapiens
  misc_feature: GYAE6OF02FGRKC.21.27.C05.1.454.CMB.1.raw
  modified_base (486)..(486): a, c, t, g, unknown or other
  misc_feature (486)..(486): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtcgagaggccttgagtggcttggaaggactattatacgtcccagtggtatgaagactatgcagattctgtgagcggtcgtctcacatcacccagacacgtccaagaatcaggtctccctccacctaatgtctgtcactcccgagacacggctagtttaattttgtgacaagtagggatcgaactattcggtnaccgttacctccttagaccttccgtggggtcccagggtaaccg

SEQ ID NO: 213008 - DNA, 764 bp, Homo sapiens
  misc_feature: GYAE6OF02F4BWJ.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcaagaaatctggccaggcctcccgaggtcctcctctactttacccggtgcctactcccaccgacggggcccaacgttcgggtcgtccccgaagtaccgtacgggttaccagggttcgggcgggttaggtagtttcgggggaactaggttagtttttccgtaccttccgaaccctagttacccgacggtacccgtacccccttaacgaacgggtaacgttagggaaacgttagtttcggtttacggtacgtttaagttttttaactttttccgtaccggtacctaaagaccttaaaagttaactttaaagtttaacccgtgggttaccccgttaggtacccggttacgtacccgggttttaccgggacccggtaaaccgggggtaacccgtaaggggggttaacggtaaaaccgttaaccggaaaaaccggttaacgtttggggtaccggtaccgttacggaccctaaacccgttcgttaaccggtttcttaccgtttaacccg

SEQ ID NO: 213009 - DNA, 617 bp, Homo sapiens
  misc_feature: GYAE6OF02GZL67.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgtgcactcccacgagggcccacgtcggtcgtcccagacctaggttcaggtgggcggtggtagtttgggactaggtacgttttctctccaacctatcacggccgtaccctaacgagtagtacggaagtagttggttcgcttaagtttttactttcgtacgtccaagtacctaattaattaacttacgtggtaccttggtccgttccgtacggtttccgggaccgtaaccggggaccgtaagggttacgggaaactaaccggtaaacggtaacgtagggtacggtacgtacgaccgtacctagttccgttcgttcttaccg

SEQ ID NO: 213010 - DNA, 518 bp, Homo sapiens
  misc_feature: GYAE6OF02IX164.21.27.C05.1.454.CMB.1.raw
  modified_base (440)..(440): a, c, t, g, unknown or other
  misc_feature (440)..(440): n is a, c, g, or t
  modified_base (460)..(460): a, c, t, g, unknown or other
  misc_feature (460)..(460): n is a, c, g, or t
  modified_base (466)..(466): a, c, t, g, unknown or other
  misc_feature (466)..(466): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattgggattaggcagtccccgtcgagaggccttgagtggcttggaaggacctattatacgtcccagtggtatgaagactatgcagattctgtgagcggtcgtctcacatcaccccagacactccaagaatcagtcctccctccacctaatgtctgtcactcccganaccacggcagttttatttgngcaagngggatcgaatnttcgngtactacctcttcgactcctggggcctagggtaacg

SEQ ID NO: 213011 - DNA, 637 bp, Homo sapiens
  misc_feature: GYAE6OF02GU8HB.21.27.C05.1.454.CMB.1.raw
  modified_base (238)..(238): a, c, t, g, unknown or other
  misc_feature (238)..(238): n is a, c, g, or t
  modified_base (261)..(261): a, c, t, g, unknown or other
  misc_feature (261)..(261): n is a, c, g, or t
  modified_base (518)..(518): a, c, t, g, unknown or other
  misc_feature (518)..(518): n is a, c, g, or t
tcagtcgtcgctcgcacgaccggtgctcgatttagacgcgatcgaagggtttgggggcgagagcctgctgacttctggctgaccagggcagtcaccggagctccagacaatgtctgtctccttcctcatctcctgcccgtgctgggcctcccagtggggtgtcctgtcacagatcaaactacagcagtctggtccaggactggtggacggccctcgcagaccctttcactcacctgtnacatcgtacggggaaaatgtcgntggcaactaagtggttaggaagttggacttaggactaccggtaccccgtcggagacggtccttagagtggtcgttaggaaagggtacctattacgttaccgtacccagttaggtagtacgaaagtactatgacgagtattcgtgtagtacggtcggtcgttctacacctacgtccaccccgagacctacgtaccaaagtactacggacgtccttcccacctacctaatcgtacctgtaccaccgtcccgacggaacnccggtacttagttttaacttttgtcgacgaaggtaggactccgtaacttacgttaccggtacgtaaccttcctaccgttcgtaccttccgggtgggtaccccggtaggggttaacccgg

SEQ ID NO: 213012 - DNA, 561 bp, Homo sapiens
  misc_feature: GYAE6OF02IC35H.21.27.C05.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (379)..(379): a, c, t, g, unknown or other
  misc_feature (379)..(379): n is a, c, g, or t
  modified_base (395)..(395): a, c, t, g, unknown or other
  misc_feature (395)..(395): n is a, c, g, or t
  modified_base (548)..(548): a, c, t, g, unknown or other
  misc_feature (548)..(548): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccacctctcctgcacagccagtcagtctatcgctgacttggttagcctggtaccagcagaatctggccaggctcccaggcctcctctactttaccgngcactccaccgagggcccacgttggtcgtcccagactaggttcaggtggcggtgtagtttgggactagtacgtttcnctcacctatcacgccncctacagtagtagaagagtgttcgacgttagttttattctcgcctagactaaattacttaagttactggtacctggtacgttccggtaacgttcggacgaacgggacctaaggtacggaaagtacgaaacgtagtcgtacgcgtgaccgactntcgtcgtcttacg

SEQ ID NO: 213013 - DNA, 622 bp, Homo sapiens
  misc_feature: GYAE6OF02JC8AQ.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactgggtgaggccctcgcagtaccctttcactcacctgtgacatcgtaccggggaaaatgtcgctggcaacatggtgattggatagcagtcccgtcgagagccttgagtgcgttggaagtactattactacgtcccagtggtatggaacgtactataggacagtattacgtgtgacggtcggttcgtctactacctacgtcctaaccccgagacctacgtaccaaagtactacgtacgggtcctaccccgtacctaacctaacgtcgttactcgtacctaaccgtcccggaaccgacgtaccggtaccttagttttacgttttacgacgtacgaacggtagggtactacgtaacgtacgttcggtacgtaccgttacccgttaccgttacgtcccgttccggtacgggtccgtagggttaaccgg

SEQ ID NO: 213014 - DNA, 548 bp, Homo sapiens
  misc_feature: GYAE6OF02HNZOH.21.27.C05.1.454.CMB.1.raw
  modified_base (466)..(466): a, c, t, g, unknown or other
  misc_feature (466)..(466): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtcgtctcaccatcaccccagacacgtcaagaatcaggtcctccctccaccttaatcgtctgtcactcccgacgacacggctagttttacttttgngtacaaggagggataccgactacttcggtacgtaccttaccttccttcgaccttcccggtgggtacccgtagggttaaccgg

SEQ ID NO: 213015 - DNA, 585 bp, Homo sapiens
  misc_feature: GYAE6OF02JA8SC.21.27.C05.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
  modified_base (384)..(384): a, c, t, g, unknown or other
  misc_feature (384)..(384): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggcctggcctcccgaggcctcctctatttaccgngccatcccaccgagggcccacgttggtcgtcccagactaggttcaggtggcggtaggtagtttgggactagtagttttcnctacaccgatcgacgcccgaccctaacaggacgtagaaagtagttgttgacttagttttattctacgacctagtataattaattaacttacgtggtccttagcgttcgacggttcggacccgacgggtaaccagggtagaaacgtacgaaaccgtacgtaggtacggtactacgacctacgtacgtcttagttacttaccg

SEQ ID NO: 213016 - DNA, 666 bp, Homo sapiens
  misc_feature: GYAE6OF02HMHQQ.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcagtaccctttcactcacctgtgacatcgtaccggggaaatgtcgctggacaacgaagtggttaggtaattggattacggctacggtccccgtgaagtacggccttggagtggtcttagggaacggtaccttagttaacgtaccggtcctaaggttcggtaagtagaaagtacgtagtggactagtactttacgtggtacgacggtccggttcgtactactaccgtacgtccaaccccgagtaccgaccggtaccaaaggtaactcgaacggtcccttaccccgtaccctaaccgtaactcgtcctacgtacctaccgtacccgacgaccgtacggtaccttacgttttactttgacgtacgaaggtacgggtctacgacgttacgttacggtacgtacccgttaccttcgttacggaccttcccgggtacgggtaccgtacgggttaaccg

SEQ ID NO: 213017 - DNA, 594 bp, Homo sapiens
  misc_feature: GYAE6OF02I35TX.21.27.C05.1.454.CMB.1.raw
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
  modified_base (354)..(354): a, c, t, g, unknown or other
  misc_feature (354)..(354): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggcccctcgcacgtaccctttcactccacctgtcgacatcgtaccggggaaatgtcgctggcaacaagtggttaggaattggattaggctacgtcccgtggagnggccttgngtggctggaagtctatatacgtccagtgtatagaanactatgcagtattcgtgtggacggtcggtcgtctaccacctactacccaccctaagacctacgtaccaaagactccgaacggtcccttaccctccaaccttagtcgtcctcgtaccaccgtacccgaacgaccgtacggtacttacgtttttattcggtacgacgtaagacggtactcgaacttcggttcgtacgtaccctacgttcttcggacttccggcgggtacctaggttaacccg

SEQ ID NO: 213018 - DNA, 554 bp, Homo sapiens
  misc_feature: GYAE6OF02GGVMV.21.27.C05.1.454.CMB.1.raw
  modified_base (201)..(201): a, c, t, g, unknown or other
  misc_feature (201)..(201): n is a, c, g, or t
  modified_base (294)..(294): a, c, t, g, unknown or other
  misc_feature (294)..(294): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccaggggggancgccacctctcctgcacagccagtcagtctatcgctgactggttagcctggtaccagcagaaatctggcaggctccaggctcctcattaccgngcatccacagggccacgtggtgtcccagacaggttcagtggcggtggagtttgggactaggtatttctctcaccatcagccgccctagagagtgaagatgttgctagtttattctgtccagcaagttataattacgtggtacctggtcgtacgtacgttcggacgtaaccgggacgtaaggtacggtaaacgtacggaaaccgtaacgtagggttcggtacgttacggacgaaccctacgttaccgttagttccttaccg

SEQ ID NO: 213019 - DNA, 823 bp, Homo sapiens
  misc_feature: GYAE6OF02IVXT1.21.27.C05.1.454.CMB.1.raw
  modified_base (205)..(205): a, c, t, g, unknown or other
  misc_feature (205)..(205): n is a, c, g, or t
  modified_base (252)..(252): a, c, t, g, unknown or other
  misc_feature (252)..(252): n is a, c, g, or t
  modified_base (261)..(261): a, c, t, g, unknown or other
  misc_feature (261)..(261): n is a, c, g, or t
tcagtcgtcgctcgcacgaccggtgctcgatttagacgcgatcgaagggtttgggggagggaacgtgctcagttaggacccagacggagccatggaagccccagcgcagcttctcttcctcctgcttctctggctcccagacaccactggagtgattgtgatgacgcagtctccagccacctgtcctgtgtctccgaggggggancgccaccctctcctgccacagccagtcagtctatcgctgactggtancctgtaccngacagaactcaggccaggcctccgaggccttccgtactacgtttaccgtgacctactccccaccggacggtcccaacgttgggtctacccccgaagaccgtaacggtttccgaacgggtcgggtccgggtttaaggtaacggtttttagggggaacctaagggtttacggtttttttaccccacgttacccgaaacccttaacgttcgaaccggttccccgtaaccccgttaagtaacgggaacgtttacgggaaaacggttagttacgggtttacggtaccgtttaaggttttttacttttacccggtacgggaccccttaaaggacctttaaaacgtttaacgtttaaaagttttacccgtacgggttacccgttaggttccccggggtaaacctttaccggggtttccccggaaccggtaaaccggggtaccccgtaaagggtttaccgggaaaaccttaaacccggtaaaacgggttaacccgtttaggggttacccggtacttacggaaacccgttaacccggtacgtttaccggtttacgtttccgtttaaccccg

SEQ ID NO: 213020 - DNA, 661 bp, Homo sapiens
  misc_feature: GYAE6OF02IZA22.21.27.C05.1.454.CMB.1.raw
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagcccaccctgtctgtgtctccgaggggggancgccaccctctcctgcacacgccagtcagtctancgctgactggttacnccgtggtaccagcaagaaatcgtggccaggcctccgaggcctcctctactttaccgcgactactcccgaaccgacgggccctacggtcggtacgtcccgaggtacgtggttacgagggtcgggcgggttaggtaggtttgggaactaggttacgttttctcttaccaacctatccgacgtccgaccctagaacggagtaggaagtagttgttacgtacgtttaagttttacgttcgtcgtacccgtaagaactaaagttaacttaacgttacctgggtaccgttggtaccgttaccgggtaccggtttacccgggaccggtaacgggtaaccgtaagggtacgtaaacgtaaccgaaaacggtacgtggtcgtacgtacgactaaccgtattcggtacgttccttaccg

SEQ ID NO: 213021 - DNA, 543 bp, Homo sapiens
  misc_feature: GYAE6OF02IVDE6.21.27.C05.1.454.CMB.1.raw
  modified_base (477)..(477): a, c, t, g, unknown or other
  misc_feature (477)..(477): n is a, c, g, or t
  modified_base (499)..(499): a, c, t, g, unknown or other
  misc_feature (499)..(499): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctacggggaaaatgtcgctggcaacaatggttggaattggattaggcagtccccgtgagaggccttgagtggcttggaaggcctattatacgtcccagtggtatgaagactatgcagattctgtgagcggtctctcaccatccacccagaccacgtaccaagaatcgacggtctcccgtacacccttaatcgtctgtccactacccgacgacgacgtcagttttcttttgtgcaaggngtactcgtactacttccggtanaccttaccttccttggtacctcgtcggggtccgaggttaaccgg

SEQ ID NO: 213022 - DNA, 651 bp, Homo sapiens
  misc_feature: GYAE6OF02H33RM.21.27.C05.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (284)..(284): a, c, t, g, unknown or other
  misc_feature (284)..(284): n is a, c, g, or t
tcagtcgtcgctcgcacgaccggtgctcgatttagacgcgatcgaagggtttgggggaggaactactcagttaggacccagacggagccatggaagccccagcgcagcttctcttcctcctgcttctctggctcccagacaccactggagtgattgtgatgacgcagtctccagccaccctgtctgtacgtctccgaggggggncgccaccctntcctgacacgagccagtcaagtctatcgctgactggtacnctgcagnagatngcaggctccggctccgtntacttacctgacatccaccgacggtactacgtcggtctaccgagtaccgtaggttccgaaggtcgggtacggtcggtaattagggaactaggtacgttttcacttacgacctagtcgtacgcccgtaccttacgaacggttaagtagaaacgtagttacggttacgacgttaagttttacttcgtacgtaccgtagaccgttaaagtaacgtaacgtttacgtcgggtaaccttggtccgtaccggtacgttaccgacccggacggtaaccgtaacggaggtaaacctcgtaaaaccggcgtacggttacggccgtttaacgacgtaccgtacgttaccgttacggtttactacgtaccttacccgg

SEQ ID NO: 213023 - DNA, 654 bp, Homo sapiens
  misc_feature: GYAE6OF02JGK1D.21.27.C05.1.454.CMB.1.raw
  modified_base (203)..(203): a, c, t, g, unknown or other
  misc_feature (203)..(203): n is a, c, g, or t
  modified_base (325)..(325): a, c, t, g, unknown or other
  misc_feature (325)..(325): n is a, c, g, or t
  modified_base (416)..(416): a, c, t, g, unknown or other
  misc_feature (416)..(416): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggganccgcccacccttctcctgcacacgcctagtcagtctatcgctagacttggttacgccgtcggtaccagacaagaaactcgtcggcccaggcctccccgaggccctcctactacgtttaccgngaccactcccgaccgacgggccctacgtcggtcgtcccagacgtaggttcaggtcgggcggtggtagtttagggactaggttcgttttccnctaccacctagtacgacgtcccgtaccctagaaggagtagaagtagttggtcgtcgttaagttttactttcgtcgaccgtaagtactaattacgttaaattaccgtcggtacctgtccgttacgttaccggttccggaaccggtaccgggaacgtagggtaagtaaacgtaaccgaaacggtaacgttcggttacgtacgttacggacctaaccgtacgttccgttacgttcttaccg

SEQ ID NO: 213024 - DNA, 574 bp, Homo sapiens
  misc_feature: GYAE6OF02I5M5F.21.27.C05.1.454.CMB.1.raw
  modified_base (300)..(300): a, c, t, g, unknown or other
  misc_feature (300)..(300): n is a, c, g, or t
  modified_base (422)..(422): a, c, t, g, unknown or other
  misc_feature (422)..(422): n is a, c, g, or t
  modified_base (441)..(441): a, c, t, g, unknown or other
  misc_feature (441)..(441): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactcagcagtctggtccaggactggtgaggccctcgcagaccctttcactcacctgtcgacatcgtaccggggaaaatgtacgctggcaacaatggttgattggattaggcagtcccgtcgagnggccttgagtggcttggaaggactattatacgtccagtgtatgaagtactatgacagattctgtgagcggtcgtctcaccacgtaccacccagacctacgtccaagactcacggtcctcccncctacctaatctctgtacncctacccgacgaccgaccggtcctaagttttacttttcgagtactaacggaggtactactaacgttacgttcggtacgaccttaccgttcccttcggtaccgttccgtaccggggtaccgtaggggttaaccg

SEQ ID NO: 213025 - DNA, 630 bp, Homo sapiens
  misc_feature: GYAE6OF02F3ZQR.21.27.C05.1.454.CMB.1.raw
  modified_base (203)..(203): a, c, t, g, unknown or other
  misc_feature (203)..(203): n is a, c, g, or t
  modified_base (396)..(396): a, c, t, g, unknown or other
  misc_feature (396)..(396): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttacgcctggtaccagcaagaatcgtggccaggcctcccgaggcctcctctatttaccgtgcactcccaccgacgggccctacgtcggtcgtacccgagacgtacggttcaggtgggcggtaggtagtttgggactagttacgttttccnctcactatcacgtccgtaccctagagtagtagaagtacgttgttcgtacgttaagttttactttcgtcgtaccgagtactaaattaattaacgttacgtcggtaccgttggtcggttaccggtacggttccggaaccgtaaccgggtaacgtagggttacggaaacgtaaccgtaaacggtacggtaggtacggtacctacggacctaccgtacgttcgttacgttccttaccg

SEQ ID NO: 213026 - DNA, 625 bp, Homo sapiens
  misc_feature: GYAE6OF02I099M.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtgtcctgtcacagatcaaactacagcagtctggtccaggactggtgaggccctgcagaccctttcactcacctgtgacatcgtacggggaaaatgtcgctggcaacaatggttggaattggattaggcagtccccgtgagaggccttgagtggcttggaaggtacctattatacgtcccagtcggtatgaagactatgcagattctgtagagcggtcgtctcaccgactcaccccgaagaccacgtaccaagtaactaccgaacggttcctacccgtaccctaacctaacgtcgttactcgtaccacccgttaccccgaaccgaccgtaaccggtaccttaacgttttacgtttttcgtacgtaccgaaggtacggtaacgtactaacgtaacgttaccgggtacgtaaccgttacccgttaccttacggtaccgttccggtcggggtaccgtacgggtttaacccgg

SEQ ID NO: 213027 - DNA, 578 bp, Homo sapiens
  misc_feature: GYAE6OF02IATGJ.21.27.C05.1.454.CMB.1.raw
  modified_base (206)..(206): a, c, t, g, unknown or other
  misc_feature (206)..(206): n is a, c, g, or t
  modified_base (309)..(309): a, c, t, g, unknown or other
  misc_feature (309)..(309): n is a, c, g, or t
  modified_base (389)..(389): a, c, t, g, unknown or other
  misc_feature (389)..(389): n is a, c, g, or t
  modified_base (426)..(426): a, c, t, g, unknown or other
  misc_feature (426)..(426): n is a, c, g, or t
  modified_base (445)..(445): a, c, t, g, unknown or other
  misc_feature (445)..(445): n is a, c, g, or t
  modified_base (563)..(563): a, c, t, g, unknown or other
  misc_feature (563)..(563): n is a, c, g, or t
tcagtcgtcgctcgcacgaccggtgctcgatttagacgcgatcgaagggtttgggggaggaactgctcagttaggacccagacggagccatggaagcccccagcgcagcttctcttcctcctgcttctctggcctcccagacaccactgggagtgattgtgatgacgcagtctccagccaccctgtctgtgtctccgagggggganccgccaccctctcctgcacagccagtcagtctatcgctgactggttagcctggtaccagcaagaatctggccaggcctcccgaggcctcctactatttaccgngactatccaaccgagggccacgtggtcaccgagactaggttcaggtcggacggttggtagtttggactggttacttttcnctcaactatcacggccaccctaagaggagtagaagtnttagttgtacttaagtttnttcgtacgtactagtactaattattaacgttacgtcgtctcggtcgtaccgtacggtcgaccgaacgggaccgaaggtacgaacgtcgaaacgtacgtagtcggactcgaccaacgtntcgtcgttactaccg

SEQ ID NO: 213028 - DNA, 676 bp, Homo sapiens
  misc_feature: GYAE6OF02H91HW.21.27.C05.1.454.CMB.1.raw
  modified_base (203)..(203): a, c, t, g, unknown or other
  misc_feature (203)..(203): n is a, c, g, or t
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtanccgtggtaccagcagaatctggccaggctccaggcctcctactactttaccgngcactccacgagggcccacgttggtcgtcccaagacgtacggttcgaggtcgggcgggttaggtagtttacggggaactagggttaacgttttctccgttaccacctattccgacggtacccgtaccccttaacgaaggtacggttagaaacgtaagttagttacggtactttagttttacgtttcgtacgtaccgtagtactaaattaagtttaaacgtttaacgtcggtaccttagggtaccgttccggttaaccggttcgggacccgaacgggtaccgtaagggtacggaaacgttaaccggaaaacgtaacggttacggtaccggtacgttacggaccctaaccgtacgttccgtacgttaccttaaccg

SEQ ID NO: 213029 - DNA, 644 bp, Homo sapiens
  misc_feature: GYAE6OF02GQ5LS.21.27.C05.1.454.CMB.1.raw
  modified_base (203)..(203): a, c, t, g, unknown or other
  misc_feature (203)..(203): n is a, c, g, or t
  modified_base (311)..(311): a, c, t, g, unknown or other
  misc_feature (311)..(311): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttacgcctggtaccagcaagaaatctggccaggcctcccgaggtcctccctcgtacttttaccgngcctactcccaaccgacgggcccacgttcgggtctcccgaagctacggttcaggtcgggcggttggtagtttgggaactaggttagttttccnctccaacctntcacgccnccctagagagtagaagtattgttgattagttttacttcgtcgacctaagtactaaattaacttaacgttacgtcgggtccttggtccgttacggtaaccgggttcggaaccggtaaccggggaaccgtaagggtaacggtaaacgtaaccggtaaaaccggtaacgttcggtacgggtacctacggaaccgtaaccctacgttcgttaccgttcttaacccg

SEQ ID NO: 213030 - DNA, 553 bp, Homo sapiens
  misc_feature: GYAE6OF02IBGS0.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctaggtacccagcaagaaatctggccaggcctccgaggcctcctcatttaccgtgcatcccaccagggccacgtgggtcgtcccagacaggttcaggtcgggcggtggtagtttgggactagtgttttctctacacctatcagccgcccacgagagtagaagtgttagttgcgtagttttattcgtcgccagtctaataattaattactggtacctaggtcgtacgtacgtccgaccgaacgggaccagggtcgaaatacgaaaccgtacgtagtacggactcgacacgactctgtcttac

SEQ ID NO: 213031 - DNA, 575 bp, Homo sapiens
  misc_feature: GYAE6OF02JHXE0.21.27.C05.1.454.CMB.1.raw
  modified_base (202)..(202): a, c, t, g, unknown or other
  misc_feature (202)..(202): n is a, c, g, or t
  modified_base (396)..(396): a, c, t, g, unknown or other
  misc_feature (396)..(396): n is a, c, g, or t
  modified_base (430)..(430): a, c, t, g, unknown or other
  misc_feature (430)..(430): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcaagaatcgtggccaggcctcccgaggcctcctctatttaccgtgccactcccaccgacgggccacgtggtccgtacccagaccgtaggttccaggttcgggcggttaggtagtttggggactaggtacgttttcnctcaccatcgacgtcgaccctagagagtgaagtntgtgacttagtttattctgacctagtactaattataacgttacgtcgtctgtacgtacgtacgttccggaccgaccgggtaaccgtagggacgtaagtaccgaaacgtacgtgtacggactcgaccactagtcgttcgtcttacg

SEQ ID NO: 213032 - DNA, 696 bp, Homo sapiens
  misc_feature: GYAE6OF02JVFMK.21.27.C05.1.454.CMB.1.raw
  modified_base (202)..(202): a, c, t, g, unknown or other
  misc_feature (202)..(202): n is a, c, g, or t
  modified_base (252)..(252): a, c, t, g, unknown or other
  misc_feature (252)..(252): n is a, c, g, or t
  modified_base (317)..(317): a, c, t, g, unknown or other
  misc_feature (317)..(317): n is a, c, g, or t
  modified_base (665)..(665): a, c, t, g, unknown or other
  misc_feature (665)..(665): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgacacagccagtcagttcatcgctcgacttggtacncctggtaccagcaagtaactcgtcgacctacggcctacccgaggtcctcctactacttttaccgngcctactccacccgagggccctaacgtcggttaccgtacccgaaggacctaacgggtttcaacggggttgggaccgggttaggtacgttttcggggaactacgggttaagtttttccctcgtaccaacgtactcgtacgcccgtccctaacgaggtacgtaggtaaagtacgtttcggttaacgtcgtttaacggttttacttttaccgacgtacccgtaagtaccgtaaaagtttaactttaaacgtttacgccggttacgttcggtaccggttaccggtacggttaccggaccgaacgggtaaccgtagggtaacgtaactacggaaacgtaccgtagtacggtanacgtaccaattactcgttacgttccttaacg

SEQ ID NO: 213033 - DNA, 689 bp, Homo sapiens
  misc_feature: GYAE6OF02GOXMO.21.27.C05.1.454.CMB.1.raw
  modified_base (203)..(203): a, c, t, g, unknown or other
  misc_feature (203)..(203): n is a, c, g, or t
  modified_base (251)..(251): a, c, t, g, unknown or other
  misc_feature (251)..(251): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttacnccgtggtaccagacaagtaaatctcggccaggcctcccgaggcctcctactactttaccgtgacactcccaaccgacgggccctacgttggtcgtcccaggactaggttcaggtcggcggttggtagtttcgggactaggttacgttttcctctacctacctataccgacggcccgtaccctaacgaaggtaggtagaagtagttggttacgacttagttttactttcgtacgtaccgagtacttaaagttaacttaacgtttacgtacgggtacccttgggtaccgtttaccggtaccggttcccggaacccggaacccggggtaaccgtaaggggttaaccggtaaacgttaaccgtaaaaccgggtaccgttagggttaccggtaccgttacgggtacctaacccgtactttaccgttacggttacctttacccg

SEQ ID NO: 213034 - DNA, 625 bp, Homo sapiens
  misc_feature: GYAE6OF02H8XEN.21.27.C05.1.454.CMB.1.raw
  modified_base (202)..(202): a, c, t, g, unknown or other
  misc_feature (202)..(202): n is a, c, g, or t
  modified_base (315)..(315): a, c, t, g, unknown or other
  misc_feature (315)..(315): n is a, c, g, or t
  modified_base (404)..(404): a, c, t, g, unknown or other
  misc_feature (404)..(404): n is a, c, g, or t
  modified_base (447)..(447): a, c, t, g, unknown or other
  misc_feature (447)..(447): n is a, c, g, or t
  modified_base (454)..(454): a, c, t, g, unknown or other
  misc_feature (454)..(454): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagccacctgtctgtcgtctccgagggggnccgccaccctctcctgcacacgccagtcagtctatcgctgactggtacgccgtaggtaccagctaagaactcgtggccaggtcctcccgaggcctccgtactacgtttaccgncctactccaccgacgggccacgtgtccgaccaggactaggttcaggtcggtacggtggtactttacggggactaggttacgtttttccncgtaccgactagtcgacgccgtacctacagtagtacgaaagtntcgttanacttaggtttacttcgagtaccagtactaaattacttaacgttacgtacggcctaggtccgtacgtacggttacggaccggaaccggaacgtacgggtaacggaacgttaaccgaaacgtacgttcggtacgtcgtacggtaccaccgtattcccgttagttccttaaccg

SEQ ID NO: 213035 - DNA, 872 bp, Homo sapiens
  misc_feature: GYAE6OF02H1HA2.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatacaaactacagcagtctggtccaggactggtgacggccctgcacgtaccctttcactcacctgtgacatccgtacggggaaaatggtccgcgtggacaaacgtaagttacgggttaggtaaagtttagggtaacgtttaagggtaccgtaccggttcccccccggtaacggtaacggtaacgggtcccgtttaggtacggttacgggtaccggttttaacggggaaacgggttaacccgttaagtttaaccgttaacccggttaccccgtaagggttacggggttaacgttacgggtaaacggtaaccgttaagtacggtaccgttaagggtaacttttccgtaggttacggtacgggttacccggggttaccgtttacccgttacccgtaaccctaacgttacccccgaaacccccggtaacgtaacccgtaaaccggttaacccgaaaacgtaacctaccggtaaccggttcccttacccccgttaaccctaaccgttaaacgttcgtacctaccgtaccgtaacccgtacccggaaccgtaaccgtaccggtaccttttacgtttttagttttaccggagtaaccgtaaggtacgggttaactccgtaacgttacggtttaccggtacgttaacccttacccgtttaccgttacggtacccgttccggtacgggtacccggtaaggtttaacccgg

SEQ ID NO: 213036 - DNA, 680 bp, Homo sapiens
  misc_feature: GYAE6OF02JNL14.21.27.C05.1.454.CMB.1.raw
  modified_base (213)..(213): a, c, t, g, unknown or other
  misc_feature (213)..(213): n is a, c, g, or t
  modified_base (333)..(333): a, c, t, g, unknown or other
  misc_feature (333)..(333): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggccgcccacctctcncgacacgagccagtcagtctactcgctgacttggtacgcctggtaccagcaagaaactctaggcctaggcctacccgaggcctcccgtctaacgttttaccgcgacctactccccgaccncggggtaccctacggtcgggtaccgtccccgaagaccgaccggtttacgagggttcgggccgggtagggttacggtttaggggacctaggtacgtttttccgacgtcccacgtactcgacgccgtaccctagtacggagtacgaagtacgtacgttgtacgttagtttacttttacgcgtaccagtacaagttaataacttttaccggtgtacccgttaggttccgtaccgttaccgggttaccggacccggtaacggggtacccgtagggttacggaaaccgtttacggaaaacgtacggttaggtaccggctacggaccgacgtacgttcgttcgtactttaccg

SEQ ID NO: 213037 - DNA, 643 bp, Homo sapiens
  misc_feature: GYAE6OF02GPN2D.21.27.C05.1.454.CMB.1.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
  modified_base (384)..(384): a, c, t, g, unknown or other
  misc_feature (384)..(384): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggganccgccaccctctcctgcacagccagtcagtctatcgctgactggttagcctggtaccagcaagaaatcgtggccagggcctcccgaggcctcctctactttaccgncactccacgacgggccacgtggtcgtcccagactaggtcaggtggtcggtgagtttgggacaggtacgttttcnctcacctatcgagccgtaccctacgaggagtaggaagtagttggttacgtacgttaggttttaactttcgtacgtacctaacgtactaaaagttaattaaacgtttacgtacgggtcccttagggtcccggttaccggtaccgggttcccggaacccgtaaccgggggtacccgtaaggggttacggtaaacgtaaccggtaaacggtaacgttggtacggtcgtacggacctaccgtattccgttacgttaccttacg

SEQ ID NO: 213038 - DNA, 752 bp, Homo sapiens
  misc_feature: GYAE6OF02JVB4Q.21.27.C05.1.454.CMB.1.raw
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
  modified_base (342)..(342): a, c, t, g, unknown or other
  misc_feature (342)..(342): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctacccagacaccactggagtgattgtgatgacgcagtctccagccaccctgtctgtgtctccgagggggacnccgccaccctcgtcctgacacagccagtccagtcctagtccgntagacttggttacgccgtaggttacccagctaagtaaactccgtaggccctaagggccttaccccgaggtcccttccgtctaacgttttacccgngcctactccccgaaccgtacgggtccctaaggttcggtccggtaccccaaggtaccgtaggtttcccaagggttcgggaccggttggtaacgtttgggggaaaccttaggttacgtttttcaccgttaccgaaccgtagtccgaacgtcccgtaccctaacgtaggtacgtacggtaaagtacgttggttacgcgtttaacggttttacgttttccacgggtaccctagtaacctaaagtttaacgttaaacgttttaacgtcgggtaccgttggcccggttacggttaccggttaccggacccggtacgggtaccgaagggttacggtaaactaaccggttaaaccgtaacttcgggaccggttacgacgggtaaccctaccgtacgttacttacggttaccttaccgg

SEQ ID NO: 213039 - DNA, 559 bp, Homo sapiens
  misc_feature: GYAE6OF02IHK5D.21.27.C05.1.454.CMB.1.raw
  modified_base (311)..(311): a, c, t, g, unknown or other
  misc_feature (311)..(311): n is a, c, g, or t
  modified_base (379)..(379): a, c, t, g, unknown or other
  misc_feature (379)..(379): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgtaccctttcactcacctgtgacatcgtaccggggaaaatgtcgctggcaacaatggttggaattggattaggcagtccccgtgagaggccttgngtggcttggaagacctattactacgtccagtggtatgaagactatgcagattctgtgagcggtcgtcncaccatccaccccagacacgtacaagaactcacggtccttccctaccacctaatcgtctcgtcacctcccgacgaccacggtctagttttatttgagtacgaagaggactacgactagtttcgggataccttaccgttccttacgtaccgttccgtacggggtcccgtagggttaaccgg

SEQ ID NO: 213040 - DNA, 667 bp, Homo sapiens
  misc_feature: GYAE6OF02GH1YL.21.27.C05.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggtacgcctggtaccagcaagaaactctggccaggcctcccgaggtcctcctctactttaccgngcactccaaccgagggcccacgttggtcgtacccaggacctaggttcgaagggtcgggtcgggttaggtagtttacggggactaggttacgttttcctcgtaccaaccgtactcgaacggtcccgaccctaagacggtaggtagaaagtagttcggttacgtacgttagttttacttcgtacgtcctaagtactaaattaacttaattaccgtcggtaccttcggtaccggttccggttaccggtccggaccgtaaccgggaccgtaagggttacggaaaactacccggtaaaacggtaccggttcggtacggtaccgtacgtacccgtacgttaacctcgttaccgttacttacccg

SEQ ID NO: 213041 - DNA, 580 bp, Homo sapiens
  misc_feature: GYAE6OF02F5NSJ.21.27.C05.1.454.CMB.1.raw
  modified_base (224)..(224): a, c, t, g, unknown or other
  misc_feature (224)..(224): n is a, c, g, or t
  modified_base (436)..(436): a, c, t, g, unknown or other
  misc_feature (436)..(436): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttnactcacctgtgacatctccggggaaaatgtcgctggcaacaatggttaggaattggattaggcagtccccgtgagaggccttgagtggcttggaagacctattatacgtcccagtgtatgaagactatgcagattctgtgagtcggtcgtctcgaccatccacccagacacgtccaaagatcacggtctccctcctactaatcgtctgtccnccgtacccgacgacctaccggtcttaacgttttattttcggtacgtaccgaagtagggtactaccgaacgtacgtttacgggtacgtaccgttacccttccgttccgtaccgtcccggtacggggacccgtagggttaacccgg

SEQ ID NO: 213042 - DNA, 711 bp, Homo sapiens
  misc_feature: GYAE6OF02IFXX9.21.27.C05.1.454.CMB.1.raw
  modified_base (202)..(202): a, c, t, g, unknown or other
  misc_feature (202)..(202): n is a, c, g, or t
  modified_base (319)..(319): a, c, t, g, unknown or other
  misc_feature (319)..(319): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctctcctgcacacgccagtcagtctatcgctgactggttacgcctggtaccagcaagaaactcgtaggacgaggcctccccgaggtccctccttactacgttttacccgngtacctacgttccccaaccgtacgggccctacgttcgggtcgtccccgaagacctagggttcgacggtggggtccgggttagggtagttttcgggggaactagggtttacggtttttccctccgttaccgtaaccctgttaccgacggtcccgtaccccgttaacgacggtaggttacggaagtagttcggttacggacttacgttttattccgttcgacctacgtactaaattaacttaactttacgtcggtccgtcggtaccgttaccggttaccggttccggacccggtaccggggtaaccgtacgggtacggtaaaccgtaacgtaaaccggtaacgtgggttaccgtacgtcgacccgtaaccgtacgtccgttacggttccttccg

SEQ ID NO: 213043 - DNA, 556 bp, Homo sapiens
  misc_feature: GYAE6OF02FKJWN.21.27.C05.1.454.CMB.1.raw
  modified_base (203)..(203): a, c, t, g, unknown or other
  misc_feature (203)..(203): n is a, c, g, or t
  modified_base (388)..(388): a, c, t, g, unknown or other
  misc_feature (388)..(388): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcaagaaatctggccaggcctcccaggcctcctctactttaccgtgccatcccaccgacgggcccacgtggtcgtcccagtacctaggttcaggtgggcggttggagtttgggactagtacgttttcnctcaccatcagccgtcctacagagtagaagtattgtgtcttagttttattctcgcctagtctaattattaattacgtggtcctgtccgtcgtacgtccggccgaccgggacgtaggtacgaacgtacgaaacgtactcggtaggtctcgactacctagtctcgtcttc

SEQ ID NO: 213044 - DNA, 576 bp, Homo sapiens
  misc_feature: GYAE6OF02GC7A9.21.27.C05.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (380)..(380): a, c, t, g, unknown or other
  misc_feature (380)..(380): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccaggcctcctcatttaccgngcactccaccgagggcccacgtggtcgtcccagaccaggttcaggtggcggtggtagtttgggactaggtagttttcnctcaccatcagccgtacctacgaggtagtagaagtactggttgcttagttttactttctcgacctagctaaattattaaacttcgtacggtcctgtcgttacgtacgttccggaccgtacgggaaccgaggtacggaaacgtacgaaaacggtacgtaggtacggacgtcgacctacctagtccgtagttcttacc

SEQ ID NO: 213045 - DNA, 697 bp, Homo sapiens
  misc_feature: GYAE6OF02H5F2P.21.27.C05.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (311)..(311): a, c, t, g, unknown or other
  misc_feature (311)..(311): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgntgactggttacgcctggtaccagcaagaaatcgtaggccaggcctccccaggccctcctctacttttaccgngccactcccaccgacgggccctaacgtcgggtccgtcccaaggtactacggtttccagggtcgggcggttgggtagttttcggggaactaggttagtttttccacgttccgacctacgttccgacgcccggtcccctaacgacgaggttacgaaagtagttgttacgtacgtttaagttttacttttacgcgttaccgaagtacctaaagtttaacttaaacgtttacggttcggtacccgttaggtccgtttaccggtaacccggtttcgggacccgtaacggggtaacccgtaagggtaccggtaaacgtaccggaaaaccgtacggtacggttacggtccgtacggtacccaaccgttacgtttcgttaccgttcgttaaccc

SEQ ID NO: 213046 - DNA, 612 bp, Homo sapiens
  misc_feature: GYAE6OF02H6Q9Z.21.27.C05.1.454.CMB.1.raw
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggccctcccagtgggggtgtcctgtcacagatacaaactacagcagtctggtccaggactgggtgacggcccctcgcacgtacccctttcacctcacctgtgacatccgtacgggaaatgtcgctggcaacaatggtggaattggattaggcacgtccccgtagagaggctgngtggnttggagactattagtacgtcagtgtatgagtacatgacagattcgtgtagacgtcggtcgtctcacctatccaaccccagacacgtccaagaactgaggtccctccctacctacctacttcgcttttcgactacccgtaccgaccgtaccgacggtacttacgttttacgtttacggtcgaccgtaaggacgggtacttaccgacttaacggtttccggtacgttacccgttacccttcgttaccgtaccggtttcccggacggggttacccgtaccgggtttaacccgg

SEQ ID NO: 213047 - DNA, 839 bp, Homo sapiens
  misc_feature: GYAE6OF02HICAQ.21.27.C05.1.454.CMB.1.raw
  modified_base (204)..(204): a, c, t, g, unknown or other
  misc_feature (204)..(204): n is a, c, g, or t
  modified_base (316)..(316): a, c, t, g, unknown or other
  misc_feature (316)..(316): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacncgccaccctctcctgcacagccagtcagtctatcgctgactggttagcctggtaccagcaagaatcgtggccaggcctcccgaggccttcccgtactaacgttttacccggngcctacgtccccgaaccgacgggtccctaacgttcgggtccgttaccccgaaggtaccgtaacgggtttcccaaggggttcggggtaccggggtttgggtaaacgtttttacgggggaaaccttagggtttaacggttttttccctaccgttaccgtaacccgtacgttaccgaaccgtccccggtaaccccgtaaacgtaacggtaaacggtaacggtaaacggtacgtttcgggttaacggtacgtttaaacgttttttacgttttaccgttacgggtaaccccttaagggtaacccttaaaagtttaaccgtttaaaacgtttaccggttacgggtacccgtttacggttacccgggtttaccggttaacccggggtttaccggtaaccccgggtaaacccgggggtaacccgtaaagggggttaccgggtaaaaccgttaacccggaaaccggttaaaccgtgggttaccggtaccgtacggaccctaaccgttacgttaccgtttcgttaccttaccg

SEQ ID NO: 213048 - DNA, 630 bp, Homo sapiens
  misc_feature: GYAE6OF02F6V9Q.21.27.C05.1.454.CMB.1.raw
  modified_base (205)..(205): a, c, t, g, unknown or other
  misc_feature (205)..(205): n is a, c, g, or t
  modified_base (257)..(257): a, c, t, g, unknown or other
  misc_feature (257)..(257): n is a, c, g, or t
  modified_base (399)..(399): a, c, t, g, unknown or other
  misc_feature (399)..(399): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagcccaccctgtctgtgtctccgagggggganccgccaccctctcctgccacacgccagtcagtctatcgctgacttggttacnccgtggtaccagcaagaaatcgtggccaggcctcccgaggcctcctctactttaccgtgctactccgaaccgacgggcctacgttggtccgtccagaccgtaggttcaggtggcggtggtagttgggactagtacgttttcnctacactatcacgtccaccctagaggtacgtaggaagtatttcggttacgtacgtttacgtttttaactttccgttcggtaccctagtacctaaatttaacgttaactttacgtcggtacgttcggtccggttaccggttaccggttcccgggaccaaccggggtaccaggggttaccgaaacgtacgaaaccgtaacgtgtcggactcgctaccgtatacttcgttctcc

SEQ ID NO: 213049 - DNA, 515 bp, Homo sapiens
  misc_feature: GYAE6OF02HIEQN.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (303)..(303): a, c, t, g, unknown or other
  misc_feature (303)..(303): n is a, c, g, or t
  modified_base (380)..(380): a, c, t, g, unknown or other
  misc_feature (380)..(380): n is a, c, g, or t
  modified_base (400)..(400): a, c, t, g, unknown or other
  misc_feature (400)..(400): n is a, c, g, or t
  modified_base (429)..(429): a, c, t, g, unknown or other
  misc_feature (429)..(429): n is a, c, g, or t
  modified_base (450)..(450): a, c, t, g, unknown or other
  misc_feature (450)..(450): n is a, c, g, or t
  modified_base (513)..(513): a, c, t, g, unknown or other
  misc_feature (513)..(513): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaaatctggccaggcctcccgaggctcctcattttaccgngcctatcccaccgacgggccacgtggtcgtcccagacctaggttcagtgggcggtggatttgggacagtagttttcnctcaccatcagccgccctanagagtgaagatgttgctagtttattcgtncctagactaatattaattacnggtcctgcgttcgcgttcgcacggacaggtagaatcaaacgtactgtgctgacaccatctgtntc

SEQ ID NO: 213050 - DNA, 643 bp, Homo sapiens
  misc_feature: GYAE6OF02JHYCG.21.27.C05.1.454.CMB.1.raw
  modified_base (345)..(345): a, c, t, g, unknown or other
  misc_feature (345)..(345): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgaccgtgctgggcctcccatggggtgtcctgtcacagatcaaactacagcagtctggtccaggactggtgaggccctcgcacgaccctttcactcacctgtgacatctaccggggaaaatgtcgctggcaacaatggttggaattggattaggcacgtccccgtgagaggcctgagtgcttggagacctattatacgtcccagtcggtagngaagactatggcagtactttctgtggagcggttcgtcgtcaccataccaacccctagaccaccgtacaaagtaataccgacgtcctcccgtaccctaactaacttcgtcctcggtacctaccgtaccccgtaacgacctaaccgggttcttaaacgttttttacgttttcggtacgacgtaacgggacgggtacttaccgtaaacgttacgtttacgggttaccgtaccgtttaacccgttccgtttacggtacccgtttccgggtacccggggtacggtaaccgggttttaacccgg

SEQ ID NO: 213051 - DNA, 847 bp, Homo sapiens
  misc_feature: GYAE6OF02H8FNG.21.27.C05.1.454.CMB.1.raw
  modified_base (204)..(204): a, c, t, g, unknown or other
  misc_feature (204)..(204): n is a, c, g, or t
  modified_base (253)..(253): a, c, t, g, unknown or other
  misc_feature (253)..(253): n is a, c, g, or t
  modified_base (321)..(321): a, c, t, g, unknown or other
  misc_feature (321)..(321): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactgggagtgattgtgatgacgcagtctccagccaccctgtctgtgtctccgaggggggancgcccacctctcctgcacacgccagtcagtctatcgctgactggttacnccgtaggtaccagcaagaatcgtcggccaggcctacccgaggtccctaccgtctaacgttttaccggngtacctaactcccgaacccggacggggccctacggttcgggtccgtacccgaacggtaacgtacgggtttacgaggggtcggggcgggttagggtacggtttaggggaacttagggtttacgtttttccgtaccttacccgtaacccgttaacgtccgtaaccggtaccccggtacccctttaaacggaacgggttaaaggtaacgggtaaaacggtaagtttacgggtttacggtaccgttttaaacggttttttaacgtttttacccgtacggttacccgtaaagtaaccgttaaaaatttaacgtttaaactttaccggtaccggttacccggtttacggtacccgggtttaaccggttaacccgggtttaccggggaaaccccggttaaccgggggtaaacccggttaaacgggggtaaacggttaaaacggtacccggtaaaaaccgttaaccggttagggttaccggtacggtaccggaaccctaacccggttacgtacgtttaccgttactttaacccg

SEQ ID NO: 213052 - DNA, 535 bp, Homo sapiens
  misc_feature: GYAE6OF02HMBXL.21.27.C05.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (302)..(302): a, c, t, g, unknown or other
  misc_feature (302)..(302): n is a, c, g, or t
  modified_base (375)..(375): a, c, t, g, unknown or other
  misc_feature (375)..(375): n is a, c, g, or t
  modified_base (413)..(413): a, c, t, g, unknown or other
  misc_feature (413)..(413): n is a, c, g, or t
  modified_base (427)..(427): a, c, t, g, unknown or other
  misc_feature (427)..(427): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcaagaaatctggccaggctcccaggctcctctatttaccgncatccacagggcccagtggtctcccagactaggttcaggtgggcggtggtagtttgggactaggtagttttcnctcaccatcacgccgcctacagagtagaagtattgtcnctagtttactttcngccagactaattataattactcggctgcgttcgtacgttcggaccgacgggaccaggtagaaacgtcgaaacgacgttgcggtctacgccaacctatctgtacttacg

SEQ ID NO: 213053 - DNA, 860 bp, Homo sapiens
  misc_feature: GYAE6OF02JS6IO.21.27.C05.1.454.CMB.1.raw
tcagtcgtcgctcgcacgaccggtgctcgatttagacgcgatcgaagggtttgggggtcgagagcctgctgacttctggctgaccgagggcgagtcaccggagctccagacaatgtctgtctccttcctcatcttcctgaccgtgctcgggcctcccgagtgggggtcgtcctgttcacagactacaaactacgagcagtctcggtccaggacgtggtgacggccctcgcacgtaccctttcacctcacctgtacgaccagtccgtaccgggggaaaatcggtccgtcgtcggactaaacgtaagttcgggttacggtaagttacgggtaagtttacgggacttaccgggtacccccggttggaacggtaccgggtccgtttgggtaacggttcggggtaccggtttaacggggaaacgggtaacccttagtttaaccgtaacccggttacccgtagggttacgggttactacgggtaaacgtaacggttaagtcggtacgtaacggttaacgtttcgttacgggtcggtacggtaccggtttccggtaccttaccgaacctacgtacccgaacccgagtacccgacgtaccgtaaagtaaccgttaccgtacgggttaccctaccccgttaccctaaacgttaaccgttgttaccccgttagtaccctaacccggtaccccggaaccgtacgtaccgggtaacctttttaagtttttccgtttagggtaacaccgggtaaaggtccggttaactacccggtatttaaccgggttaccggtacctttaaccggtacccgtttccggttaaccgtcccgtttaaccgggtacccggggtacccgttaggggtttaaccccg

SEQ ID NO: 213054 - DNA, 618 bp, Homo sapiens
  misc_feature: GYAE6OF02HNM3L.21.27.C05.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctcccatggggtgtcctgtcacagatcaaactacagcagtctggtccaggactggtgaggccctcgcagaccctttnactcacctgtgacatcctcggggaaaatgtcgctggacaacaatggttacggaatggattaggcacgtccccgtgagacggccttgagtggcttggaaggcctatatacgtccagtgtatgaagactatgcagattctgtgagcggttctctcacatccaccccagacacggtaccaaggataccgacggtcctacccgtaccaaccttaagtcgtccttcggttaccaccgttacccgacgacgaccgggacttagttttaacgttttcgacgtaccgtaaggtacgggtactaccgtaacgtacgtttaccgggacgttaacccgtttacccgttcccgtttaccggaaccgtttccccggtaaggggggtacccctaacggggtttacccgg

SEQ ID NO: 213055 - DNA, 587 bp, Homo sapiens
  misc_feature: GYAE6OF02H9QIS.21.27.C05.1.454.CMB.1.raw
  modified_base (201)..(201): a, c, t, g, unknown or other
  misc_feature (201)..(201): n is a, c, g, or t
  modified_base (312)..(312): a, c, t, g, unknown or other
  misc_feature (312)..(312): n is a, c, g, or t
  modified_base (398)..(398): a, c, t, g, unknown or other
  misc_feature (398)..(398): n is a, c, g, or t
tcagtcgtcgctcgcacgaccggtgctcgatttagacgcgatcgaagggtttgggggaggaactgctcagttaggacccagacggagccatggaagccccagcgcagcttctcttctcctgcttctctggctccagacaccactggagtgattgtgatgacgcagtctccagccaccctgtctgtgtctccgagggggggncgcccacctctcctgcacagccagtcagtctatcgctgactggttagcctggtaccagcaagtaaactcgtggccaggcctacccgaggtccctcctactacgtttaccgngctactccaccgagggccacgttggtcgtacccgagacgtacggtcaggtcggtcggtggtagtttgggaactggttacgttttcncgtaccactatcgacgccgaccctagagagtagaagtagttgttgacgttagtttactttctcgcagtacaattattaacgtagtcgcgtgtacgtcgtacggttcggaccgtacgggacgtaaggtacgtaacgtaacgaaacgtacgtaggtacgcgtacgaccgacctacgtaccgttgtacttac

SEQ ID NO: 213056 - DNA, 728 bp, Homo sapiens
  misc_feature: GYAE6OF02HFXT5.21.27.C05.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (305)..(305): a, c, t, g, unknown or other
  misc_feature (305)..(305): n is a, c, g, or t
  modified_base (397)..(397): a, c, t, g, unknown or other
  misc_feature (397)..(397): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctntcctgcacagccagtcagtctatcgctgactggttagcctggtaccagcaagaaatctggccaggcctcccaggcctcctctactttaccgngcactcccaccgacgggccacgtggtcgtacccagacctaggttacaggtcgggcggttaggtacgtttggggaactaggttacgttttccncgtacacctatccacggtcccgacccttaagaggtaacgtacggaaagtacgttggtttagtaccgttaaggtttttaactttcgtacgtacccgtaaggtaaccttaaaagtttaactttaaaacgtttaccggtacggttacccgttacgggtacccggtttaccggtttaacccgggtttcccgggaacccggtaaccgggggtaacccgtaagggggttaacggtaaaacccgttaaccggaaaaaccgggttaacggttacggttacgggtaccgttacggtaccctaaaccgttaacgtttacggttaccggttactttaacccg

SEQ ID NO: 213057 - DNA, 766 bp, Homo sapiens
  misc_feature: GYAE6OF02HP8HX.21.27.C05.1.454.CMB.1.raw
  modified_base (151)..(151): a, c, t, g, unknown or other
  misc_feature (151)..(151): n is a, c, g, or t
  modified_base (160)..(160): a, c, t, g, unknown or other
  misc_feature (160)..(160): n is a, c, g, or t
  modified_base (218)..(218): a, c, t, g, unknown or other
  misc_feature (218)..(218): n is a, c, g, or t
  modified_base (245)..(245): a, c, t, g, unknown or other
  misc_feature (245)..(245): n is a, c, g, or t
  modified_base (271)..(271): a, c, t, g, unknown or other
  misc_feature (271)..(271): n is a, c, g, or t
tcagtcgtcgctcgcacgaccggtgctcgatttagacgcgatcgaagggtttgggggcagagcctgctgacttctggctgaccagggcagtcacggagctccagacaatgtctgtctccttctcatcttcctgcccgtgctgggccctccngtgggggtntcctgcacagactacaaactacagccagtctggtccagggctggtagaccggtccctncgtactaccctttcactcacctggtanactatccggtacggggaaatcgtcgngtcggacaacgtagttggtaggtaagtagtagttacggccgtcggtccccgagacgtcggtacctaggtgtcggtacgttacggggaacgtaactttacggttactacccggtaccgtagggtacggttagttaaggaacgtacgtagtacggactaacggtatttccgggtagtcggtaacgggtccggtttaccgttccgtaaccgttacctaacccgttaccccgaccggtaaccaacccggtaaccgttaaccggaacgtaaccggcggttaccggtccccttaaaccccctaccgttaacgtaacgttcgttaccgtacccgttaacgtaccccgtaaccggtacccgtaccgtacgttacgttttacgtttttaacgtaggtaccgtacgtaggtacggtactacgtaacgttcggtacctacggttaccccttacggttaccgttacggacccgtttcggggtacggtacccggttaggttaacccgg

SEQ ID NO: 213058 - DNA, 828 bp, Homo sapiens
  misc_feature: GYAE6OF02F6VV7.21.27.C05.1.454.CMB.1.raw
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (347)..(347): a, c, t, g, unknown or other
  misc_feature (347)..(347): n is a, c, g, or t
tcagtcgtcgctcgcacgaccggtgctcgatttagacgcgatcgaagggtttggggggagaactgacgtcagttaggacccagacgggacgccatcggaagtccccagcggcagcttctcttcctcctgcttctctgctcccagacaccactggagtcgattcgtgactgacgcagtcctcgagccaccgtgtctgtcgtcgtccgaggggganccgccacctntcctgcacacgccagtacagtctagtcgcgttggacttggttacgccgtacggtaccaggacaagaaactccgtacggccacggcctacccgaaggtcctacctacgtaacgttttacccggngaccgtacgttccccgaacgacgggtccctaacggttcggtacgtcccaaggtaccgtagggttaccgaggttcgggtccggtttaggtaacgtttcggggaacctacggtttacgtttttccgaccgtaccgaacccgttagtccgacggtacccgtacccgttaacggacggtaacggttacggaaacggtacgtttagggtttaccgtaccgtttaaggtttttaaccgtttaccgttaccgggttacccgttaacggtaccttaaaggtttaaccgtttaaaacggttaccggttaaccggggttacccgtttacgggttacccggtttacgggttaacccgggttccgggtaacccgggaaccggggtaaccgtaagggtacggtaaaccgtaaccggtaaaaccggtacgttaccggtccggtaaccggttccgtaaccgtacccgttacgttccgttaccgttacctttacccg

SEQ ID NO: 213059 - DNA, 592 bp, Homo sapiens
  misc_feature: GYAE6OF02I1XPG.21.27.C05.1.454.CMB.1.raw
  modified_base (203)..(203): a, c, t, g, unknown or other
  misc_feature (203)..(203): n is a, c, g, or t
  modified_base (274)..(274): a, c, t, g, unknown or other
  misc_feature (274)..(274): n is a, c, g, or t
  modified_base (308)..(308): a, c, t, g, unknown or other
  misc_feature (308)..(308): n is a, c, g, or t
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgccacagccagtcagtctatcgctgactggttagcctggtaccagcaagaaatcgnggccaggcctcccaggcctcctcacgtttaccgngcactcccacgagggcccacgtggtcgtccagactcggtcaggtggcggtggtagttgggacagtgttttcncgtcacntcagccgacctacgagagtagaagtgtgtagtacttagtttatttcgtcgcctagactaattattaattacgtacggtccttggtccgttacgtacggttacggaccgtaacggggtaaccgagggtacggtaaaacgtacgaaaacgtacggttacggtaggaccgtacggacctaaccgtagttccgttacgtccgtttaccg

SEQ ID NO: 213060 - DNA, 702 bp, Homo sapiens
  misc_feature: GYAE6OF02GI9B2.21.27.C05.1.454.CMB.1.raw
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
  modified_base (310)..(310): a, c, t, g, unknown or other
  misc_feature (310)..(310): n is a, c, g, or t
  modified_base (406)..(406): a, c, t, g, unknown or other
  misc_feature (406)..(406): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctancgctgactgttacgcctggtaccagcaagtaatctggaccaggtcctcccgaggtcctccctatactttaccgngccactcccaccgtacgggcccagttcgggtctccccaagacgtacggtcgaggtcgggacggtggtaagtttcggggaactacgttagttttccncctacaacccgtatccgtaacgccgtaccctaacgacggtaaggtactaaaggcgttagggttacgacgttaagtttttactttacgttacggtacccaaggtaacctaaagttaaactttaaacttaacgttcgggtaccttacgggtcccggttacggttaacccgggtttcccgggacccgtaaccgggggtaccctaacggggtaacggtaaaccgtaacgtaaaaccggtaacggttaacggtcgggtactacgggtaccacccgttagtacccggttattcccgttaccg

SEQ ID NO: 213061 - DNA, 738 bp, Homo sapiens
  misc_feature: GYAE6OF02ITZHC.21.27.C05.1.454.CMB.1.raw
  modified_base (240)..(240): a, c, t, g, unknown or other
  misc_feature (240)..(240): n is a, c, g, or t
  modified_base (405)..(405): a, c, t, g, unknown or other
  misc_feature (405)..(405): n is a, c, g, or t
tcagtcgtcgctcgcacgaccggtgctcgatttagacgcgatcgaagggtttgggggcagagcctgctgacttctggctgaccagggcagtcaccggagctccagacaatgtactgtctccttcctcatcttcctgcccgtagctggcctcccatggggtgtcctcgtcacagatacaaaactcagcgagtctcggtccgaggacctgggtagacggcccctcgccacgtacccctttanaaccgtccaccgtgtcgactatcgtaccgggaaaatcgtcgacctggacaacgtaagtcggttaggtaagttaggtattacggctacggttccccgtggaagacggtccttggagtggtcggttaggaacggaccttattacgtacgtacccgtaggtcggtagngtaagtacgtagtcgacgtacgtattcgtggtgacgtcggtcgtacctacgaaccacgtacccaacccgaacgaccgtaaccgtaccgtaaatacgtaccgtaccggtacccttacccgtacccgtaaccgtttaaactccgttacccttagtacccgttaacccgtaccccgtaaccgtaccgttaaccgtccgtttaagtttttaacgttttccgaacgtacgtaacggtacggacttacccggaagtttaccgtacgggtacctacccgtttaccgttacccgtaacggtacccggttacggtccggggtaaccctagggtttaacccgg

SEQ ID NO: 213062 - DNA, 620 bp, Homo sapiens
  misc_feature: GYAE6OF02F4X5V.21.27.C05.1.454.CMB.1.raw
  modified_base (203)..(203): a, c, t, g, unknown or other
  misc_feature (203)..(203): n is a, c, g, or t
  modified_base (252)..(252): a, c, t, g, unknown or other
  misc_feature (252)..(252): n is a, c, g, or t
  modified_base (305)..(305): a, c, t, g, unknown or other
  misc_feature (305)..(305): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtcctccgagggggganccgccaccctctcctgcacagccagtcagtctatcgctgactggttacnctggtaccagcagaatctggccaggcctccaggcctcctactactttaccgtncactaccgaccgacgggtcccagtcggtcgtcccagacgtaggttcaggtcgggacggtagtagtttcggggactaggttcgttttctcgtacacctatacgacgcccgaccctaagagtagtagaagtgttggttacgattagtttactttctcgactagtactaacttaatttaacgttacgtacggtaccttcggtacggttacgtaccggttacggccgtaacgggaccgtaaggtacggaaacgttaaccgaaacggtacgtacggtacggtactacggaccgaaccttacgtcttacggtaccttaccg

SEQ ID NO: 213063 - DNA, 555 bp, Homo sapiens
  misc_feature: GYAE6OF02FT5XF.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgtgcatccaccagggccactggtctcccagacaggttcaggtgggcggtggagtttgggactagtagttttctctcacctatccagccgtccctagagagtagaagattggttgctagttttattctgtccagactaatattaattactcgcctggtcgttacgacggttcggaccgaacggggacctagggtacgtaaacgtacaaaaccggtacgtggtcgtacgtcgaccgtaaccagtcgttcgttcttaccg

SEQ ID NO: 213064 - DNA, 569 bp, Homo sapiens
  misc_feature: GYAE6OF02GYTHH.21.27.C05.1.454.CMB.1.raw
  modified_base (300)..(300): a, c, t, g, unknown or other
  misc_feature (300)..(300): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtcgacatcgtaccggggaaaatggtcgctggcaacaatggtgaattggattaggcagtccccgtgagnggccttgagtggctggaagacctatatcgtccagtgtatgaagactangcagtattctgtgngcgtctctcacatccacccagacacgtcaagactcgacgtctccctaccgactatcgtactgtccacgtcccgacgtaccgacggtaccttaagttttacttttcggacgtacgtaagtacgggtataccgtaactacgtttacggtacttaaccgttcccttcgttacgtccttacccgggtagggtacccggtaggttaacccgg

SEQ ID NO: 213065 - DNA, 564 bp, Homo sapiens
  misc_feature: GYAE6OF02GQRJH.21.27.C05.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctntcctgcacagccagtcagtctatcgctgactggttagcctggtaccagcagaaatctggccaggctccgaggctcctcatttaccgtgcactccaccgagggccacgtggtacgtcccagacaggttcagtggcggtaggtagtttgggactagtagttttctctcacctatcagcgtaccctacagtacgtgaacgattggttcgcgtaagtttatttcgtgcctaagtctaattattaattacgtcgtcctgtcgttcgtacgttcggaccgaacggaccgtaaggtcgtaaacgtacgaaacgaacgtcgtacggtcgtcgtcaaccgtactcgttacgttcttaccg

SEQ ID NO: 213066 - DNA, 738 bp, Homo sapiens
  misc_feature: GYAE6OF02I2ZXY.21.27.C05.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtcgtcctacggagggggacnccgcccacccttctcctgccacgacgcctagtactacgtctactccgctacggtacttcggttacgccgttacggtacccgagacgtaaagtaaactcgtcggaccagggtcccctacccgacggtccctacccttacgttacgttttaccggcgtaacctacctaccccgaaccggtacggaccctacggttcgggttacccgtaccaacggaccgtacggttcgagggtcggggacgggttgttaacggttacgggaacgtaggtttacgttttcccttaacccgactagtcgaccgtcccacccgtaacgaggtagtaggaagtgttaggtactacgtttagttttacgttcacgtacctagtacaactttaagttaacgtttacgacggttccgttacggtccgttaccggttaccggtacccggtaccgggaaccgtaacccggtaagggtaacggaaccttaaacggaaaccggttaggtaaggtccgtacgtcgacccgtactcgttacgtcgttacccttaccg

SEQ ID NO: 213067 - DNA, 604 bp, Homo sapiens
  misc_feature: GYAE6OF02FUBC0.21.27.C05.1.454.CMB.1.raw
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
  modified_base (387)..(387): a, c, t, g, unknown or other
  misc_feature (387)..(387): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctctcctgcacagccagtcagtctatcgctgactggttagcctggtaccagcaagaaatcgtggccaggcctcccgaggctcctctactttaccgngcactccaccagggcctacgtggtcgtcccagaccgaggttcaggtcgggcggttggagtttgggactaggttacgttttcncttcacctagtcacgtccgaccctacagagtagaagtatgttgcttagttttacttcgttcgaccgtagactaattaattaacgttacgtcggtccttcggtccgttaccgtaccggttccggaccgaccgggtaaccgtaagggtacggaaacgtacgaaaaccggtacgttggtacggtcgtacggcctaaccgtacttcgttcgttccttaccg

SEQ ID NO: 213068 - DNA, 754 bp, Homo sapiens
  misc_feature: GYAE6OF02JCBLX.21.27.C05.1.454.CMB.1.raw
  modified_base (205)..(205): a, c, t, g, unknown or other
  misc_feature (205)..(205): n is a, c, g, or t
  modified_base (321)..(321): a, c, t, g, unknown or other
  misc_feature (321)..(321): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtcgtctccgaggggggacnccgccacccttctcctgcacagccagtcagtctagtcgctgacttgtagccgtggtaccagcaagaaactcgtacggccaggcctacccgaggccctacctcttacgtttaccggngtaccactacccgaccgtacgggacccctacggttcgggtaccgttcccgaagtacggttacggttcgtaacggggttcggggtacgggttagggttaacggttttacgggggaacgttaacgggtttaccggttttttaccgtccgttacccgtaacctaacgtttccgaccgggtccccgttaaacccccgtaacggtaacggtacgggttaaggaaacggtaggtttcggtttagtaccgttttaagtttttaactttcgtaccgtaccgtagtactaaagttaacttaacgtttacggttcggccgtttacggccgttaccgggttaccggtcccggaccgggtaacgggtaccggtagggtaacggtaacgtaaccgaaacggtactggtcggtaactcggacctaccgattccgtacgttcttaccg

SEQ ID NO: 213069 - DNA, 655 bp, Homo sapiens
  misc_feature: GYAE6OF02GGPZ8.21.27.C05.1.454.CMB.1.raw
  modified_base (202)..(202): a, c, t, g, unknown or other
  misc_feature (202)..(202): n is a, c, g, or t
  modified_base (249)..(249): a, c, t, g, unknown or other
  misc_feature (249)..(249): n is a, c, g, or t
  modified_base (305)..(305): a, c, t, g, unknown or other
  misc_feature (305)..(305): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctctcctgcacagccagtcagtctatcgctgactggttancctggtaccagcaagaaatctggccaggcctcccaggcctcctctactttaccggngcctactcccaccgagggcccacgtggtcgtcccagactaggttcaggtgggcggtggtagtttgggactaggtacgttttcactccacctatcgacgccgaccctagagtaggtagtaaagtagttggttcgacttaaggttttactttcgtcgacctagtactaaattaacgttaacttacgtacgggtccttggtacccgttacggtaccggtttccgggacccgtaaccggggtaaccgtaagggtaacgggtaaacgttaaccggaaaaccggttaacgttacgggtacggtccgttacggtacccgtaacccgtaacgttccggttacgttaccgtttaacccg

SEQ ID NO: 213070 - DNA, 574 bp, Homo sapiens
  misc_feature: GYAE6OF02HT196.21.27.C05.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
  modified_base (307)..(307): a, c, t, g, unknown or other
  misc_feature (307)..(307): n is a, c, g, or t
  modified_base (396)..(396): a, c, t, g, unknown or other
  misc_feature (396)..(396): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggacncgccaccctctcctgcacagccagtcagtctatccgntgactggttancctggtaccngcagaatctggccaggcctcccgaggtcctcctctacgtttaccgngcaactcccgaccgacgggccctaacgtggtaccgtcccaagacgtaggttcacggtgggcggtggtagtttgggacagttagttttcnctcactatcagccacctanagtagngaagatgtcagttagtttcttcgcgcagactaatacttaatacgtgtcctggccgtacgtaccgtcgaccgaaccgggtacgtaaggtacggtaaacacggtaaacgtacgtagaccggtctacgaccgacctacgtccttacgttccttaac

SEQ ID NO: 213071 - DNA, 728 bp, Homo sapiens
  misc_feature: GYAE6OF02H3MA8.21.27.C05.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgcccaccctctcctgcacagccagtcagtctatcgctgactggttagcctggtaccagcaagaaatcgtggccaggctacccgaggccttcctctacgtttaccgngcctactccccaccgacgggccctacgtcggtcgtacccgagacgtacggttacgaggtcgggcggtagggtacgtttaggggactaacggtttacgtttttctaccgttaccgaacccgttaacttacccggtacggtccccgtaccccgtaaccgtaaaggtaacggttaacgtaaacggtacgttgggtttacgtaccgtttagttttttacgttttactcggtacccgtaagtaacctaaattaaacgttaaactttaccggtacggtaccgtcggtccggttaccggttaccgggttccggaacccgtaccggggaaccgtaagggtaacggtaaaccgtaaccgaaaacggttacgtacgggtacggtacgttaccgaccgtaacctagtttacccgttcgttacgttaccc

SEQ ID NO: 213072 - DNA, 614 bp, Homo sapiens
  misc_feature: GYAE6OF02IGWXH.21.27.C05.1.454.CMB.1.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
  modified_base (396)..(396): a, c, t, g, unknown or other
  misc_feature (396)..(396): n is a, c, g, or t
  modified_base (415)..(415): a, c, t, g, unknown or other
  misc_feature (415)..(415): n is a, c, g, or t
  modified_base (506)..(506): a, c, t, g, unknown or other
  misc_feature (506)..(506): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggccctcccatgggggtgtcctgtcacagatcaaactacagcagtctggtccaggtntggtgaggccctgcagaccctttcactcacctgtgacntcgtacgggaaaatgtcgcnggacaanaagtggtagaattggattaggctacgtcccctgagaggcttgagtgctaggaagactatatacgtccagtgtatagagactatgacagtattcgtagtgaggtcggttctctacactatccaaccccganaacacgtaccaaagtaacngacggtcctccccttacacccttaatcgtactacgtccaacccgttaccgaaccacgaaccgtcgttagtttttaagttttgtaaccgtanaaagggtacgggtaactacgtaaccttacggttaccggttcggtaaaccttccgttacccgttagtaaccgttacggttccggggtaaccggtacgggtttaaaccgg

SEQ ID NO: 213073 - DNA, 625 bp, Homo sapiens
  misc_feature: GYAE6OF02FYJC3.21.27.C05.1.454.CMB.1.raw
  modified_base (202)..(202): a, c, t, g, unknown or other
  misc_feature (202)..(202): n is a, c, g, or t
  modified_base (317)..(317): a, c, t, g, unknown or other
  misc_feature (317)..(317): n is a, c, g, or t
  modified_base (412)..(412): a, c, t, g, unknown or other
  misc_feature (412)..(412): n is a, c, g, or t
  modified_base (608)..(608): a, c, t, g, unknown or other
  misc_feature (608)..(608): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgccacagccagtcagtctatcgcgtgacgttggttacgcctggtaccagcaagtaaactcgtcggccaggcctcccgaggcctccgtctacgtttaccgngccactcccaccgacgggcctacgttcggtcacccgagaccgtaggttcagggtcgggcggttaggtagtttacgggactaaggttcgttttccnccgtacctaccgtactcgacgccgtaccctacgagtacgtagaagtgttagttagcttagtttcttcgtgaccatactaattacttaacttcgtacggtcgttcgcgttaccgtaccggttaccggaccgtacgggtaccgtaagggtacgtaaccgtaacggaaaccgtacgtacggtcgacgtcgacctacgtnttccgttagtcttaccg

SEQ ID NO: 213074 - DNA, 574 bp, Homo sapiens
  misc_feature: GYAE6OF02HS463.21.27.C05.1.454.CMB.1.raw
  modified_base (472)..(472): a, c, t, g, unknown or other
  misc_feature (472)..(472): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgtaccctttcactcacctgtgacatcgtaccgggaaatgtacgctggcaacaatggttaggaattggattaggctagtccccgtgagaggtcctgagtgcgttggaagtactagttatacgtccagtggtatgaagtactagtgacagtattcgtgtgacgcggtcgtctcacactaccaccccagaccgtacgtacaagactacgtacggtcctaccctaccaactatcgtactacgtacacctaccgacgtacncgtactagttttactttgcgactaaggagtactcgtaacgtacgttcggtacgtaccgtccttacgttacgtacctccggtacggaccgtaggttaacccgg

SEQ ID NO: 213075 - DNA, 704 bp, Homo sapiens
  misc_feature: GYAE6OF02ITPOU.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtctgtcacagatcaaactacagcagtctggtccaggactggtgaggccctcgcacgtaccctttcactccaccgtgtcgacactaccgtaccggggaaaactgtcgcgtttggacgaacaagttgggtaggtaagttggtaagttacggactacgtaccccggtcggaaggtaggtccgttggaggtggtacgttaggaacggtaccttaattactacgtacctaggtaggtaatagaagtaacgtagtagacgtagtacgttacgtgtaggacggtcggtaccgttctacgtacctaccgtaccaaccccgagaccgtaaccgtacctaaacgaactaccgtacggtcccttaccctaccctaacctaatcgtccgtccgtacacccgtacccgtaccgaaccgacggtacttaagttttatttacggtacgtacgtaagggtacggtaacgttccgtaaaccgtacgttacggttaccgtaacgttacccgttacggttacgtaccgtacccggacggggttacccgtagggtttaacccg

SEQ ID NO: 213076 - DNA, 871 bp, Homo sapiens
  misc_feature: GYAE6OF02HQZO3.21.27.C05.1.454.CMB.1.raw
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacngccagtcagtctatcgctgacgttggttagccgttggtacccagacgaagaaacgtcgtcggaccacgggcccttacccgacgggtcctcccgttaccgttaaccgttttaacccggtcgtacctaaccgtccccaacccggacgggggtccccctaacggttccgggtttaccggtaccccgaacggtaccggtaacgggtttaccgaacgggttcggggtccggggttagggtttacgtttaacgggggaaccgttaagggtttaacggttttttcccacgtttcccgaaccgtaaccgttaccgtaacgggtaccccggtaaccccgttaacggtaaacgggtaaggttaacgggtaaaggttacggttacgggttttacggacgtttaaacggtttttacgtttttaccgtacggttacccgtaagtaccgtaaactttaagttaaacgtttaaccgttaccggtccgttacggtaccgggttaccgttaaccgggttccggaaccggtaaacccggggaccgtaaacggggttaacggtaaaaccggtaaccggtaaaaaccggtaacgttacgggttacccgggtaacgtttaccggaacccgtaaccgtaaccgttaccgtttacgttacccgtttaacccg

SEQ ID NO: 213077 - DNA, 673 bp, Homo sapiens
  misc_feature: GYAE6OF02FWXUO.21.27.C05.1.454.CMB.1.raw
  modified_base (593)..(593): a, c, t, g, unknown or other
  misc_feature (593)..(593): n is a, c, g, or t
tcagtcgtcgctcgcacgaccggtgctcgatttagacgcgatcgaagggtttgggggcgagagcctgctgacttctggctgaccagggcagtcaccggagctccagacaatgtctgtctccttcctcatcttcctgcccgtgctgggcctcccatggggtgtcctgtcacgagactcaaactacagcagtctggtaccaggactggtgacggccctcgcacgtaccctttcactcacctgtcgacagtcgtaccggggaaaatcgtacgcgtggcaacgaagtcggttacggaagttgggatttagggactaggtcccccgtggacgacggtcccttggagtggcgttagggaacggtaccttaagttactaccggtcccaagttacggtactaggaacgtacgttagtgtaccgaagtactttccgtgtacgaacggtcggttacgttccgtcctaaccgatacccgaacccctagtacctaccggttaccaaacggtaactaccgacgggttacctaccccgttacctaaccttaacgtcgttacctcgtacaccgtcccgacgaaccgtacgtcttacgttttatttcgngtacgtaaggcggtactcgaactacgttcggtactaccgtaccctctcgtacccgtcggccggtaccgacggtttaaccg

SEQ ID NO: 213078 - DNA, 742 bp, Homo sapiens
  misc_feature: GYAE6OF02F4QRS.21.27.C05.1.454.CMB.1.raw
  modified_base (204)..(204): a, c, t, g, unknown or other
  misc_feature (204)..(204): n is a, c, g, or t
  modified_base (326)..(326): a, c, t, g, unknown or other
  misc_feature (326)..(326): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactgggagtgattgtgatgacgcagtctccacgccacctgtctgtcgtctccggagggggnccgcccaccctctcctcgaccacacgccagtcagtctatcgctgtacgtggtacgccgtaggtaccagacaaagtaactcgcggccacggcctcccgaggtccctcctctaacgtttaccgnaccactacccgaccggacgggacctacggttcggtaccgtaccccgaaggtaccgtacggttcgacgggttcggggtcgggttagggttacggtttacgggggaacttacgggtttacgttttccaccgtaaccctaaccgtacgtccggacgtccccgtaccgtaacgacgggtaggttaacgaaagtaggtttcggtacgtacgttttagtttacgttcgtactaccgtagtaacttaaattacgttaacgttacgtacggtccgttagggtaccgttaccgggtaccggtaccggaacccggtaacgggtaaccgtaagggtaacgaaaccggttaaccggaaaacggttacggtacgggttacgtaccggtacacccgttaaccgtgtttacccggtttctacccgttaccg

SEQ ID NO: 213079 - DNA, 546 bp, Homo sapiens
  misc_feature: GYAE6OF02H23DB.21.27.C05.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (306)..(306): a, c, t, g, unknown or other
  misc_feature (306)..(306): n is a, c, g, or t
  modified_base (394)..(394): a, c, t, g, unknown or other
  misc_feature (394)..(394): n is a, c, g, or t
  modified_base (433)..(433): a, c, t, g, unknown or other
  misc_feature (433)..(433): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgntgactggttagcctggtaccagcaagaaatctggccaggcctcccaggccttcctctattttaccgngccactcccaaccgagggcccagttgggtcgtaccccaagacctagggttcaggttgggcggtggtagtttggggactagtgttttcnctcacctatccagccgccctacagagtagaagatgttgnttagttttattctgccagacaatataattacgtgtcctgcgtcgtacggttcggaccgacggaccgaaggtagaatacgaaacgacgtagtgactgacaaccatctgttctac

SEQ ID NO: 213080 - DNA, 671 bp, Homo sapiens
  misc_feature: GYAE6OF02FVCLK.21.27.C05.1.454.CMB.1.raw
  modified_base (202)..(202): a, c, t, g, unknown or other
  misc_feature (202)..(202): n is a, c, g, or t
  modified_base (303)..(303): a, c, t, g, unknown or other
  misc_feature (303)..(303): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggncgcccaccctctcctgcacagccagtcagtctatcgctgactgttagcctggtaccagcagaaatctaggccagcctccgaggcctcctctatttaccggngccatccgaccagggcccacgtggtcgtcccagacgtaggtcaggtggcggtggtagtttgggacaggtacgttttctctcacctatcgagccgtacccgtacaggtagtagaaagcgttagtcgacgtttagttttactttcgtacgtacccgtagtacgtaaattaacgttaaattaccgttcgggtaccttcggtacccggttacgggttaaccggttccgggtaaccggtaaacccgggtaacccggtaacgggtaacgggttaaaaccgtaaccggtaaaaaccggtaacggttacggtaccgggttaccgttacggacccgttaacccgtaaccttcccgtttacggtaccctttaacccgg

SEQ ID NO: 213081 - DNA, 709 bp, Homo sapiens
  misc_feature: GYAE6OF02JYR4S.21.27.C05.1.454.CMB.1.raw
  modified_base (117)..(117): a, c, t, g, unknown or other
  misc_feature (117)..(117): n is a, c, g, or t
  modified_base (205)..(205): a, c, t, g, unknown or other
  misc_feature (205)..(205): n is a, c, g, or t
  modified_base (223)..(223): a, c, t, g, unknown or other
  misc_feature (223)..(223): n is a, c, g, or t
  modified_base (264)..(264): a, c, t, g, unknown or other
  misc_feature (264)..(264): n is a, c, g, or t
  modified_base (330)..(330): a, c, t, g, unknown or other
  misc_feature (330)..(330): n is a, c, g, or t
  modified_base (344)..(344): a, c, t, g, unknown or other
  misc_feature (344)..(344): n is a, c, g, or t
tcagtcgtcgctcgcacgaccggtgctcgatttagacgcgatcgaagggtttgggggaggaactgctcagttaggacccagacggagccatggaagccccagcgcagcttctcttcncctgcttctctggcctccagacaccactggatgattgtgatgacgcagtctccagccaccctgtctgtcgtactccgagggggggacnccgacccacccgtctccngcacacggccagtcacgtctactcgctagacgttggttacnccgtaggtaccagccaagaactcgtaggaccaggcctcccgaggacctccgtactacgtttaccgngcccagttaccccncgaacgggtcccacgttacggtctacccgaagtacccggtaggttcaacgggttcggaccggggttaggtaacggtttacggggaactacgggttaacgtttttccaccggtcctacccgtatcgtacgtccgtacccgttaagacgtacggtacgtaaagtcgttacggttacgtacgttagtttacgttacgttcgtaccgtaacgtactaacggttaattaacgttacgtacggtaccgttagtcgttaccgtacgttaccggaccgtaaccgggtaccgtacgggtacgtaaccgtaacggaacgtacggtacgtacggtacgtacgtaccgaccgtaacggttactacggttacttaccg

SEQ ID NO: 213082 - DNA, 824 bp, Homo sapiens
  misc_feature: GYAE6OF02IKLP8.21.27.C05.1.454.CMB.1.raw
  modified_base (167)..(167): a, c, t, g, unknown or other
  misc_feature (167)..(167): n is a, c, g, or t
  modified_base (206)..(206): a, c, t, g, unknown or other
  misc_feature (206)..(206): n is a, c, g, or t
  modified_base (253)..(253): a, c, t, g, unknown or other
  misc_feature (253)..(253): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgaccgnagtctccagccaccctgtctgtgtcgccggaggggggcnccgcccacctctccgcgacacgacgtcctacgtcacgtctactccgntagtacgtggtacgtcgtacggaccagacaagtaacgtcggtacggaccgacggtcctacccggacggtcctacccttacgttaacgttaccgcgaccgtaccgtacccgaaccggtaccgggaccctacggttcgggtaccgtaacccgtaacggtaccggttacggttacggacggggttcgggtacggggttaaggtttaacgggtttacggggaaccgttaagggttttaccgtttactaccgtaacccgtaccgtacggtccgtaaccggtacccgtaccgttaaaggtacggtaacgggttaacggtaaacggtacgtttacggttacgttacgtttacgtttttaccgtacgtacggtaccgtaacgtaactaaagtttaaacttacggttaccggtacggtaccgtacgggttaccgtaccgggttacccgggtaccgtaacccgggtaacggtaaccggtaacgggttaaacggtaaaccgtaaacccggtaacggttaacggttacggacggttaacgaccggttaacctaaccgtacggtttccgttagttacccgttcg

SEQ ID NO: 213083 - DNA, 690 bp, Homo sapiens
  misc_feature: GYAE6OF02F6DOE.21.27.C05.1.454.CMB.1.raw
  modified_base (205)..(205): a, c, t, g, unknown or other
  misc_feature (205)..(205): n is a, c, g, or t
  modified_base (319)..(319): a, c, t, g, unknown or other
  misc_feature (319)..(319): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgatttgtgatgacgcagtctccagcccaccctgtctgtgtctccgagggggganccgccaccctctccctgcacacgccagtccagtctatcgctgactggttagcctggtaccagcaagaaactcgtggaccaggcctcccgacggcctccgtactagttttaccgngctactaccaccgagggcccacgttcggtcgtcccaagacgtaggttcgaggtcgggtcggtaggtacgtttggggactagttacgtttttcaccgtccacctatccgacgccgtcccgttaacaaggtagtacggaaagtacgttgttacggtactttaaggtttttactttccgtacgtccaagtacgtaaattaattaacgttacggtacgtccgttcggtaccgttacggttaccggtttacggacccggtaaccggggtaacccgtaacgggttacggaaaacttacccggaaaaaccggttaccggtcggttacggtaccgttacggtaccgtaacccgttattaccgttcgttccctttaaccg

SEQ ID NO: 213084 - DNA, 743 bp, Homo sapiens
  misc_feature: GYAE6OF02IDCP4.21.27.C05.1.454.CMB.1.raw
  modified_base (161)..(161): a, c, t, g, unknown or other
  misc_feature (161)..(161): n is a, c, g, or t
  modified_base (228)..(228): a, c, t, g, unknown or other
  misc_feature (228)..(228): n is a, c, g, or t
  modified_base (261)..(261): a, c, t, g, unknown or other
  misc_feature (261)..(261): n is a, c, g, or t
tcagtcgtcgctcgcacgaccggtgctcgatttagacgcgatcgaagggtttgggggcagagcctgctgacttctggctgaccagggcagtcaccggagctccagacaaatgtctgtctccttcctcatcttcctgcccgtgctgggcctcccatggggtntcctgtcacagatcaaactacagcagtctggtccaaggactggtgacggccctgcacgtaccctttnactcacctgtgacatcgtaccgggaaatgacgntggcaacatggtgtaattggattaggcacgtccccgtaggagtacggtccttgagtggtcgttggaagtacctattacgtacgtccgagtaggtaatcgaagtacgtagtcgactagaactttcgtagtcgacggtccggttacgttccgtacgtaaccctacgttacccgaaaccccgtacgtaaccgtaaccgttaacccaaaacggtaaacttaccggtaaacggttcccttaaccccttaacccgtaaaccgttaacgttcgttaccgtaacgttacccaacccgttaacccggaccgtaaccgtaccgggttaacctttaacggtttttactttttacggaacgttaccggtaaaggtacggggttaacttaccggtaaacgtttacggtttaccggtaaccggttaaccttacccgttaccgttacgtacccggtttacccggtacgggggttaacccgtaggggtttaaccccgg

SEQ ID NO: 213085 - DNA, 540 bp, Homo sapiens
  misc_feature: GYAE6OF02GYTZI.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggcccctcggcagaccctttcactcacctgtgacatctccgggggaaaatgtcgctggcaacaatggttgaattggattaggcagtccccgtcgagaggccttgagtggcttggaaggactattatacgtccagtggtatgaagactatgcagattctgtgagcggtcgtctcaccactcaccccagacacgtccaagatcaggttcctccctccacctaatcgtctcgtcactcccgacgaccacggctagtttactttgtgcaagaggatcgaactatttcggtagtacctaccgttccttcgtacctccgtcggggtccctagggttaaccg

SEQ ID NO: 213086 - DNA, 653 bp, Homo sapiens
  misc_feature: GYAE6OF02FLS8D.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgacacgtaccctttcacctcacctgtcgaccatcgtaccggggaaaatcgtcgctggacaacaagttggttaggaattggattaggctacgtccccgtcgagacggtccttgagtggcgttaggaacggacttagttactacgtccgaagtggtatagaagtactagtgacagtacttcgtgtagagtcggtctctacaccataccacccgacgacacgtacaaagtactcgacggtccctaccctacctaaccgttaatcgttacctcgtacctacccgtacccggaccgtaaccgtaccgtacgtttaacgttttactttacgtagtaaccgtaaggtacggtactaccgtaacgttacggttaccggtacgtaacccgttaccgttccgttaccggtaccgttccgggtacggggtaccgtaacggggtttaacccg

SEQ ID NO: 213087 - DNA, 580 bp, Homo sapiens
  misc_feature: GYAE6OF02G0M2M.21.27.C05.1.454.CMB.1.raw
  modified_base (203)..(203): a, c, t, g, unknown or other
  misc_feature (203)..(203): n is a, c, g, or t
  modified_base (253)..(253): a, c, t, g, unknown or other
  misc_feature (253)..(253): n is a, c, g, or t
  modified_base (312)..(312): a, c, t, g, unknown or other
  misc_feature (312)..(312): n is a, c, g, or t
  modified_base (389)..(389): a, c, t, g, unknown or other
  misc_feature (389)..(389): n is a, c, g, or t
  modified_base (410)..(410): a, c, t, g, unknown or other
  misc_feature (410)..(410): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgccacagccagtcagtctatcgctgacttggttancctggtaccagcagaaatcgtggaccaggcctcccgaggcctccctctacttttaccgngaccactcccaaccgagggcccacgtggtcgtcccagacaggttcaggtggcggtgtagttgggactagtgttttcnctcactatcagccgaccctanagagtagaagtatgttgacttagtttacttcgtgccagtactaaattattaattacgtggtcctggtcgttccggtacggttccggaccgaccggggtaacctagggtacgaaactaccggaaacgtaacgtggtacggcttacgaccacctacgtcgttcgtcttaccg

SEQ ID NO: 213088 - DNA, 601 bp, Homo sapiens
  misc_feature: GYAE6OF02HERNW.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatgggggtgtcctgtcacagatcaaactacagcagtctggtccaggactggtgaggccctcgcacgaccctttcactcacctgtcgacatcgtaccgggaaatgtcgctggcaacaatggttggattggattaggcagtccccgtacggagaggccgttgagtggcgtggaaggtactattactacgtcccagtggtatgaagactatcgacagattctagtgagtcggtcgttcgtccacctactcctaaccccacgtaccgtaccgtacgaaacgtaactccgacgtcccttacccgtacccaaccttaacgtctctcgtcctacccgtacccgaaccgacaccggtcttagttttatttacggtcgtacgtaaggaggtactacgtcgtagttcggtactacttaccgttcgttacgtccgttccggcgggtaccgtaggttaccg

SEQ ID NO: 213089 - DNA, 648 bp, Homo sapiens
  misc_feature: GYAE6OF02HKET9.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgaccgtgctgggcctcccatggggtgtcctgtcacagatcaaactacagcagtctggtccaggactggtgacgggccctcgcacgtaccctttcactcacctgtgacactcgtaccggggaaaatcgtcgcgtggacaacaagtggttaggaattggattaggacagtccccggcggagacggtccttagaggtggcgttagggaaggacctaattacgtacgtcccgagtggtatggaagtactatgacagtattctgtgaggcggtcgtctcacactccaaccccagtacctaccgacaaacggtataccgtacgggtccttccccgtacctaaccctaatccgtcgtacgtctacccgtacccgtaaccgaccgtacggtaccttacgttttagttttacggtcgtacgtaacggtaggtactaccgtaacttacggttaccggtacgtaacccttacccgttcttaccggtaccttcccgggtaccggggtccggtacggttaacccggg

SEQ ID NO: 213090 - DNA, 540 bp, Homo sapiens
  misc_feature: GYAE6OF02FKJKF.21.27.C05.1.454.CMB.1.raw
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
tcagtcgtcgctcgcacgaccggtgctcgatttagacgcgatcgaagggtttgagggaggaactgctcagttaggacccagacggagccatggaagccccagcgcagcttctcttcctcctgcttctctggctcccagacaccactggagtgattgtgatgacgcagtctccagccacctgtctgtgtctccgaggggggnccgccaccctctcctgcacagccagtcagtctatcgctgactggttagcctggtaccagcagacgcctggccaggcctcccgaggttccnatctatcgctcgggtcccagcgggccgcggcactccagacaggttcagtggcnggtggtcnggacngtacttcactctacacatcacgcacgacgtggacgtcgtaggagttagtttcgactaagttgtaacttcgtgtacagactatacgtcgtacctacccaccccgtataccctaccgttccggaccgaacggacctacgactcgacgtacgaacgtacgaacgtacgtgtacggtacgtcgaccg

SEQ ID NO: 213091 - DNA, 569 bp, Homo sapiens
  misc_feature: GYAE6OF02FPIQZ.21.27.C05.1.454.CMB.1.raw
  modified_base (202)..(202): a, c, t, g, unknown or other
  misc_feature (202)..(202): n is a, c, g, or t
  modified_base (378)..(378): a, c, t, g, unknown or other
  misc_feature (378)..(378): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcaagaaatctggccaggcctcccaggctcctcactttaccgtgccatccaccagggccacgtggtcgtcccagacaggttcaggtggcggtggtacgtttgggacaggtagtttttcnctccaccatcacgccgccctacagtagtagaagtagtgttgcgttagtttaactttctcgcctagtacaagttaataattacgtagtcctggccgttcgacggttccggaccgaccggggacctaagggtacggtaaacgtaccgaaacgtactaggtcgacgttcgaccaccacgttacttcgtcttacc

SEQ ID NO: 213092 - DNA, 750 bp, Homo sapiens
  misc_feature: GYAE6OF02IWS0Y.21.27.C05.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctcagccacctgtctgtgtctccgagggggnccgccacccgtctcctgccactacgcctagtccagttctatccgcttgaccgttggttacgccttaggtaccgagtacgaaggtaaactcgtaggccacgggctacccgacggtcctaccgtactatttaccggcgtccaattccccgaaccgtacgggccttaacggtcggtaccgtacccgaagttaccgaacgggtttcaacggggttgggtaccggttaaggttacggtttaacggggaacgttacggttaacggtttttcccctacggtccgtaaaccgtctttaccggacggacccgtacccgtaacgtaacggtaacggttaaggaacggttaaagttcggttacgggtacgtttaacgttttaggtttaccgttaaccggaccgtaacgtacgtaaacgttaagtttaaacgttaccgttcggtaaccgttcggtaccggttcggtaaccgtcggaaccggtacggtaaccggtagtaaccggtaacgacgtaaacgtagaacgtcggtacgtacgtaccccgatacgtacttcgtacctacg

SEQ ID NO: 213093 - DNA, 855 bp, Homo sapiens
  misc_feature: GYAE6OF02HAFOK.21.27.C05.1.454.CMB.1.raw
  modified_base (203)..(203): a, c, t, g, unknown or other
  misc_feature (203)..(203): n is a, c, g, or t
  modified_base (259)..(259): a, c, t, g, unknown or other
  misc_feature (259)..(259): n is a, c, g, or t
  modified_base (347)..(347): a, c, t, g, unknown or other
  misc_feature (347)..(347): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagcccacctgtctgtgtctccgaggggganccgccaccctctcctgcacacgccagtcagtctagtcgctagtacgttgggttacnccgtaggtacccagaccaaagtaaacttccgtcggaccctagggtccctacccggaggtcccttaccctacgttaacgtttacccggngacctaccgttaccccgaaccggtacggggtccctacggttcgggtaccgtaccccgaaggtaccgtacggtttacgagggttcgggtcgggttagggttaacggttttcggggaacttacgggtttacttttttccgaccgttaccctaaccgttacgttaccgaccgtccccgtaccccgtttaaaccggaaggttaccggttaaggtaaacgttacggtttacggtttacggttaccgttttaagtttttaaccgtttccgtaccgtaccgttaagttaaccttaaatttaacgtttaaacgtttaccggttccgggttacccgttcgggttacccggttaccggtttacccggggttaccggaaccccgggtaacggggttaacccggtaaggggttaacggtaaaccgttaacccggtaaaaccggttaacggttcggtaaccggtaccgttaccggacccgtaacccgtttacggtttacttccggtttacctttaacccgg

SEQ ID NO: 213094 - DNA, 599 bp, Homo sapiens
  misc_feature: GYAE6OF02JOBX4.21.27.C05.1.454.CMB.1.raw
  modified_base (406)..(406): a, c, t, g, unknown or other
  misc_feature (406)..(406): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggcccctgcacgaccctttcactcacctgtagacatcgtaccggggaaaatgtcgctggcaacaatggttggattggattacggctacgtccccggtacgagacggccttgagtggcgttgggaaggacctatacgtaccgtacccagtggtatggaatactagtgcagattctgtgagcgtcgtctcactactccacccngacacgtaccaaagactcgaacggttcctaccctacctaacctagttacgtctcgtaccacctacccgacgaccgtacggtactaagtttttcgttagtgaaccgtaggtacggatccgaacttgttcggtactaccgtttaaccctccgtttaggaccctttggtacccggggtaccggtaggtttaaccgg

SEQ ID NO: 213095 - DNA, 875 bp, Homo sapiens
  misc_feature: GYAE6OF02IF58Z.21.27.C05.1.454.CMB.1.raw
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtagatgacgcagtctccagccaccctgtctgtgtcnccaggtggganccgcctaccctctccngacacngaccagtcagtctagtcgntcgactggtacgccgtaggtaccagacaagaactcgtacggaccgaggtccctacccgacggtccttacccgtcttaactttaccggtacgacctactaccccgaccgaccggtccctaaccgttcggtaccgtacccaaggtaccgtacggttacgacggtacggggtacggttacggttaacggtttacggggacttaacggttacggttttttacctaccgttaaccgtaccctaaacgttccggtaaacccgtacccccgttaaaccccgtaacgtaaacgggttaacggttacgggaaacgttacggtttacgggttttacgtaacgtttttaaacgggttttttacctttaccgtaccggtaacccgttagtaaaccggtttaaattaaaccgtttaaaccgttttaccggttaaccggggtttaccgtaccgggtttaaccgtttaccgggtaacccggtttacccgggaacccggggttaaacccgggaacccgggttaaacgggttaaaaccgggttaaacgtaaaccccgtaaaaaccggggttaacccgttaagggttacccggtaccgttaacccggtaaccttaacccggttacgtttcccgttacggtttaacccgg

SEQ ID NO: 213096 - DNA, 644 bp, Homo sapiens
  misc_feature: GYAE6OF02FX3OB.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtgtcctgtcacagatcaaactacagcagtctggtccaggactgggtgacggccctcgcaggaccctttcactcacctgtgacatccgtccgggaaaatgcgctggctaacgatggtaggaattggattaggcagtccccgtaggagacggtccttgaggtcgtcgttgggaagggtacctagttaactacggtcccaaggttaggtaactagaacggtacttaacgtgacagtatttcgtggtggaggtccggttacgtacgtaccactatccccaacccgacgacctaaccgtaccaagtaaactccgaacgttcctacccgttaccaaccgttaactcggtacctcgtactacccttacccggacgaccgtaccggtacgtttagttttacgttttagtccgtaacgtacgtagggtctacgtaacgtctttacgggactaaccgtaccttcgtaggtacctcggtccggtacgtagggttaccg

SEQ ID NO: 213097 - DNA, 667 bp, Homo sapiens
  misc_feature: GYAE6OF02JYDXT.21.27.C05.1.454.CMB.1.raw
  modified_base (284)..(284): a, c, t, g, unknown or other
  misc_feature (284)..(284): n is a, c, g, or t
  modified_base (335)..(335): a, c, t, g, unknown or other
  misc_feature (335)..(335): n is a, c, g, or t
  modified_base (430)..(430): a, c, t, g, unknown or other
  misc_feature (430)..(430): n is a, c, g, or t
  modified_base (462)..(462): a, c, t, g, unknown or other
  misc_feature (462)..(462): n is a, c, g, or t
  modified_base (658)..(658): a, c, t, g, unknown or other
  misc_feature (658)..(658): n is a, c, g, or t
tcagtcgtcgctcgcacgaccggtgctcgattttagacgcgatcgaagggtttgggggaggaactgctcagttaggacccagacggagccatggaagccccagcgcagcttctcttcctcctgcttctctggctcccagacaccactggagtgattgtgatgacgcagtctcacgccaccctgtcctgtgtcgtccgaggggggactccggacctacccctccttccgcgacacgtacgcctagtcacgtcctatcgctgaccgttggtacgccgtggtaaccngctaacgaacctggcccgaggcctacccgagtcctccgactactttaccgngaccactccaccggtacggccctacgtcggttaccgcccgaagacctagggtaccagggtcgggcgtaggtactttggacttagttcgttttacnctccactatcgactccgaccctagacgtaganaagtgtcttaaggcgttaagtttagttctactacggtactaacgtataacctttatcgtaccgttacgtcgtaccggtacgtaccgggttccggtaccctaacggggtacgtaacgggttacgaacgtaaaccggtacgtaacggtagttacggaccttacgaacctaccggttactaccggttagtttacccgtnttaaccccg

SEQ ID NO: 213098 - DNA, 686 bp, Homo sapiens
  misc_feature: GYAE6OF02FSZK6.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgacgttggttacgccgttacggtaccagtccgaagaaacttcgtcggccaggcctacccgaggtcctcccgtactacgtttaccgtcgcactccaccgacgggccacgtcggtcgtacccgagtaccgtaggttccgaggtcgggcggggttaggtacgtttacggggacgtaggttacgtttttcctcgttactaccgtatccgtacgacccgtaccctaacgaggtaggtagaaacgtagttcggttacgctttaaggttttactttcgtcgtacctaacgtactaaagttacttaagttaccgtcggtccgttcggtaccggttaccggtccggttacccggaccggtaaccggggtaccgtaagggtacggtaaacgtaaccgtaaaccggtacgtacggtcggtacgtacgcctaaccgtacgttcgttacgttccttacg

SEQ ID NO: 213099 - DNA, 562 bp, Homo sapiens
  misc_feature: GYAE6OF02GU1PK.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtgagaggccttgagtggcttggaaggacctattatacgtcccagtggtatgaagactatgacagtattcgtgtgagcggtcgtctcacctactcaccccagaccacgttccaaaggaactcgagtcctcccgtccacctaatcgtctgtcactcccgacgaccacggcttagtttacttttgacgtacgaagagggatcgaactacgttcggtagtaccttaccgtccgttacgaccgttccggtacggggaccgtagggttaaccgg

SEQ ID NO: 213100 - DNA, 632 bp, Homo sapiens
  misc_feature: GYAE6OF02GS4IE.21.27.C05.1.454.CMB.1.raw
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
  modified_base (391)..(391): a, c, t, g, unknown or other
  misc_feature (391)..(391): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatcgtggccaggcctcccgaggcctcctctactttaccgngtaccactcccaaccgagggaccctacgtggtcgtcccaggactaggttcaggtggcggtgtagtttgggactaggtacgttttcnctacacctatcgacgcccgaccctacgaggtacgtagaaagtacgttgttacgacgttagttttactttcgtcgtaccgtagtacctaattaacttaagttacgtacggtacctcggtccgttaccgtacggttccggaccgtaaccgggtaaccgtagggtacggtaaacgtaacgaaaccggtaaccgttaggtccggtacgtacggaccctaaccgtacgtcgttaccgttcttaccg

SEQ ID NO: 213101 - DNA, 576 bp, Homo sapiens
  misc_feature: GYAE6OF02FVMBN.21.27.C05.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccacctctcctgcacagccagtcagtctatcgctgactggttagcctggtaccagcagaaatctggccaggcctcccgaggctcctctacgtttaccgngcactcccgaaccgacgggcctacgtcggtcgtcccgagtacaggttcagggtcggcggttggtagtttggggactaggtacgttttctctactacctatccacgcgtaccctacgaggtagtagaacgagttgttgcttagttttacttctcgcagtactaattattaattacgtcgtctgtccgttcgtaccgtcggaccgtacgggactacgggtagaacgtacgaaacgtacgtggtagcgtacgaccacctactcttcgtcttaccg

SEQ ID NO: 213102 - DNA, 858 bp, Homo sapiens
  misc_feature: GYAE6OF02GJT50.21.27.C05.1.454.CMB.1.raw
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
  modified_base (247)..(247): a, c, t, g, unknown or other
  misc_feature (247)..(247): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtcctccagccacctgtctgtgtctcgagggggncgccacctctctgcacncgccagtcagtctatcgctgactggttacnccgtcgtacagacaagtaaactcgtacggccgtacggcccttacccgaggcccttaccttacctacgttttacccggtcgacctacgtccccgaaccgaaccgggtccctaacggtcgggtaccgttaccccgaaggtacccgtacgggttacgaacggggttcgggtacgggttagggttacgggtttacggggaacttacgggtttaacgttttttccgtacccgtttaccaaacccgtacgttaccgaaccgggtcccgtaacccccgttaagtaacgggttacgggttaacggtaaaacggttaggtttacggtttacgtaaccggtttttaaggtttttaaccgtttcccggttaaccggtacccttaacggtaaaccgtttaaaaactttaacggttttaaaccgtttaaccgggttcccgttaaccggttccggttcccggtttaaccggggttacccgggttacccggaaccgggtaaacccggggtaaccggttaaaccggggaagggttaaaaccctaaaccggtaaaacccggtacggttaccggtacgtacggttacgaacccgtaccgtaacgtttccggttacgttcccttaacccg

SEQ ID NO: 213103 - DNA, 738 bp, Homo sapiens
  misc_feature: GYAE6OF02JNI4P.21.27.C05.1.454.CMB.1.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (323)..(323): a, c, t, g, unknown or other
  misc_feature (323)..(323): n is a, c, g, or t
  modified_base (343)..(343): a, c, t, g, unknown or other
  misc_feature (343)..(343): n is a, c, g, or t
  modified_base (442)..(442): a, c, t, g, unknown or other
  misc_feature (442)..(442): n is a, c, g, or t
tcagtcgtcgctcgcacgaccggtgctcgatttagacgcgatcgaagggtttgggggaggaacgtgctcagttaggacccagacggagccatggaagccccagcgcagcttctcttcctcctgcttctctggcctcccagacaccactggagtgattgtgatgacgcagtctccagccaccctgtctgtgtctccgagggggncgccacctctcctgcacagccagtcagtctagtcnctgacttggttacnccgtaggtaccagcaagaactcgtacggaccacggccctcccgacggtcctcccgtctacgtttacccggngacctacctcccgaacccgngggccctaaccggttgggtaccgtacccaaggtaccgtacggttacgaggtcggggtcggttagggtagtttacggggacttagggttactttttcccncgttacacccgtatccgacgacctaccccgtacgtacgagtacggtaacgtacgttagttagttaccgttaggttttacgttttaccgtacgtacctacggttaacctaaagtttaactttaaaccgttaccgttcggttaccccttaggttacccggttacgttacccgggtttcccgaacccgggtaaccgggtaaccgggtacgttaacggaaaccgtaacggttaaaccgtaacggttaagggttacccgacgtacgacctaccgttaacgtccgttacgtttacccgtacc

SEQ ID NO: 213104 - DNA, 828 bp, Homo sapiens
  misc_feature: GYAE6OF02I35XR.21.27.C05.1.454.CMB.1.raw
  modified_base (201)..(201): a, c, t, g, unknown or other
  misc_feature (201)..(201): n is a, c, g, or t
  modified_base (248)..(248): a, c, t, g, unknown or other
  misc_feature (248)..(248): n is a, c, g, or t
  modified_base (302)..(302): a, c, t, g, unknown or other
  misc_feature (302)..(302): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggatgattgtgatgacgcagtctccagccacctgtctgtgtctccgaggggggancgccaccctctcctgcacagccagtcagtctatcgctgactggtacnctggtaccagcagaatctcggcaggcctcccaggtcctcctctacgtttaccgngactactccacgacgggcccacgttcggtccgtaccccgagaccgtaggttacgacgggtcgggtacgggttagggtaaggttttcggggaaccgttagggttaacgttttttccgaccgtttaccgaaccttacgtaccgtaccggtaccccgtaacccccgttaaacggtaacggtaacgggtaacggaaacgggttaacgtttacgggtttacggaaccgttttaacgggttttttaactttaccggttaccgggtaacccgttaaggtaccttaaaaccgtttaacgttttaaaaccgtttacccggttaccgggttacccgttcggttaaccgggtttaacccgggtaacccgggtttacccgggaaccccgggtaaaccgggggttaaccccgttaaggggtaaccggttaaaaccgtaaccggttaaaaccggtaacccggggtttacggtaccgggttaccgtaccggtaacccgtaacccggtaactttaccggttaccggtttacctttaacccgg

SEQ ID NO: 213105 - DNA, 766 bp, Homo sapiens
  misc_feature: GYAE6OF02GS7XZ.21.27.C05.1.454.CMB.1.raw
  modified_base (173)..(173): a, c, t, g, unknown or other
  misc_feature (173)..(173): n is a, c, g, or t
  modified_base (222)..(222): a, c, t, g, unknown or other
  misc_feature (222)..(222): n is a, c, g, or t
  modified_base (390)..(390): a, c, t, g, unknown or other
  misc_feature (390)..(390): n is a, c, g, or t
tcagtcgtcgctcgcacgaccggtgctcgatttagacgcgatcgaagggtttgggggtagggaacgtgctcagttaggacccagacggagccatggaagccccagcgcagcttctcttcctcctgcttctctggcctcccagacaccacgtggagtgtattcgagatggaccncgagtcctccagtccctacccgtgtcgtagtcgtcctaccgaggggggntccgcccacccgtcctcgtacgacgactaaggtccgaagttccaagtcgtactccggacttagaccgttggttacgccgtacggtaccgacgcgtaacgtaaactccgttacggaccctacggtccctacccggaccggtcttcccgtaccttacgttttaacccggngacccggtaactccggaacccgtaccgggtacctaaccgtcgggttccgtacccggtaagtaccggtacggtttaccagggtcgggtccggtggtacgtttacggggactacgttacgttttccaccgtaccaccgtaagtccgaacgtccgacctacggacgtacgttaggagtacgttagttacggtacgtttagttaacgtttacgtacgaacccgtagtaacctaaacgttacgttaacttaccggtgttacccgtacgttaccgggtcggtaaccgttaccgggaaccgtaaacgggtaaccgtagggtacgaaacggttcgaaacgttaccgtagtaccgcgtgaccgtaactctcggttacttctaacg

SEQ ID NO: 213106 - DNA, 789 bp, Homo sapiens
  misc_feature: GYAE6OF02GFV8D.21.27.C05.1.454.CMB.1.raw
  modified_base (201)..(201): a, c, t, g, unknown or other
  misc_feature (201)..(201): n is a, c, g, or t
  modified_base (254)..(254): a, c, t, g, unknown or other
  misc_feature (254)..(254): n is a, c, g, or t
  modified_base (295)..(295): a, c, t, g, unknown or other
  misc_feature (295)..(295): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctcagccacctgtctgtgtctccgaggggggancgccacctctcctgcacagccagtcagtcatcgctgactgttagcctggtacngcagaatctagcaggctccgaggcctccgtcactttaccgngactacgtccaccgcgggaccctacgttcggtcgtacccgagaccgtagggttacacgggttcgggcgggttaggtaacgttttaggggaacctaagggttacgttttttaccgtaccgttacctaacccgtaacgttaccggaacggtaccccggtaccccttaacgtaacggtacggttaaaggaacggttaattcgggtttacgacgtttaaggttttaactttccggtacgtaccgtacggtaaccttaaagtttaaactttaaacggtttaaccggttacgggtacccgtttagggttaccggtttaccgggttaacccggtttcccgggaacccgggttaaccgggggaacccggttaaggggggttaaccggttaaaaccggttaaaccggtaaaaccggttaaacggtttccgggtaccggttacgtacccggtaaccggtaaccggttaaccggttacgtttacccgggtttaccttaaccccgg

SEQ ID NO: 213107 - DNA, 921 bp, Homo sapiens
  misc_feature: GYAE6OF02HW0TF.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccaccctgtctgtgtctccgaggggggancgccaccctctccgtgcacacgccagtcagtctatcgctgacgttggttagccgtaggtaaccagcgaagtaaacttcgtacggaccgaggccctacccgaggtcccttacctcgttaacgttttacccggcgacctaccgtacccaaccggtacgggtaccctacggttcgggtcccgtaacccgaacggaaccggttaacggtttaccggaaggggttcggggtaccggggttagggtttaacgggtttacggggaaacgttagggttttaaccggttttttcctacccgtttaacccgtaaccgttaacgttacccggtaaccgggtccccgtaaaccccgtttaacggaaacggtaacgggttaaacggtaaagggttacggtttacgggtttaccggttaacggtttttaacggttttttaacgtttccgtaaccgggttaccgtaaacggtaaacctttaaaaacgtttaagtttaaaaccgttttaaccgggttaccgggtttacccggttaccgggttacccgggttaaccccggtttaacccggggtttacccgggaaaccccgggtaaaccggggtaaaccgggttaaacggggttaaaccggtaaaaccggtaaaccggtaaaacccggttagggttaccgggtaaccgggttacctaaccggaacccgtaaccgttaacgtttccgttacggtttaccctttacccg

SEQ ID NO: 213108 - DNA, 705 bp, Homo sapiens
  misc_feature: GYAE6OF02GR5QW.21.27.C05.1.454.CMB.1.raw
  modified_base (203)..(203): a, c, t, g, unknown or other
  misc_feature (203)..(203): n is a, c, g, or t
  modified_base (325)..(325): a, c, t, g, unknown or other
  misc_feature (325)..(325): n is a, c, g, or t
  modified_base (442)..(442): a, c, t, g, unknown or other
  misc_feature (442)..(442): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgacgttggttacgccgtacggtaccagcaagtaaactcgtcggaccgaggccctacccgaggtccctccctactacgtttaccgngcctactcccaccgacgggccctacgtcggtcgtacccaggtaccgtacggttcgagggtcgggtaccggggttagggtacgttttacggggaacttaacgggttacgttttttccncccgttaccaacctacgtccgacgcccgtaccctacgacgtagtagtaacgtagttgttcgtacgttagttttactcgtacgtaccagtactaattaactttaacttacgtcgtaccgttacggtaccgttaccggtaccggttaccggaaccgtaaccggggtaaccgtaagggtaacggtaaaccgtaaccggtaaaccggtacgttacggttacggtacgttaccggaccaacccgttacgttcgttccgttacttaccg

SEQ ID NO: 213109 - DNA, 817 bp, Homo sapiens
  misc_feature: GYAE6OF02H0DWZ.21.27.C05.1.454.CMB.1.raw
  modified_base (171)..(171): a, c, t, g, unknown or other
  misc_feature (171)..(171): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggccctcccagtggggtgtcctgtcanagatacaaactacagcagtcgtcggtccgaaggtacgtgggtgacggcccctcgacgaccgtacccctttcaccgtcctaaccgtcgtacgtaaccacgttaccggtaaccggggggtaaaatcggttaccggcgtacggaaccaaacgtaaggttgggttaggtaagttagggtacgttaggaccgtaccggtccccggtacggaacggtacggtaccgttaggtacggtacggtacggttacgggaaacgtaaccttaagttaacgtaccggtacccgtagtaggtaacgttacggaagtaaccgttagtcggtacgttaagtactttcggtaggtacggtaacgggtccggttaccgtccgttaacccaaccctaaccgtacccccgaaccccggaacggaaccctaacccggtaaacgaaacgtaccgtaccgtaccggttaccccttacccctaccgtaaccttaagtccgtactaccggtacccgtaccctacccggtaaccgacgttaccggttaactttagtttttaacttcggacgtaacgaagggtagtactaacgtactttacggttcggaccttaaccttcccgttaacgttcgaaacccggttaccgggaccgggttaccggtaaggttcccg

SEQ ID NO: 213110 - DNA, 778 bp, Homo sapiens
  misc_feature: GYAE6OF02IO7KO.21.27.C05.1.454.CMB.1.raw
  modified_base (158)..(158): a, c, t, g, unknown or other
  misc_feature (158)..(158): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctccatggggtntcctgtcacagactcaaactacagcagtctggtccaggactggtgacgccctgctacgtaccctttcactccaccgtgtacgacataccgtaccgggaaatcgtcgctaggacaactaagtcggttacggaattggattaggcctacggtcccccggtacggaggacgggtaccttaggtacggtggtaccgtttagggaaacggtaacccgttaagtttaacgtacccgtacccgtaacggttggttaacgttaggaaacgtaacgttacgtaggacgtaagttacgtttcgtaggttgtacggtccgggttcgttccgtacctaaccgtacttacccgaacccccgtaaggtaacccgtaaccgttaccgaaacgtaacgttaccgtaacggttaccctacccgttaacccgtaaaccctttaaagtccgttaccgtacgttaccaacccgttacccggaaccgaccgtaaccgggtaccttacgttttttaacgtttttcggaacgtaccgtaaaggtacgggtaactacggtaaccttacggttacggtacgtaacccgttacccttccgttacgtacccgttcccggtacggggtacccgtagggtttaacccgg

SEQ ID NO: 213111 - DNA, 662 bp, Homo sapiens
  misc_feature: GYAE6OF02H6I9Z.21.27.C05.1.454.CMB.1.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
  modified_base (390)..(390): a, c, t, g, unknown or other
  misc_feature (390)..(390): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagcccacctgtctgtgtctccgaggggggacncgccaccctgtcctgcacacgccagtcagtctatcgctgactggttagcctggtaccagcaagtaatctggccaggcctcccgaggccttcctctaactttccgngcactccaccgagggccacgttggtctccgagactaggttcaggttcggcggtggtagtttcgggactaggttacgttttcncttaccactactcacgcccgtaccctacgtaaggacggtagtaagacttggttacggtacgtttaagttttacgtttacgtcgtacctacggtaacctaaaatttaatttaaaactttacggtcggtaccgttggtaccgtttaccgtacgggttccgggaacccgtaccggggtaaccgtaagggtacggtaaaacgttacgtaaaaccgtacggttaacgggtacggtagacggtaccaaccgttacgttacgttcggttactttaaccg

SEQ ID NO: 213112 - DNA, 810 bp, Homo sapiens
  misc_feature: GYAE6OF02HBBI2.21.27.C05.1.454.CMB.1.raw
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
tcagtcgtcgctcgcacgaccggtgctcgatttagacgcgatcgaagggtttggggggaggaactgctcagttacggacccagacggagccatggaacgccccagcgcagcttctcttcctcctgcttctctgcctcccgagacaccacgtggagtgtattgtgatcgacgctacgtcctccgagccctacctgtctgtcgtcgacggaggggacccgccncctcgtctcgcacncgaccgagtcacgttctacgtccgtcgtacgtacggttggtaccgtccggtaggtaccacgacgtaaagtaaaccgttccggacggaccccgtacggtccccgtaccccggtacggccccttccccgttaactttaaccgtttcccggccgacctaacccgtaccccgaaaccgggtcgggtacccgtacggtttccgggtacccgtaacccggaagtaacgttagggttaccgtaggggtcgggtccgggttaaggttacggtttacgggacgttagtttacgtttcctacggaccctacgtattacccgacgtccccgtaacaacggtacggtaaagtacggtaaagttcgttacgttacgttacgttttactttacgtttccgtaacggactaacgtaactttaaattaacgtttaacgttacccggtcgtaccggtcggttacccgttcgggttaaccgggttcccgaacccggggtaaccgggaacgttaacggggtaacgtaaacgtaccgaaaccgttcggtaacggtcgtacggtacaccgtacttacggtcgttccgtacttccgg

SEQ ID NO: 213113 - DNA, 732 bp, Homo sapiens
  misc_feature: GYAE6OF02IN63F.21.27.C05.1.454.CMB.1.raw
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
  modified_base (260)..(260): a, c, t, g, unknown or other
  misc_feature (260)..(260): n is a, c, g, or t
  modified_base (337)..(337): a, c, t, g, unknown or other
  misc_feature (337)..(337): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccacctgtctgtcgtcgtccgagggggacnccgccaccctcgttccnaccacacgccagtcagtcctatcgctgacgttcgggttanccgttcggtaccacgcgaacgtaaactcgtcggaccgtaggccctcccgacggttcctcccgtactacgtttaccgngccacctaccgaccgacggccacgtcggtccgtccaggtaccgaggttccagggttgggacggttaggtagtttgggacttagttgtttcctctacgtaccctagtacccggtaacgtcccgtacccgtaacgtacggtacggtaaggtagttacgtttacgtccgggttactttaacgggttttactttacgtaccgacccgttaagaccgtttaaattaacgtttaacgttaccgtcgttaccgttccgggttcggtaccgtttaacccgggttccgtacccggggtaaccgggtaaccggttagggttaacggtaaccggtaaaccgtaaacggtacggtacggttccggaccgttacgacgtaaccgttgaccgtttcgtttacgttaccg

SEQ ID NO: 213114 - DNA, 681 bp, Homo sapiens
  misc_feature: GYAE6OF02GDFK3.21.27.C05.1.454.CMB.1.raw
  modified_base (203)..(203): a, c, t, g, unknown or other
  misc_feature (203)..(203): n is a, c, g, or t
  modified_base (320)..(320): a, c, t, g, unknown or other
  misc_feature (320)..(320): n is a, c, g, or t
  modified_base (414)..(414): a, c, t, g, unknown or other
  misc_feature (414)..(414): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggnccgccaccctctcctgcacagccagtcagtctatcgctgacttggttacgccgtggtaccagcaagtaactctcggaccaggtcctcccgaggtccttccctactacgtttaccggnccactacccgaccgacgggcccacgttcggtccgtcccagacgtacggttcgaggtcgggtcggtaggtacgttgggactaggttagttttccnctcacctagtcacgccctacctagagtagtagaagtgttgtgtcttagtttnttcgtntaccagtaactaagttaacttaacgttacgtccggtaccttcggtaccggttacggttaccggttacccgggacccgggtaacccgggtaaccggtagggttaaccggtaaaaccgttaacccggtaaaccggtaaaccggttcgggttaaccggtaccggttaaccgacccgtaaccttacgtttcccgttaccgttcctttaacccg

SEQ ID NO: 213115 - DNA, 740 bp, Homo sapiens
  misc_feature: GYAE6OF02F7CW2.21.27.C05.1.454.CMB.1.raw
  modified_base (238)..(238): a, c, t, g, unknown or other
  misc_feature (238)..(238): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatcaaactacagcagtctgtccaggactggtgacggccctcgcacgtacccttcactccacctgtnacatccgtacggggaaatgtcgctggacaaactaagtggttaggaagttggagttacggctaccggtccccggtcggaggacggtccgttaggacggtggtcgttagggaaacggtaccttaagttactaccggtcccgtaggtaggtacgtagaaacggtacttacgtgacgtaggtaattcgtggtagtacggcggttccgttccgactaccgtaactccgtaaccccgacgtaaccgtaccgtaccgaaaggtaactaccgtacggttccgtcccctacgtaacccttaagtcgttacgttacccgtccgttaacccgacccggtaacccgtaccgtaccggttacgtttacggttttttaagttttcggaacggtacgtaaccggtagggtactaccggtaaccttaccggtttcgggaacccgttacccgtttaccgttcccgttacggtaacccgttccgggttaccggggtacccggtaggggttttaaccccgg

SEQ ID NO: 213116 - DNA, 577 bp, Homo sapiens
  misc_feature: GYAE6OF02F11K0.21.27.C05.1.454.CMB.1.raw
  modified_base (301)..(301): a, c, t, g, unknown or other
  misc_feature (301)..(301): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatgggggtgtcctgtcacagatcaaactacagcagtctggtccaggactggtgaggccctcgcagaccctttcactcacctgtgacatctccggggaaaatgtcgctggcaacaatggttggaattggattaggcacgtccccgtgagnggccttgagtggcttggagctattatacgtccagtggtatgaagtactatgcagtattctgtgaggcggtcgtctcaccatccaccccagaccacgtccaagactcacggtcctccctcctaactacgtgtctcggactaccgtccgacgaccgacgtcttagttttactttcggtcgtacgaaggtacggtatccgtaacgtagttaccggtcgtaccttacccgttccgttacggtacccgttcccggtaggggtacccgtaggggtttaaccg

SEQ ID NO: 213117 - DNA, 592 bp, Homo sapiens
  misc_feature: GYAE6OF02I169R.21.27.C05.1.454.CMB.1.raw
  modified_base (165)..(165): a, c, t, g, unknown or other
  misc_feature (165)..(165): n is a, c, g, or t
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
  modified_base (320)..(320): a, c, t, g, unknown or other
  misc_feature (320)..(320): n is a, c, g, or t
  modified_base (577)..(577): a, c, t, g, unknown or other
  misc_feature (577)..(577): n is a, c, g, or t
  modified_base (586)..(586): a, c, t, g, unknown or other
  misc_feature (586)..(586): n is a, c, g, or t
tcagtcgtcgctcgcacgaccggtgctcgatttagacgcgatcgaagggtttgggggaggaactgctcagttaggacccagacggagccatgggaagccccagcgcagcttctcttcctcctgcttctctggctccagacaccactggagtgattgtgatgacgntagtctccagccacctgtctgtgtctcggagggggancgccctaccctctcctgcacagccagtcagtctatccgntgacttggtacgccgtggaccagtcaagaattcgtcggccgaggcctaccccgaggtcccttacctcttacgtttccgngctactcccgaccgacgggccctaggtggccgttaccagtacgtggttcgaggtcgggcggtgggtagtttcgggacttaaggttcttttctcctacactacgtcacgtccgtacctaagacgtagagtagtagtgttacgtacttagtttcttcgtctacctagataacttataactttacgtcgcgttgacgtcgttacgggtacgacggacggacgtagtaaggaactaagaacgtatggtacgctcgcaactntcgttactnttaccg

SEQ ID NO: 213118 - DNA, 645 bp, Homo sapiens
  misc_feature: GYAE6OF02H732L.21.27.C05.1.454.CMB.1.raw
  modified_base (253)..(253): a, c, t, g, unknown or other
  misc_feature (253)..(253): n is a, c, g, or t
  modified_base (263)..(263): a, c, t, g, unknown or other
  misc_feature (263)..(263): n is a, c, g, or t
  modified_base (315)..(315): a, c, t, g, unknown or other
  misc_feature (315)..(315): n is a, c, g, or t
  modified_base (402)..(402): a, c, t, g, unknown or other
  misc_feature (402)..(402): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggagccgccaccctctcctgccacacgccagtcagtctatcgctgacttggtancctggtaccngcaagaaatctggtacacggcctacccaggcccttcctcttaactttaccgngaccactaccccaacgacgggcccacgtggtcgtcccaagacgtggtcgaggtgggcggtaggtagttgggaactggttagttttcnctacacctatccgacgcccgtaccctagaggtaagtagaagtagttggttacgtacgtttaacgtttatttccgtacgtacctagaactaattaacttaaacgttacggtacggtccgtcgtacgttaccgtacggttccgggaaccgtacggggaaccgtaggtaacggtaaactaacggtaaaaccgtacgtacggtcgtaccgtacggacctaaccgtacttacgtttacgtccgttacc

SEQ ID NO: 213119 - DNA, 941 bp, Homo sapiens
  misc_feature: GYAE6OF02IXWV1.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctcagccacctgtctgtgtctccggagggggacnccgcctacctctcctggacctacacgccagtccgacgttctacgtccgacgttgtaccgttaggtttaacgccgttacgggtaaccagtcgtaaaacgtaaacttccgtacgggaccgtaacgggccttacccgacgggtcccttacccgtacttaacggttttaccgcggtacctaaccgtacccgaaccggacgggtaccctaacggtttcggggtaccgtaacccgaagtaccggtacggtttacgaacggggttcgggtacgggttgggtttaacggtttacggggaccgttaaggtttaccggtttttctaccgtacccgtaccgttaacgttcccgtaaaccgggttaccccgttaacccgtaaacggttaacggttaaacggtaacggtaacggttacgtttacgggtttaccggtaaacgttttaacggttttttaaccgttttaccgtaaccggtaaccctaaacgggttaccttaaaacggtttaacgtttaaaccgtttaacgggttacccggttccgttacccgggttaccggttacccgggtttaaacccggggttacccgggtaaacccggggtttaaacccgggggtaaccggttaaacggggttaaaacgggttaaaacccggttaaaccgggttaaaaccggttacccgggttaacggttaccggtaccggtttaaccggaccgttaaccgttacgttacggttttacccgtactttacccg

SEQ ID NO: 213120 - DNA, 829 bp, Homo sapiens
  misc_feature: GYAE6OF02IFFH1.21.27.C05.1.454.CMB.1.raw
tcagtcgtcgctcgcacgaccggtgctcgatttagacgcgatcgaagggtttgggggcgagagcctgctgacttctggctgaccagggcagtcaccggagctccagacaatgtctgtctccttcctcatcttcctgcccgtgctgggccctcccatgggggtgtcctgtcacagatacaaactacagcagtctggtccaggactgggtgacggcccctcgcacgtaccctttcactcacctgtgactatccgtaccgggggaaaatcggtcgcgtggacaaacgaagtgggttaggtaagtttgggaatttagggccgtacggtcccccggtacggaggtacgggtccttaggtaggtcgggtacgtttacgggaaacggtaccctttaatttaccgtaacccgggttcccgtaaggttggtaacttaggaaacgtaccttaagtacgtacgagttaacttcgtaggtaggaacggtccggttacgttcctaccgaacctacgtacccgaaaccccgtaagaacccgtaaccgtaaccgaaacggtaaactcgtaaccggttcccttacccccgtaaccctaaaccgttaatcgttccgtacgtacccgtaacccgtaccccggtaaccgaacccgtaaccgggttaccgtttaaacgggttttttttcgttttacgggaccgttaaaccgggaaacggggttacggggtacctttaccgaaaccgtttacgggtttaccggtaacccggttaaccctttaccgttacccgttacgggtaccccttaccgggggttccgggtaacccgggttaacggtttaaccccggg

SEQ ID NO: 213121 - DNA, 690 bp, Homo sapiens
  misc_feature: GYAE6OF02HUF9W.21.27.C05.1.454.CMB.1.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
  modified_base (404)..(404): a, c, t, g, unknown or other
  misc_feature (404)..(404): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtcgtctccgaggggggancgccaccctctccgtgcacagcctagtcagtctatcgctgacttggtagcctggtaccagtcaagaatcgtggccaggctcccaggcctccgtctacgtttaccgngtcacttaccgaccgacgggcctacgtcgggtcctccgaagtacctacggttcaggtcggcggttggtatttggggactaggtacgtttttacncgttaccaaccgtcgtaccgacgtacccgtaccccgtaaacgtacggtaacgttaacggaaagtacgttacggttcgtacgtttaacgtttttacgttttaccgtacgacccgttaagctaaaagtttaacttaaacgtttacgttccgggtaccgttacgtcccggttaaccggttaccggttccggaaccggtaccgggaaccgtaacggggtacgtaaacgtaaccgtaaaccggtacgtaggtacgaccgtacgaccgaacctacgttctcgttacctaccg

SEQ ID NO: 213122 - DNA, 664 bp, Homo sapiens
  misc_feature: GYAE6OF02F29HN.21.27.C05.1.454.CMB.1.raw
  modified_base (204)..(204): a, c, t, g, unknown or other
  misc_feature (204)..(204): n is a, c, g, or t
  modified_base (253)..(253): a, c, t, g, unknown or other
  misc_feature (253)..(253): n is a, c, g, or t
  modified_base (318)..(318): a, c, t, g, unknown or other
  misc_feature (318)..(318): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagaccaccactggagtgattgtgatgacgcagtctccagccacctgtcctgtgtctccgaggggggcncgccacctcgtcctgcacagccagtcagtctatcgctgacctggttacnccgtggtaccaggtacaagaaactcgtaggccacggcctacccgaggcctcctctatttacccgngcactccgaccgacgggacctctgggtactcccgaagaccgtaggttccgaaggtgggacggtggtagttgggacctaggtacttttcgctccgactactcgtacgcccgtaccctaacgaggtacgtaggtaaggtacttggttcgacgtttaacggttttaattcgtacgtaccctaggtaactaagtaacgttaacttaccggttcgtacccgttcggtaccgttacgggttaacccggttcggacccgaaccggggtaaccgtagggtaacggtaacgtaaccggtaaacgtacgtacgggtcgtacgtcggacctacgtaacgttcgttaccgtcttaccg

SEQ ID NO: 213123 - DNA, 688 bp, Homo sapiens
  misc_feature: GYAE6OF02I42OH.21.27.C05.1.454.CMB.1.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (411)..(411): a, c, t, g, unknown or other
  misc_feature (411)..(411): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctgctcccagacaccactggagtgattgtgatgacgcagtctccagccaccctgtctgtgtctccgaggggggacccgccaccctctcctgccacncgccagtcagtctatcgntcgactggttacnccgtggtaccngcaagaactcgtggccaggccctacccgaggtccctcctatacgtttaccgcacctactccccgacgacgggcctacgtggtccgtacccagacgtacggttcgaggtcggcggttaggtagtttcgggaactaggttcttttccncgtactaccagtccgacgtccgtacctacgagtagtacgaacgtagttcgttacgacgttacgttttacgtttcgtacgtaccgtaagtaactaacttaacgtttaaacgttaccggttcggtacccgttacggttacccggttacggtaacccggtttccgggaacccgtaaccggggtaaccgtaagggtacggtaaaccggtaaccggtaaaaccggtacgttgggtacgtaccgtacgtacccggtaaccgtacgttcgttacgtacgttacc

SEQ ID NO: 213124 - DNA, 1001 bp, Homo sapiens
  misc_feature: GYAE6OF02GCVMF.21.27.C05.1.454.CMB.1.raw
tcagtcgtcgctcgcacgaccggtgctcgatttagacgcgatcgaagggtttgggggcgagagcctgctgacttctggctgaccagggcagtcaccggagctccagacaatgtctgtctccttcctcatctcctgcccgtgctgggcctcccatgggtgtcctgtcacagactcaaactacagcagtctggtccaggactggtgaggccctcgcagaccctttcactcaccgtgtcgactactcgtaccgggtaaaatcgtaccgtcgttaggaccaaacgtaacgttcgggttaggtaaccgtttaggaacttttaacgggacctaacggttacccccggttacggtaacggtaacgggtaccccgtttaggaaggtttcgggtaccgttttacggggtaaacgggtaacccgtttaaagtttaacgtaacccggttaccccgtaaggttcgggttaacgttaacggaaaacggtaccgttaacgtcggtaccgtaacggtaacgtttccgttacggttcggtaaacggtcccgggtttaccgtttaccgtaccgtaacccgtaacgttaccccgaacccccggtaggtaaaccccgtaaccggttacccgtaaaacgggtaaaccttaccggtaaaccggggtttaccctttaacccccgtaccccgttaaaccccgtttaaacgttacccggttacccgtttaccggtttaaccccttaacccgtttaccccccgggtaaacgtaaccccggttaacccggggtaaccttttaaaccggggtttttttaaacgttttttaccgggttaaaccgttacccgggttaaacgggttaaccgggggttaaccttaacccggtaaaccgggtttaaaccggttttaccgggggttaaacccgttaacccgtttaacccccgtttcccggtttaacccggttaacccggtttccccgggtaccgggggttaaccccggttaaccggggtttttaaacccccggg

SEQ ID NO: 213125 - DNA, 712 bp, Homo sapiens
  misc_feature: GYAE6OF02JX5X8.21.27.C05.1.454.CMB.1.raw
tcagtcgtcgctcgcacgaccggtgctcgatttagacgcgatcgaagggtttggggggaagaggaagactgacggtcctgccacaggtggtgctgggcacggtgggccctcgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtacgtctcacatcaccccagacacgtcaagatcagtctccctaccactatgtctcgtcaccgtacccgacgacgacgctagttttactttgtcgtacaagaggtactacactacgttcgtagtaccttacccgttccttacgtaccttccggacggggcctaacggggtacgttttcgacccgtacgttccctacccgtacgtaccgacccttacccgaaaccggtaaccggccccgtaaggttcccgttaccccgttacccccggtcgggtacccccgtcccgttaccgtacccgtaccgaccgggtaacgtacccctaccggtacccgagtaccgactaaccgggccgtacccgggtcccggtacgggtcccttaccggtacccgtaccgggaacttaaaccggtacccgtttaccccggtacccggaacggtaccccgg

SEQ ID NO: 213126 - DNA, 667 bp, Homo sapiens
  misc_feature: GYAE6OF02I2HF4.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgaccgtgctgggcctcccagtggggtgtcctgtcacagatcaaactacagcagtctggtccaggactggtgacggccctcgcacgtaccctttcacctccacctgtcgacactcgtaccggggaaaatggtcgctggcaacaagtggttgaattggattaggcagtccccgtgagacggccttggagtggcgttggaagtactattatacgtccgagtggtatagaagactatgacagtattctgtgagtcggtcgtctcgaccactccaccccgacgaccaccgtacaaacgtaactccgaacggttccctacccgtacccctaaccttaacgtccgttacctcggttacccacccgttaccccggaaccgaccgtaacccggtacgtttaacgttttttagttttacggttagaccgtaacgggtagggtaaccttaccggtaacttaaccggtttccggtacgtacccttaccgttcccgtttacgtacccgttcccggtacggggtacccggtaggggttttaacccgg

SEQ ID NO: 213127 - DNA, 802 bp, Homo sapiens
  misc_feature: GYAE6OF02G6MOK.21.27.C05.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (311)..(311): a, c, t, g, unknown or other
  misc_feature (311)..(311): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggncgccaccctntcctgcacagccagtcagtctatcgctgactggttancctggtaccagcagaaatcgtggccaggcctcccgaggtccctcctcgtacgttttacccggngacctactccccaaccgaggggacccctaacgttcggggtaccgtccccaaggtacccgtagggtttaccgaagggttcggggacggggtttagggtaacgttttgggggaacctaagggttacggtttttttcctaccgtaccgaaccctattacccgaacggtccccggtaaccccttaacggaggtaacggttacggaaacggtagttggtttacgacgtttaacgggtttttaacttttccgtcgtaacccgtaaggtaaccgttaaaatttaacgtttaaagttttaaccggtcggggttaccccttagggttaccccgggtttacgtaaacccgggttttacccgggaaaccggtaaaccgggggttaacccgtaaaggggttaacgggtaaaacttaacccgggtaaaaaccgtaccggtttaggtaccgggtaccttaccggaccgtaaacccgtagtttaccccgtaggtttaccccttacg

SEQ ID NO: 213128 - DNA, 611 bp, Homo sapiens
  misc_feature: GYAE6OF02F4JAF.21.27.C05.1.454.CMB.1.raw
  modified_base (156)..(156): a, c, t, g, unknown or other
  misc_feature (156)..(156): n is a, c, g, or t
  modified_base (202)..(202): a, c, t, g, unknown or other
  misc_feature (202)..(202): n is a, c, g, or t
  modified_base (222)..(222): a, c, t, g, unknown or other
  misc_feature (222)..(222): n is a, c, g, or t
  modified_base (274)..(274): a, c, t, g, unknown or other
  misc_feature (274)..(274): n is a, c, g, or t
  modified_base (307)..(307): a, c, t, g, unknown or other
  misc_feature (307)..(307): n is a, c, g, or t
  modified_base (466)..(466): a, c, t, g, unknown or other
  misc_feature (466)..(466): n is a, c, g, or t
  modified_base (477)..(477): a, c, t, g, unknown or other
  misc_feature (477)..(477): n is a, c, g, or t
  modified_base (579)..(579): a, c, t, g, unknown or other
  misc_feature (579)..(579): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggatgattgngatgacgcagtctccagccaccctgtctgtgtctccgagggggganccgccaccctctcctgcacngccagtcagtctatccgactgacgtgttacgcctggtaccagcaagaatcgnggccaggcctccgagctcctatacgtttaccgnctacgtcccggacccggggccacgttcggtacgtacccaggtaccgacggtttacgacggttcgggccgggttggacgttttcggggaacctaaggttacgtttttcctaccgtaccgacctagtccgtaacgcccgtaccctagaggtactagacgtntagtgtacgtnttttactcacgctagactaatataacgttcgaggtctggcgtacggtcgttacggccgtaaccggaacgaaggtacgaactacgaacgaacttggccgtacncggacctcgtagttctaagttccgttatcccg

SEQ ID NO: 213129 - DNA, 756 bp, Homo sapiens
  misc_feature: GYAE6OF02GGP6F.21.27.C05.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtgactntacgtacgggaaatcggtcgctgacaactaagttggttaggtaagttggtaagttacggcctacggttccccggtaggaggtacggtccgttaggtaggtgggtccgttagggaacggttaccttaagttacgtaacccgttcctaggttcggtaagtaggtaaacgtacgttagtggtacgtaagttacttaccgttaggtacggaacggttcgggttccgttaccttaccaaccgtactacccgaaccccgaacggtaaccctaaccggtaacaaacggtaacttaccggtaaccggttacccttacccgttaacccgtaaccctttaagttcccggttacttaccgtacccgtaacccgttacccgaaccggaccgtaaccggttctttaacgtttttcgttttggaacgtacgtaaggtacggtacttacgtaactacggtttaccggtacgttacccgttacttccggttacgtaccgttccgggtacgggtacggttaacggttaccg

SEQ ID NO: 213130 - DNA, 688 bp, Homo sapiens
  misc_feature: GYAE6OF02GCIBD.21.27.C05.1.454.CMB.1.raw
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (431)..(431): a, c, t, g, unknown or other
  misc_feature (431)..(431): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccacctctcctgcacncgcagtcagtctatcgctgacgtggttacgccgttaggtaccacgcaagaaatccgtacggtccgaggcccttccccgaggtccctcccgtacttacgtttacccggcgacctactacccgaccgacgggtccctacgtcgggtccgtacccaggtaccgaggttcaagggtcgggcggtggtagtttagggactaggttaacgttttccncgtacctacagtcgacgacccgtacctaacgaggtacgtgtaaacgtgttggttacacgtttaggttttacttaccgtcgtccgtaagtactttaaataattaacctttacggcggttccttacggtccgtaccggttaccggttccggacccggaaccgggtaaccgtagggttacgtaaacgtaaccgaaacggttaccgttacggtacggtctacggtacctaacccgttattcccggttagttacccgttacc

SEQ ID NO: 213131 - DNA, 708 bp, Homo sapiens
  misc_feature: GYAE6OF02H9ONA.21.27.C05.1.454.CMB.1.raw
  modified_base (237)..(237): a, c, t, g, unknown or other
  misc_feature (237)..(237): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttctcatcttcctgcccgtgctgggcctcccatggggtgtcctgtcacagatacaaactacagcagtctggtccaggactggtgacggccctgcacgtaccctttcactcacctgtnacagtcgtacggggaaatgtcgctggcaacgtagtggttaggtagttaggattaggactacggtccccggtagtaggtacggtccttaggaggttcgggtacgtttacggggaaacggtacccttaaagttacgtaccggtccctaaggtcggttaactaggaaacgtacgtatacggactaagtagtttcgtgtacgtacgggtcggttctttcctactaaccgtattaccccacccgtagtaaccctaccgtaaccaaacgaactccgtaacggttaccctaccccttaccgaaacgttacttcggtccttacggtaccgtaccctacccggaacgacgtaccgtctttaagtttttcgtttgacgtacgaaggtacgggtaacctactacggtatttaccgggtaactaccgtttaccgtcttacggtaccccgttacggttaccgggtaccgtagggtttaacccgg

SEQ ID NO: 213132 - DNA, 585 bp, Homo sapiens
  misc_feature: GYAE6OF02GZAH9.21.27.C05.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (310)..(310): a, c, t, g, unknown or other
  misc_feature (310)..(310): n is a, c, g, or t
  modified_base (392)..(392): a, c, t, g, unknown or other
  misc_feature (392)..(392): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctcagccaccctgtctgtgtctccgagggggganccgccaccctctcctgcacacgccagtcagtctancgctgactggtanccgtaggtaccagcagaaatcgtggccaggcctcccgaggcctcctactacgtttaccgngaccactaccgaccacgggcccacgtcggtcgcccagacgacggttcgagtgggcgtaggtagttggactagtacgttttcnctcaccgatacgacgacctccctacgagtaggtacgtaagtagttggttacgagttaagtttattcgtagtaccagtactaaatattaagtacgtcgtctgtcgtacgtacggttcgaacgaacggacgtaggtacgtaacgtacgaaacgtacggtacgtcggatacgactaccgtacgtcgtacgtctacg

SEQ ID NO: 213133 - DNA, 713 bp, Homo sapiens
  misc_feature: GYAE6OF02HXPIT.21.27.C05.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
  modified_base (405)..(405): a, c, t, g, unknown or other
  misc_feature (405)..(405): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgactgactggttagcctggtaccagcaagaatcgtggccaggcctcccgaggccttcctctactttaccgtncctactccaaccgacgggccctacgttcggtcgtcccgagacgtacggttccagggtcgggacggtggtagtttcggggactagttagttttccncttccgactatccgacgcccgtacccttaacgaggtaaggtagaaagtagttaggttcgtacgttaagtttttaacgtttccgtacgtaccgtaacggtactaaacgttaagtttaaacgtttacggttcggtacccgttagggtacccggttacggtaacccgggtttaccgggacccgtaaaccggggtaacccgtaaggggtaacgggtaaaccgtaaccggtaaaccggtaacgttacgggtacggtaccgttaccggacccgtaacccgttacgtttacccgttccggttacctttaacccgg

SEQ ID NO: 213134 - DNA, 740 bp, Homo sapiens
  misc_feature: GYAE6OF02F1OHV.21.27.C05.1.454.CMB.1.raw
  modified_base (207)..(207): a, c, t, g, unknown or other
  misc_feature (207)..(207): n is a, c, g, or t
  modified_base (462)..(462): a, c, t, g, unknown or other
  misc_feature (462)..(462): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtcctccacgcccaccctgtctgtgtctccggagggggacnccgcccacccttctcctcgaccacacgcccagtccagttctactccgctgacgttggttacgccgtacggtaccagacaagtaactcgtcggaccgacggccctcccgaggtcccttacccttacgtaacgtttacccgcgacctaccgtaccccgaccggaaccgggccctaacggttcggtccgtacccgaagtaccgtggttaccgaggtcggtcgggttaggtacgtttagggacttaggtttcttttccncctaccacctataccgacgcccgtaccgtacgaggtacgtagaagtcgttgtacgtagttttactttacgtttccacgtaccgaagttaacgtaacgtttaaatttaacgttccggtcggttacttaccgggtccggttacccgtaccgggttacccgggacccggtaaaccgggtaacggtaacggggttaacgaaaaccgttaaccggaaaacgggttacgttcggtaccggtacctcgaacccgtacgttacgttacctttcgtacccttacccg

SEQ ID NO: 213135 - DNA, 771 bp, Homo sapiens
  misc_feature: GYAE6OF02HO6DJ.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggccctcccagtgggggtgtcctgtcacagatacaaactacagcagtctggtaccgaggactgggtgacggtccctgacagtacccctttcactcacctgtgactagtccgtacggggaaaatgtcgcgtgacaactagtaggtaggtataggtattaggctaccgtcccgtgaggtacgtccgtagacggtggacgttaggaacggtacctagttaacgtacgtaccctaggtacggtagtacggaaagtacgtagtacggactagtagttcgtagtacgaaggtccggttacgtctcctaaacgacctacccgtaaccccgaagtaaccgtacccgtaaacgtaacgtaaaccgtcggtaacggttacccctaccccggttaccaaaccttaaagttccgttaccgtcggttaacccaaccccggttaccccggaaccgtaaccggtaccgggttaaccgttttacggttttttaacgttttacggtaacgacggtaaagggtaccgggaaccgttaccgtaaccgttttaacggtccgggttaaacccgttaaccgttcccgttacccggttacgttaacccgggttccggggtacggggttacccgtaacggtttaaccgggg

SEQ ID NO: 213136 - DNA, 775 bp, Homo sapiens
  misc_feature: GYAE6OF02J0PQZ.21.27.C05.1.454.CMB.1.raw
  modified_base (208)..(208): a, c, t, g, unknown or other
  misc_feature (208)..(208): n is a, c, g, or t
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
  modified_base (336)..(336): a, c, t, g, unknown or other
  misc_feature (336)..(336): n is a, c, g, or t
  modified_base (354)..(354): a, c, t, g, unknown or other
  misc_feature (354)..(354): n is a, c, g, or t
  modified_base (453)..(453): a, c, t, g, unknown or other
  misc_feature (453)..(453): n is a, c, g, or t
tcagtcgtcgctcgcacgaccggtgctcgatttagacgcgatcgaagggtttgggggaggaactgctcagttaggacccagacggagccatggaaggccccagcgcagcttctcttcctcctgcttctctggcctcccagaccaccgactggagtgattgtgatgacgcagtcctccagccacctgtctgtgtcctccgagggggganccgaccctacccgtctcctgaccacgacgccagtccaggtcctagtcgctgactggttacnccgtggtaccngacaagaactcgtacggccctagggcctacccaggtcctacctctagtttaccggncctacgtccccgaaccgngggtaccctacgtcgggttactcccaaggaccgtaggtttccgaggtggggtaccggttaggttaagtttcggggaacctaggttacgttttcctaccnccgtaacctacgtacgaaccggtcccgtacccctaaagacgggttaagtacgtaacggtagtttagttacggtaccttaaggtttttaaccttccgaggtaccctaaagttaccgtttaaatttaactaaacgtttaccgtccgggtttcccgttacggtaccgttaccggttacccggttaccgggtaacccgaaaccggggttacccgtaagggttaaccgggtaaacgttaaccgggtaaaacccgttacggttacggttaaccggtcttacgggacccttaaacccgttggtactttacccgggtttccttaacccgg

SEQ ID NO: 213137 - DNA, 726 bp, Homo sapiens
  misc_feature: GYAE6OF02FKVF3.21.27.C05.1.454.CMB.1.raw
  modified_base (309)..(309): a, c, t, g, unknown or other
  misc_feature (309)..(309): n is a, c, g, or t
tcagtcgtcgctcgcacgaccggtgctcgatttagacgcgatcgaagggtttggggaggaactgctcagttaggacccagacggagccatggaagccccagcgcagcttctcttcctcctgcttctctggcctcccagacaccactggagtgattgtgatgacgcagtctccagcccaccctgtctgtgtctccgaggggtagccgcccaccctctccctgcacagcccagtcagtctatcgctgacgtggttagcctggtaccagcagaactctggccaggcctccccaggcctcctctactttacgntcacttccacccgacgggcctaccgttcgggtacgtccccgaaggtacctacgggtttccgacgggttcgggtcggggttagggtaacgttttcgggggaacctacgggtttaacggtttttccctaccgttaccgtaccctacgtaccgtaacgcccggaccctacgtaacggtacgttacggaaacgtagttggttacgacgttagttttactttaccgtcgtaccctagtacctaacttaacgttaactttaccgtacgggtacctacggtaccgttaccgggtaccgttaccgggacccgtaaccggggtaacccgtaacgggtacggtaaacgttaaccgtaaaccggtaaccgtacggttacggtaaccgtcgtacctaccgttaccttaccgttccgtttacgttacccg

SEQ ID NO: 213138 - DNA, 833 bp, Homo sapiens
  misc_feature: GYAE6OF02F7OTZ.21.27.C05.1.454.CMB.1.raw
  modified_base (204)..(204): a, c, t, g, unknown or other
  misc_feature (204)..(204): n is a, c, g, or t
  modified_base (256)..(256): a, c, t, g, unknown or other
  misc_feature (256)..(256): n is a, c, g, or t
  modified_base (318)..(318): a, c, t, g, unknown or other
  misc_feature (318)..(318): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctaccagccacctgtctgtcgtctccgagggggacnccgccacctctcctcgacacagccagtcagtctaatcgctagcgtggttacnccgtggtaaccagacaagaacttcgtcggccaggcctcccgagtccctctctactttaccgngaccactaccgaccgcggtacccacgttggtaccgacccaaggtaccgttaggttcgagggtcgggtaccggtaagggttaggtttacggggaaccttagggtttacgttttttacccgtaccggttaaccctaacccgtagttaccggtacccggtaccccggtaaccccgttaacgtaacgggtaacgggttaacggtaaaccgggtttagtttagggttacccggttaacgttttaacggttttttaaacgttttccggttaaccggttacccgtaagttaaccttaaaacgtttaacgtttaaaccgtttaaccgttccgggtaaccgtttcggtaccgtttaccgggttaacccgggttaccccggtaaccggggtaacccgggtaacccgggttaagggtaaccggtaaaccttaaaccggtaaaccccggtttaagtaccggggttaaccggtaccgtaccggtaaccctaaccgtaccggtttacccgttacgttccctttaacccg

SEQ ID NO: 213139 - DNA, 600 bp, Homo sapiens
  misc_feature: GYAE6OF02GNWNM.21.27.C05.1.454.CMB.1.raw
  modified_base (387)..(387): a, c, t, g, unknown or other
  misc_feature (387)..(387): n is a, c, g, or t
  modified_base (476)..(476): a, c, t, g, unknown or other
  misc_feature (476)..(476): n is a, c, g, or t
tcagtcgtcgctcgcacgaccggtgctcgatttagacgcgatcgaagggtttggggggaagaggaagactgacggtcctgccacaggtggtgctgggcacggtgggccctcgcagaccctttcactcacctgtgacatctccggggaaaatgtcgctggcaacaatggttggaattggattaggcagtccccgtgagaggccttgagtggcttggaaggacctattatacgtcccagtggtatgaagactatgcagattctgtgagcggtcgtctcaccatccacccagacacgtccaagaatcagtctccctcacctaatgtctgtccactcccgacgacacggtctagttttactttgagacaaggaggtactcacattcggtanacctacctcttagacctcgtacgggcccagggtacgttgcaccgtctcctcactcctaccacgacggccctagtccgtccttaccccgngacccgtcccgtagcctaccgagtaccgccacccgtcgagacgacccacgacggtcccggtccgtcgggtcctcggcccgttaggtaccgaacgggttaccctccggttacccggacgtaccgg

SEQ ID NO: 213140 - DNA, 661 bp, Homo sapiens
  misc_feature: GYAE6OF02G2JJ7.21.27.C05.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtcgtctccgaggggggacncgccaccctctcctgcacacgccagtccagtctatcgctgactggttacgccgtggtaccagacaagaaactctcggccaggcctcccaggctccctcgtactttaccgtgcctactcccaccgacggccacgtggtcctcccagacgtacggttcaggttgggcgggtaggtacgtttggggactaggttacgttttccgtctaccgacctaatccgacgccgtacccctagacgtacggtagtaagtagttaggttacgtacttagttttacttcgtcgtaccaagtactaaattaagttaactttaccgtcggtaccttcggtaccggttccgtaccggttaccggacccgggaacgggtaaccggaacggttacggtaaacctaacggtaaaaccggtaacgttggtaaccgtcggtaccgaccgtaccgtattccgttcgtacccttaccg

SEQ ID NO: 213141 - DNA, 670 bp, Homo sapiens
  misc_feature: GYAE6OF02JK6YU.21.27.C05.1.454.CMB.1.raw
  modified_base (420)..(420): a, c, t, g, unknown or other
  misc_feature (420)..(420): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
  modified_base (454)..(454): a, c, t, g, unknown or other
  misc_feature (454)..(454): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatcaaactacagcagtcgtgtaccaggactggtgacggccctcgcagtccctttcactcacgtgtcgacagtccgttaccggggaaatcgttcgcgtacggacaacgtaagtggttgggaagtttggaacgttagggccgtaacggttcccccggtacggacggtaacggtccgtttggacggttcggtaccgttagggaaacggtaccttagttactaccggtcccaggtcgtatagacgtactagngtacaggtnttacgngtacgngtacggtcgtacncgtacactaccaccgacactaccgactaaagtacacgtacgtaccgttccccacttaccgtattcggtccttaccgacctaccgtaccccgagaccgtaacggtcctttaacgttttatttccggagtacgtaagtggtactccgtacgttagttcggtacctaccgttaactccgtttacgacccgttcggtacgggtccgttagggttaacccg

SEQ ID NO: 213142 - DNA, 802 bp, Homo sapiens
  misc_feature: GYAE6OF02I3YM6.21.27.C05.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccgagccacctgtctgtgtctccgaggggggacccgccacccgtctcctgccacncgccagtcacgtctactcgctgtacttcgggtactccgtacggtaccaggactaagaaacttcgtaggaccgaggtcccgtacccgtaggtcctaccttactaccgtttccgcgtactactacccgaccgacgggacctaccgttcggtacgtcccgtaacgtaacgtacggttacgtacggggtacggtcggggttacgggtagtttacggggaacgttacggtttcgttttaccacgtaccgtaaccattaccggaccggtaccctacccggtaaacgtagggtaacggtaacgtaaagttcgttacgtttacgtaccgtttaacgtttttacggttccttaccggtccgaaggttaactaaagtttaacgtttaaacccgttacgtacgggttccgttagggttacccggtacgggttaaccggttaccgggaacggtaaacccgggtaaaccggaagggttaaccggttaaaaacctaaacgggttaaaaccggtacggttaaccgggtacggttaaccgtaccggtaacccgttaaccgtacgtttaaccgttttcgggtaacctttacccg

SEQ ID NO: 213143 - DNA, 677 bp, Homo sapiens
  misc_feature: GYAE6OF02GX5UJ.21.27.C05.1.454.CMB.1.raw
  modified_base (322)..(322): a, c, t, g, unknown or other
  misc_feature (322)..(322): n is a, c, g, or t
  modified_base (413)..(413): a, c, t, g, unknown or other
  misc_feature (413)..(413): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggagcgccaccctctcctgcacacgccagtcagtctatcgctgtactggttacgccgtggtaccagcgaagaaactcgtaggcccgaggcctacccgacggcctcctactacgttttaccggngccactccccacgacggacccacgtgggtccgtacccaggacgtacggttcgaggtcgggacggtggtagttgggactaggtcgttttccnctacacctatccgagtcccgacccgtacgtacggtagtagtaagtagttgtcgtacgttagttttactttcgtactaccgaagtactaaagttaattaacgttaccgtcggtaccgttcggtaccggttaccggtaccggttaccgggaacccggtaaccgggtaacccgtaaggggtaaccgtaaacgtaccggaaaaccggttacgtacgggtacggtacgttaacgaccgtaacctacgttccgttacgtccctttacccg

SEQ ID NO: 213144 - DNA, 766 bp, Homo sapiens
  misc_feature: GYAE6OF02JMDLH.21.27.C05.1.454.CMB.1.raw
  modified_base (202)..(202): a, c, t, g, unknown or other
  misc_feature (202)..(202): n is a, c, g, or t
  modified_base (250)..(250): a, c, t, g, unknown or other
  misc_feature (250)..(250): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccacctctctgcacgacgccagtcagtctatcgctgacttggtacnccgttggtaccagctaagaattcgcggtaccaggcctcccgaggtcctccgtactacgttttaccggtacctactcccgacgacgggtcccctaaggttcggtccgtacccaaggtaccgtacggtttaccacggggtttcgggaaccgggttaggttaaacggttttcggggaaacctaggttttacgttttttccgacctttacccgaaaccttacgttaccgaccggtacccgaccccgttaaacgtaacggggtacgttaaccggaaagttagtttacgggttacgtacgtttaaaggtttttcgtttacccgtcggtaacctaaggtaactaaactttaacgttaaacgttaccggttaccgtacggtacggttacgttaaccggttaccggttacggacccggtaaccgggaaccggttaggaaccgggttaaactaaccggtaaacgtaccgttggtacggaccgttagaacccgttaacgaccttttcggttacgtaccctttaccgg

SEQ ID NO: 213145 - DNA, 932 bp, Homo sapiens
  misc_feature: GYAE6OF02FGL5Q.21.27.C05.1.454.CMB.1.raw
  modified_base (159)..(159): a, c, t, g, unknown or other
  misc_feature (159)..(159): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatctcctgcccgtgctgggcctcccatggggtntcctgtcacagatcaaactacagcagtctggtccaggactggtgacggccctcgcacgaccctttacactccacctgtcgacactccgtaccgggggaaaattcggtcgacgtcggaccaacaagttcgggttaggaatttgggaagtttagggccaccggttccccggtcgaaggacggtccgtttagtaacggtcgggtcgttacgggaaacgggtaccttaagtttactaccggttccctaagggttgggtaacgtaggtaaacggtaccttaagttcgacgtaagtaacgtttccgtggttacggtaacgggtccgggttccgttacccgtaccgtaacccgtacgttaccccgaaccccgtaacggtaaccccgtaacccggtaacccgtaaaacgtaaccggttaccgtaacccgggtttacccttacccccgtaaccccttaacccgtaaaaccgttccggtttaaccgttccggtaacccgtaaccccgtacccccgggtaaaccggtaaaccccgtacccggggttaaccgtttttaacggttttttaacctttttcgggtaaaccggttaaccgggttaaaacggggttaccgggtaacgttaccccggttaaaaccgtttaccgggtttaacccggggttaaccggttaaccccgttttaacccccgtttacccgggttttacccggttaacccccggtttacccgggggtttaaccccggggggtacccggttttaaaacgggggggttttaacccccggg

SEQ ID NO: 213146 - DNA, 858 bp, Homo sapiens
  misc_feature: GYAE6OF02JTGCC.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctcttcctcatcttcctgcccgtgctgggcctcccagtgggtgtcctgtcacagatcaaactacagcagtctggtccaggactggtgaggccctcgcacgtacccttcactcgacctgtgacagtccgtaccggggaaaatgtcgcgtggacaactaagtggttaggaagttggaagttacgggctacgtcccccggtcgaacggtaggtccttggacggttcgggtacggttacggggtaaacggtaacccttaacgtttaacgtaccggtacccgtaggttaggggtttaacgtaggaaacgttaccgttagtaggtacgtaaggttaacttcgtaggtacggacggtccgggttcggttaccctccgtaaccctaccgtaccccgtaaccccgaacggtaacctaaacccggttacccgaaaaggttaaccgtaccggttaaccggttaccccgttaccccgttaacccccgtactttaaaaccgtcggtttccttaccggttaccgtaaccccgttaccccggaaccgtaaccccgtaaaccggggttacttttaaaccggtttttttagtttttaccggaacggttaacgtaaaaccgggttacgggttaaccttacccggtaaactttaaccggtttcccgggtaccgtttaacccgttacccctttaccggtttacccggttaaccggtttcccgggttaaccgggggttcccggtaaagggtttttaacccggg
